United States Patent 7,361,468 (METHODS FOR GENOTYPING POLYMORPHISMS IN HUMANS) - sequence listing, part 4

SEQ ID NO: 92464 - DNA, 50 bp, homo sapien
aagcttaacatatctggctggaatcrctgatactgaacaaaacaactgaa

SEQ ID NO: 92465 - DNA, 50 bp, homo sapien
cttattgtatttccttgctttctttyctgtattgattatttattcccatt

SEQ ID NO: 92466 - DNA, 50 bp, homo sapien
ttgaaaagaattaagttgttagatcrgagttatccaaaaggcattctcta

SEQ ID NO: 92467 - DNA, 50 bp, homo sapien
agacacctgacacttgcctcccaaaygagaaccaagacaatggataaaca

SEQ ID NO: 92468 - DNA, 50 bp, homo sapien
taatacttcgtttactttagataaartgctctgaaatacatttttggaag

SEQ ID NO: 92469 - DNA, 50 bp, homo sapien
gtcaccttctggaagtggtgttaaarttactggtatataaccaggttctc

SEQ ID NO: 92470 - DNA, 50 bp, homo sapien
ccccaagaaggagaggtattgagccrccaagcagctgatgcacccccagg

SEQ ID NO: 92471 - DNA, 50 bp, homo sapien
caactatcacttaattgatatacgtsacgaattttatcatgaattttaaa

SEQ ID NO: 92472 - DNA, 50 bp, homo sapien
cagtctcctagagtaatgcaacatakacaatccaccttatttgggatcag

SEQ ID NO: 92473 - DNA, 50 bp, homo sapien
tagcctgatctagacaatttaattcyaatcatgctgctttcttttctgta

SEQ ID NO: 92474 - DNA, 50 bp, homo sapien
attagtattattttgaaatttcagakaagcattgtggtctctaccttaaa

SEQ ID NO: 92475 - DNA, 50 bp, homo sapien
agaatttctgggtattgtagaggagratgacctggctacaataccgagat

SEQ ID NO: 92476 - DNA, 50 bp, homo sapien
gaatgctagagatgcctctatcagayactttcatgacaagttttagccag

SEQ ID NO: 92477 - DNA, 50 bp, homo sapien
gtcatttttataacatctacgatcaytataactttaaaggctaaaatgtt

SEQ ID NO: 92478 - DNA, 50 bp, homo sapien
tggagaacactttatttatttcaaasactgctaacattctcctgttgtaa

SEQ ID NO: 92479 - DNA, 50 bp, homo sapien
tcttctctcaaatatgttatgtcaaytgggttttaataagggctagatgg

SEQ ID NO: 92480 - DNA, 50 bp, homo sapien
tcagaagtgatccattgtttgaaaartagaacatcaatgtctttttaatt

SEQ ID NO: 92481 - DNA, 50 bp, homo sapien
gtttcttttaacaaaatttatgaccratattttacaaatgacaattctct

SEQ ID NO: 92482 - DNA, 50 bp, homo sapien
attaagttatcttattgtgatttaayagaataagcaaatctgaagagcaa

SEQ ID NO: 92483 - DNA, 50 bp, homo sapien
agatctgtgctctggttattggaacrctcatgtctttcattcggacatgg

SEQ ID NO: 92484 - DNA, 50 bp, homo sapien
taatgttttctaaatttatgctgacygatgtagagatcttcctccctttt

SEQ ID NO: 92485 - DNA, 50 bp, homo sapien
tctcctcatataacttgaagtccacyaacagaaataggtgaatataaaaa

SEQ ID NO: 92486 - DNA, 50 bp, homo sapien
taaattcaaattattaaacacaatamccttgataaaattatagcttgaat

SEQ ID NO: 92487 - DNA, 50 bp, homo sapien
atcatactgcaatcatgataacaatwatgtccaaataagtgatttaatac

SEQ ID NO: 92488 - DNA, 50 bp, homo sapien
acagattttgtaaagggctgattaamgatcctccactcctctggccacag

SEQ ID NO: 92489 - DNA, 50 bp, homo sapien
ataagggagaaatattgcatgcctcygctgagctgtcaacaatgaaacat

SEQ ID NO: 92490 - DNA, 50 bp, homo sapien
atgtgataagccagaaaataagggasaaatattgcatgcctctgctgagc

SEQ ID NO: 92491 - DNA, 50 bp, homo sapien
tcctttagcattagagcaatggaaaktcagccccacctgctctgaggaaa

SEQ ID NO: 92492 - DNA, 50 bp, homo sapien
aaatgtactcaaataaattacctaaraagtgcataggtaacaacttttaa

SEQ ID NO: 92493 - DNA, 50 bp, homo sapien
acttctgacattttaaatctcaacaytaatgataaacatcgttttatgct

SEQ ID NO: 92494 - DNA, 50 bp, homo sapien
ataagtttcacattaatatccaccartaatatgctagtacacaaaaatgc

SEQ ID NO: 92495 - DNA, 50 bp, homo sapien
tagaccaattttcaattaaacttcastgctttcaaagtggtgaaagagtg

SEQ ID NO: 92496 - DNA, 50 bp, homo sapien
ggtctgagttctgtctttacctcaaytataaggttaagtacagataaata

SEQ ID NO: 92497 - DNA, 50 bp, homo sapien
ggtatcaaagtagatgggccaaaaaygaactattatgcactataggaata

SEQ ID NO: 92498 - DNA, 50 bp, homo sapien
gtaaagaatgagaggaagaatttgasaatactctgttatgaggtatctgt

SEQ ID NO: 92499 - DNA, 50 bp, homo sapien
caaaatacttcattcttttctttgayagtcgattgcttcttccccaaatg

SEQ ID NO: 92500 - DNA, 50 bp, homo sapien
atcataaatgaagccatttactcaayctacttataaaatctgccctgcac

SEQ ID NO: 92501 - DNA, 50 bp, homo sapien
tgaatgcctgaagattttgtggtgcrtagggcgattgccatctgattggt

SEQ ID NO: 92502 - DNA, 50 bp, homo sapien
ttttcatgtgaaagtgagaagcatgrgaaaagctaggaaagaaaaaaccc

SEQ ID NO: 92503 - DNA, 50 bp, homo sapien
ctgccacattatgagtagtatacaamtggcaatggccatgaatgttatta

SEQ ID NO: 92504 - DNA, 50 bp, homo sapien
aactctaaaggcggatgtggtagcaytcagggatatttttgagtctaggg

SEQ ID NO: 92505 - DNA, 50 bp, homo sapien
gtgcttctccaacatgaatgtgcatwaaaaaaatacctagggagcttatt

SEQ ID NO: 92506 - DNA, 50 bp, homo sapien
tgacaagaccttaacactctgaaccyatctcttagaccacattccccagc

SEQ ID NO: 92507 - DNA, 50 bp, homo sapien
ctcagtatttaattcagctagtacargtaaaataatgtaaaatagtaaat

SEQ ID NO: 92508 - DNA, 50 bp, homo sapien
tgagagctcatctaggtaatccaacsagagtcactgtaacacagaactag

SEQ ID NO: 92509 - DNA, 50 bp, homo sapien
caaagaaaaacaaagcaatgatttaragaaagcagcctttaaacggaagg

SEQ ID NO: 92510 - DNA, 50 bp, homo sapien
aatgaagttggtctacattgatgaartgggtgttcgctatgagtttgtag

SEQ ID NO: 92511 - DNA, 50 bp, homo sapien
aggtagtcttcctctcactcttagaytcaggaaattattgtcatagctgg

SEQ ID NO: 92512 - DNA, 50 bp, homo sapien
atcatctccagcctcacaaactaaaytagccagtctgtcttaatgtgtga

SEQ ID NO: 92513 - DNA, 50 bp, homo sapien
acatgtaagtgttaatagcggatcakcttggtgtgtttgttggaagaaag

SEQ ID NO: 92514 - DNA, 50 bp, homo sapien
tgtttctattaaaatagtgtatgtamatagtttcaaaagaagactacagt

SEQ ID NO: 92515 - DNA, 50 bp, homo sapien
ttgggtgctgagaaaatgtcataacygaatagagatctttttttagccta

SEQ ID NO: 92516 - DNA, 50 bp, homo sapien
cctatgtcatgtaattaaccagataytgagccttcaggagggaaggagac

SEQ ID NO: 92517 - DNA, 50 bp, homo sapien
attattttttcctaactgtgatggcmaaattctccttcagtgggttgaag

SEQ ID NO: 92518 - DNA, 50 bp, homo sapien
ctgtcatctttacccactgagtgtcmacatggaatatgaagaaagacttt

SEQ ID NO: 92519 - DNA, 50 bp, homo sapien
atcttcacttatattcaatgtctaayatgtatcacatactgatatggtta

SEQ ID NO: 92520 - DNA, 50 bp, homo sapien
tattcactctcagcctagatgttagrcacaagggaactggtgtgtacata

SEQ ID NO: 92521 - DNA, 50 bp, homo sapien
agataagatacaggtataatagatamaaagtagcaattgctaagtacaat

SEQ ID NO: 92522 - DNA, 50 bp, homo sapien
aggtatttttatctactgaaagagayggtacagggcatggaaggaggata

SEQ ID NO: 92523 - DNA, 50 bp, homo sapien
aatgtacatgcacattgatagttacsgagaatggtggatctcctggagcc

SEQ ID NO: 92524 - DNA, 50 bp, homo sapien
gttgacaaagtaatgaatataaagawcagacatatgaaaaagtaacaaat

SEQ ID NO: 92525 - DNA, 50 bp, homo sapien
tatgatcaccattgttatttgtcccragcaagaagagaagaaatgtgggt

SEQ ID NO: 92526 - DNA, 50 bp, homo sapien
tgccttataattatagattccagacwaccgaagcaaaagatgtgtttgca

SEQ ID NO: 92527 - DNA, 50 bp, homo sapien
ttttcttttacaaaatttgcacactrtattaccggaaagtgaagtaaata

SEQ ID NO: 92528 - DNA, 50 bp, homo sapien
aatccaacctccctgccatggttgcratattctgtcatccagctgtttaa

SEQ ID NO: 92529 - DNA, 50 bp, homo sapien
tgtgaattcaagctatcacacagtaygaaaatatagaaaatgttttgata

SEQ ID NO: 92530 - DNA, 50 bp, homo sapien
atacactatttagaggactagatgayggtcttcaagttgaattcacatct

SEQ ID NO: 92531 - DNA, 50 bp, homo sapien
gagatgttggtgagacatccaagtaraaattgttgcagaatattgtatct

SEQ ID NO: 92532 - DNA, 50 bp, homo sapien
ttaatatagctatggtttgaattaartagttgattgcctataagtgattg

SEQ ID NO: 92533 - DNA, 50 bp, homo sapien
gttggttgatctaaagaggagagtasaaatgatacatcataatttctgcc

SEQ ID NO: 92534 - DNA, 50 bp, homo sapien
ttctaagcattgttatttgtgaaggraaggatcatttttcttgcataatg

SEQ ID NO: 92535 - DNA, 50 bp, homo sapien
tgaactctcctcagagacttttccamtcagaacaacgccacagtccagtc

SEQ ID NO: 92536 - DNA, 50 bp, homo sapien
aatgctggtccagggacaactctgasaaggatttataccaaaccactagt

SEQ ID NO: 92537 - DNA, 50 bp, homo sapien
tagaagacataattcatcagtcacaracatcaagacctcagtgagaaatt

SEQ ID NO: 92538 - DNA, 50 bp, homo sapien
ctctccaagcagctattatcaatcargaagttggtatttgaattagcacg

SEQ ID NO: 92539 - DNA, 50 bp, homo sapien
tcccatgatgtgttcattcctctaakgtaatcactgttaaaatgcacaaa

SEQ ID NO: 92540 - DNA, 50 bp, homo sapien
cagacacgtctcacatgtaacctagraacatagtttattctaaagacaag

SEQ ID NO: 92541 - DNA, 50 bp, homo sapien
tgtgatgttaacttaggatgcctgcrgttgtcaaggccatggaatctagg

SEQ ID NO: 92542 - DNA, 50 bp, homo sapien
atgatttaatctcaagtgccaagaayctaaattggaaacaatatattctc

SEQ ID NO: 92543 - DNA, 50 bp, homo sapien
gcagattaaaacaattcacttatgcyatttgggtcaaacactcagggttg

SEQ ID NO: 92544 - DNA, 50 bp, homo sapien
aaatcagccaggattcaatcattacrctgtttttgagtttatgatttaat

SEQ ID NO: 92545 - DNA, 50 bp, homo sapien
acactgaactcatttctgaagctcayggacaaactatgtaaaatctcaag

SEQ ID NO: 92546 - DNA, 50 bp, homo sapien
tagcatatcttagtaccattcacaamaactccaagaggcaggtagttcag

SEQ ID NO: 92547 - DNA, 50 bp, homo sapien
ctgtgagttttaaaatagctaaaacragacagatgaaaactaaatatggt

SEQ ID NO: 92548 - DNA, 50 bp, homo sapien
gcacccttctagatatggcattaaartgtgattgctacagaattgtcaca

SEQ ID NO: 92549 - DNA, 50 bp, homo sapien
tcttataaacaggaaattttgacacrgagctacatacacagatagaacgc

SEQ ID NO: 92550 - DNA, 50 bp, homo sapien
ggatttgagcatttagtatatgacartaggaataaggaaatagtaaagac

SEQ ID NO: 92551 - DNA, 50 bp, homo sapien
agcagatggtgcttaggaacctactraataaacagtctcagctacacttt

SEQ ID NO: 92552 - DNA, 50 bp, homo sapien
tgaagataaaatttaataatgccaaraagttaaggtatttttatagtcag

SEQ ID NO: 92553 - DNA, 32 bp, homo sapien
atttgttctaaaataaygaactaccaaactga

SEQ ID NO: 92554 - DNA, 50 bp, homo sapien
ggaaatgcattgaattacatctgtcygaaaggatagacactgttctacga

SEQ ID NO: 92555 - DNA, 50 bp, homo sapien
tagctccactctctcatctgccctcyaaatatctgaagcaaattccagac

SEQ ID NO: 92556 - DNA, 50 bp, homo sapien
aatgagttttgaaatatttgaaagaygcagaatcctagtcaattaatatg

SEQ ID NO: 92557 - DNA, 50 bp, homo sapien
acttgattagctcttttatactgaayccaggtaggtgagatacaagaggt

SEQ ID NO: 92558 - DNA, 50 bp, homo sapien
ctattttataagattggaaacaggamgaggttaagtcataccattagagg

SEQ ID NO: 92559 - DNA, 50 bp, homo sapien
tatttttagtttctgctattcataaraaaataagaaaaatactaacttcc

SEQ ID NO: 92560 - DNA, 50 bp, homo sapien
gtaaactggactaagtttatagagakagattggaacaataacaatgggat

SEQ ID NO: 92561 - DNA, 50 bp, homo sapien
gtgtttgccagcctaatgaagattawatcaactccagcctgggaatatga

SEQ ID NO: 92562 - DNA, 50 bp, homo sapien
cttcttcctaacaacctttcttacartagaaccatcctttctctctgact

SEQ ID NO: 92563 - DNA, 50 bp, homo sapien
tactttagggcatcaatttcaataastgttgtggaattctccaggcaatg

SEQ ID NO: 92564 - DNA, 50 bp, homo sapien
ctacatgttctagattatagctagaytcaacactagagtaaataaaggtc

SEQ ID NO: 92565 - DNA, 50 bp, homo sapien
gtacagctctagagtatatacaaaamttatcattcaccttatatgaaatg

SEQ ID NO: 92566 - DNA, 50 bp, homo sapien
acatctcatgcccttgaaaaggttayctgacatcttgtaggccagatcca

SEQ ID NO: 92567 - DNA, 50 bp, homo sapien
tcagggagaggatgactctgcaatgmcaagtggattacctagctttatca

SEQ ID NO: 92568 - DNA, 50 bp, homo sapien
gagggagagtgagaacagaggcaacrcttgatgtaaaaaacatttctgtt

SEQ ID NO: 92569 - DNA, 50 bp, homo sapien
aatacaaaagtgagagtgccttttarcctacattagggaggtgggagtaa

SEQ ID NO: 92570 - DNA, 50 bp, homo sapien
aggagctttcttccactttgtgttaygtactatctcttttgagaatattt

SEQ ID NO: 92571 - DNA, 50 bp, homo sapien
agacaaaatcattagacgacaagtaygcttcattgaaaaagaggtgcatt

SEQ ID NO: 92572 - DNA, 50 bp, homo sapien
gccaaataattctacaaacaagatgraaacttaagcattatggatgaact

SEQ ID NO: 92573 - DNA, 50 bp, homo sapien
cttacttggtattatcaaagtcataygtgtagagaagagtccgtaagttt

SEQ ID NO: 92574 - DNA, 50 bp, homo sapien
agtccataaaataatttaccagtacrcagtctatatatactacctcagag

SEQ ID NO: 92575 - DNA, 50 bp, homo sapien
tgccaatactgctggttcaagaatcrcatttgaatagatagcttctagaa

SEQ ID NO: 92576 - DNA, 50 bp, homo sapien
taatgttgaactctgtcctcaatgcyaaagtttaggatggactctaagtt

SEQ ID NO: 92577 - DNA, 50 bp, homo sapien
tatatacaagacactacattagttakttaagcttacattcttgtcaagag

SEQ ID NO: 92578 - DNA, 50 bp, homo sapien
caggaggatggggaaaagctttagaraagaggtggcattttattggtgcc

SEQ ID NO: 92579 - DNA, 50 bp, homo sapien
tttgcttttgtcttttaattgggatsatacatatatatattggtttttcg

SEQ ID NO: 92580 - DNA, 50 bp, homo sapien
tggcattttattggtgccttgatacragagtagattcagacatgcagaga

SEQ ID NO: 92581 - DNA, 50 bp, homo sapien
atgctggagccaatgtctattttcaygatggccgtaaaacaaagcaataa

SEQ ID NO: 92582 - DNA, 50 bp, homo sapien
ggctcaataagctcactgttgtctakggtttatacacctcagctgttagg

SEQ ID NO: 92583 - DNA, 50 bp, homo sapien
ttcactaaagtgcaaacaatggagtraatcagagtgagaaaacataatat

SEQ ID NO: 92584 - DNA, 50 bp, homo sapien
tattaaaagaaaagttatggttttayaccaacatctatatctgtatgtat

SEQ ID NO: 92585 - DNA, 50 bp, homo sapien
aaacagcaacaacagcaaaaccttayagattatgtacatatgcaataagc

SEQ ID NO: 92586 - DNA, 50 bp, homo sapien
gtaaataaaaatcaaatggcataaaygaagaagtgtgattacatcaaata

SEQ ID NO: 92587 - DNA, 50 bp, homo sapien
agctattaggtgatgctgataatgcragtttatggaacacactttgcaga

SEQ ID NO: 92588 - DNA, 50 bp, homo sapien
aaagcagcaagaaagtgtattcacartaacagtaattattcataatgaga

SEQ ID NO: 92589 - DNA, 50 bp, homo sapien
atttaccaacatgagggagaattgtwaatagtagaatagaatggaggaaa

SEQ ID NO: 92590 - DNA, 50 bp, homo sapien
acagcaatagttattatgtcatgaayatctgctttgtatttcacaaagac

SEQ ID NO: 92591 - DNA, 50 bp, homo sapien
aaacagtttttgaagagtaactgtgrtaggttccgaagttggtatctttc

SEQ ID NO: 92592 - DNA, 50 bp, homo sapien
ttgctgtttgcttctcatgtcagcastatggctcagaaggaagcaccata

SEQ ID NO: 92593 - DNA, 32 bp, homo sapien
cacagcagaatgctacmagacagtcaaagaag

SEQ ID NO: 92594 - DNA, 50 bp, homo sapien
actctgaattagtagattttcctgcraagtggtaataacagggttaatgt

SEQ ID NO: 92595 - DNA, 50 bp, homo sapien
tgtccatggaggcctagaacacaacygatgggaacctcttcacgcttcct

SEQ ID NO: 92596 - DNA, 50 bp, homo sapien
ctgttgtaaaatttgaaagagaatcrgaaggcaacacccaaactgctgct

SEQ ID NO: 92597 - DNA, 50 bp, homo sapien
aatatatttccattctggtgaatcargagaaaatacatttgtttcattct

SEQ ID NO: 92598 - DNA, 50 bp, homo sapien
acccaccacctaccatcttacatcargttgtaaaccaaaaacatagagat

SEQ ID NO: 92599 - DNA, 50 bp, homo sapien
acaggtttttcatgttgaaacgccasaatgctgggtgaagacatcttgtg

SEQ ID NO: 92600 - DNA, 50 bp, homo sapien
ttacatgggatcagaatcagatgtcratgaataatttgtttttgtacgtt

SEQ ID NO: 92601 - DNA, 50 bp, homo sapien
ttagagtgggactatagcatccacastgggacaaaagagatgatcatgtt

SEQ ID NO: 92602 - DNA, 50 bp, homo sapien
ggttgccccagcagaggctccctcaraggttgactatttataactatata

SEQ ID NO: 92603 - DNA, 32 bp, homo sapien
gagaagccttagaagamaccaactaatcctgc

SEQ ID NO: 92604 - DNA, 50 bp, homo sapien
gaaggaattagtttctcaggcatcasgattttcactggcagttggtttca

SEQ ID NO: 92605 - DNA, 50 bp, homo sapien
ccttcatagatgggttacagaatgtyaataattttggccaaaacagcggt

SEQ ID NO: 92606 - DNA, 50 bp, homo sapien
ggaatgactacgggggacatcgttgraaaactgtaccataatgtgcccat

SEQ ID NO: 92607 - DNA, 50 bp, homo sapien
caatttattctccactttggcttttwacaacatggtagaacagtctgttc

SEQ ID NO: 92608 - DNA, 50 bp, homo sapien
aacaatgaaataataacgagaaatayaacgtgaggtgtaggaatgaacat

SEQ ID NO: 92609 - DNA, 50 bp, homo sapien
tttactttatggcagtgccaaaatasaaggggtgtgttctgtcctctcct

SEQ ID NO: 92610 - DNA, 50 bp, homo sapien
tgtacatacaaattttcatgtttgasaactcttatatttgcagtcacata

SEQ ID NO: 92611 - DNA, 50 bp, homo sapien
aatgaagctcattatttctatgggaragaatatcataggtagtggaatgt

SEQ ID NO: 92612 - DNA, 50 bp, homo sapien
gtgtgagaatggactaatacagaaamaatacttgcagtttatccatctga

SEQ ID NO: 92613 - DNA, 50 bp, homo sapien
tggacaaatcacttcactttatgtayctcaattctaacattcttcaaatg

SEQ ID NO: 92614 - DNA, 50 bp, homo sapien
aaagaaaactagctcagaacaatccragaattatgtgagatacacaaaat

SEQ ID NO: 92615 - DNA, 50 bp, homo sapien
ttaaagattaggtaatttgctaggaygtcaactagataaaatgtctattt

SEQ ID NO: 92616 - DNA, 50 bp, homo sapien
acacacacacatagtttacaatgggwacacttaagagagataaaaataaa

SEQ ID NO: 92617 - DNA, 50 bp, homo sapien
agaataaataaagcaatcttcgatayagtcagtaaagttgtcaatcttac

SEQ ID NO: 92618 - DNA, 50 bp, homo sapien
gctgggaagttgttagaactcagaasactccaaagggaacataaggtctt

SEQ ID NO: 92619 - DNA, 50 bp, homo sapien
atatgaataatcttaaggacatttcrcctcctcggaatttttgaagcatt

SEQ ID NO: 92620 - DNA, 50 bp, homo sapien
tgagaaaatcattgcaacaatgtagyaatgggtagttttgtgtaccaggg

SEQ ID NO: 92621 - DNA, 50 bp, homo sapien
acagatacgcaaaggtgttttggtayctgtattctttctctaacagttat

SEQ ID NO: 92622 - DNA, 50 bp, homo sapien
atgaagaccatgtatttgatggagakgttatttaaatggtaactttgtta

SEQ ID NO: 92623 - DNA, 50 bp, homo sapien
tttttttctattcacattatgaggtycaaaaattggtatatggaagttca

SEQ ID NO: 92624 - DNA, 50 bp, homo sapien
caataaaactaatctggccagtaaasgaaaacctattgcttttcaaccaa

SEQ ID NO: 92625 - DNA, 50 bp, homo sapien
aatataaaccattagtccttctgtaycatatcctgttttattttctcata

SEQ ID NO: 92626 - DNA, 50 bp, homo sapien
catgagggacatgtgttggttatagyacagaatgatggaacacaaggctg

SEQ ID NO: 92627 - DNA, 50 bp, homo sapien
aggagtagtgatgctcaggagtatamatgcctcaaaagggacaactagga

SEQ ID NO: 92628 - DNA, 50 bp, homo sapien
ccgcccaagtgtctttacactgcagratcaccttaagaactggagcaaag

SEQ ID NO: 92629 - DNA, 50 bp, homo sapien
ccaagtcctatagctttagaatcacrgaagctgatgctgtaattcgcagt

SEQ ID NO: 92630 - DNA, 50 bp, homo sapien
atatattttggataatgtaggactaygacaacaagaataaattttattgg

SEQ ID NO: 92631 - DNA, 50 bp, homo sapien
cttgtatgatgtttgctaatagtagyggcctacaaatctgtgggcaaact

SEQ ID NO: 92632 - DNA, 50 bp, homo sapien
acttacacatatgtgtaaataaacayaagaatagtgaaataggcattcat

SEQ ID NO: 92633 - DNA, 50 bp, homo sapien
ataattattataggtcctcatcactrgaaacaaaaagggtccttcttcag

SEQ ID NO: 92634 - DNA, 50 bp, homo sapien
ggagtatgtgcacatgagagctatayaaccagaaattatgtgaaggaaga

SEQ ID NO: 92635 - DNA, 50 bp, homo sapien
taaacaacatacatatcttgctaaaytatatggtaccgaagtttggaact

SEQ ID NO: 92636 - DNA, 50 bp, homo sapien
tagttcctgacttattatttttaaaytgtactaagatggcagcatcatct

SEQ ID NO: 92637 - DNA, 50 bp, homo sapien
aattttaatatagaaattcatagtartacacaaattttcatttccaattt

SEQ ID NO: 92638 - DNA, 50 bp, homo sapien
tttaattaacaagtatcttttgctakagaatgaaatcaaagctctgtata

SEQ ID NO: 92639 - DNA, 50 bp, homo sapien
cactccctgatcgccattacacataycttaaccgagtaactcatattcat

SEQ ID NO: 92640 - DNA, 50 bp, homo sapien
ccttttgaatatagattggttattayggaaatgaagacatattttatccc

SEQ ID NO: 92641 - DNA, 50 bp, homo sapien
ttctttggatgtccaagtatcttaaytagatgaaaactcatccttaatat

SEQ ID NO: 92642 - DNA, 50 bp, homo sapien
acattaattaaactgtttgagaagastcaccctctaatcttttttgaaaa

SEQ ID NO: 92643 - DNA, 50 bp, homo sapien
tgccacttatgttaatttatcagcamccttaattgtgaagaagtgtcagt

SEQ ID NO: 92644 - DNA, 50 bp, homo sapien
agagaagagaagcttaactctgtcamggatattaggagaggctttgctga

SEQ ID NO: 92645 - DNA, 32 bp, homo sapien
ttctataattcctctcrtgccctgcctaggac

SEQ ID NO: 92646 - DNA, 50 bp, homo sapien
ttgtaaacagtttactaaaggcataractatctaaatgctctgagacata

SEQ ID NO: 92647 - DNA, 50 bp, homo sapien
tccacccaagttaattgaggctagawtcattcctgcgacatctatggcaa

SEQ ID NO: 92648 - DNA, 50 bp, homo sapien
caagtgtatcttctctcactatataycatcactacagcaagaaacgagtg

SEQ ID NO: 92649 - DNA, 50 bp, homo sapien
aagcaaattgacacaaacgtttacckatacaagttattatattaaagcag

SEQ ID NO: 92650 - DNA, 50 bp, homo sapien
gatatggatgttatcttttctgatayctccatcaaaggtgagtaaacatg

SEQ ID NO: 92651 - DNA, 50 bp, homo sapien
tcccatcgcatggattttcatttagrccatatcctctcttagggtcagct

SEQ ID NO: 92652 - DNA, 50 bp, homo sapien
ttttctgtcttctcaggaatgtgtaygtaaacagaatcatgtattttgtg

SEQ ID NO: 92653 - DNA, 50 bp, homo sapien
ttgacatgggtgaatgaaattggaargtcatgtacatcaggcaaacagga

SEQ ID NO: 92654 - DNA, 50 bp, homo sapien
ataggttttaaaatattgttctaaaytaagactgcttgacataagtattt

SEQ ID NO: 92655 - DNA, 50 bp, homo sapien
cacacattctactagaggctttagaygatacaccatgtgtccttgccttt

SEQ ID NO: 92656 - DNA, 50 bp, homo sapien
atctcacagctcagaatgatttgtaraatgatactgcttgattttgggag

SEQ ID NO: 92657 - DNA, 50 bp, homo sapien
gaattttttcccaattatttcatgamtataagtcaattcctcaaaggata

SEQ ID NO: 92658 - DNA, 50 bp, homo sapien
agacccacccacattatggagggcamcctattttactctaccaattaaaa

SEQ ID NO: 92659 - DNA, 50 bp, homo sapien
ttatgtctcttatactaaataaaacrccagatctattaaaatagaaactt

SEQ ID NO: 92660 - DNA, 50 bp, homo sapien
ccagaggaaagtaacaatttagttgsagaagccgaatcttctaaaaatgg

SEQ ID NO: 92661 - DNA, 50 bp, homo sapien
agctatgctttctatgttctttttcrcttcaaacgttgtctagcattcag

SEQ ID NO: 92662 - DNA, 50 bp, homo sapien
actgacattttttttgtggcaaagargatcacaataattcaaagtgtaag

SEQ ID NO: 92663 - DNA, 50 bp, homo sapien
ttgttctcactgttacaagctgaaayggattcataatttgggcttaccat

SEQ ID NO: 92664 - DNA, 50 bp, homo sapien
tctcagaaacagtagacttcagtgcygattttctgactctaattctgaag

SEQ ID NO: 92665 - DNA, 50 bp, homo sapien
ctcagttcccagaccactctccccartacgcacagtaatatgactgggca

SEQ ID NO: 92666 - DNA, 50 bp, homo sapien
gcactcagcctcctttctgatattaygtaaaaaccaggttcttttccaat

SEQ ID NO: 92667 - DNA, 50 bp, homo sapien
ccaaggtcacacagcaaataagcaayggaaccagaattcaaactcaagca

SEQ ID NO: 92668 - DNA, 50 bp, homo sapien
tagagcccaggtctcttgactcccartacagacactttctccttccttgc

SEQ ID NO: 92669 - DNA, 50 bp, homo sapien
tccttcacaaaccatattcttcaaasagttaacgctgaggattctgaaaa

SEQ ID NO: 92670 - DNA, 50 bp, homo sapien
gtgactcccaaatacagagaacttcrattccttcagataaagcaatagag

SEQ ID NO: 92671 - DNA, 50 bp, homo sapien
ttgttgaatgattaaatgggtactaygaacggtgaataaacatgtcattt

SEQ ID NO: 92672 - DNA, 50 bp, homo sapien
ccctctgagacacagtgaggctgaayaactaacttgccaaggtcacacag

SEQ ID NO: 92673 - DNA, 50 bp, homo sapien
agccctttagaactattaacttaccyaatccttacaaccactctatgaaa

SEQ ID NO: 92674 - DNA, 50 bp, homo sapien
gtatacttaccttatgaaacagatayagttaaaagaacaggtgtgcccac

SEQ ID NO: 92675 - DNA, 50 bp, homo sapien
gtggacagagtccttttcacctaaayattcatctctgtgctagctgtcat

SEQ ID NO: 92676 - DNA, 50 bp, homo sapien
aaataactcacacaagtgaaagtgayggaaaaagaggtggagattactag

SEQ ID NO: 92677 - DNA, 50 bp, homo sapien
tttctcttttgatttccttctaccaygatttatgaagcggtcacagcatt

SEQ ID NO: 92678 - DNA, 50 bp, homo sapien
gatcaaacttgtttggagcccatagkaggaagttcccacaagacagagtg

SEQ ID NO: 92679 - DNA, 50 bp, homo sapien
ttctctttttcttaaaggtgcagaamatagttaatggaaaactccagtta

SEQ ID NO: 92680 - DNA, 50 bp, homo sapien
gtttttcaattttgttatgttgatakgtactgcatgataccagattacaa

SEQ ID NO: 92681 - DNA, 50 bp, homo sapien
cacaaacatcctctaaagccagacawtcagccctttcctcaatcagtctc

SEQ ID NO: 92682 - DNA, 50 bp, homo sapien
tttgtgcactctgcctttcctatacrcgctgatgccccaatccatttgtt

SEQ ID NO: 92683 - DNA, 50 bp, homo sapien
atcaactggcttttaggaggaactascaagtttagttactacatcttcac

SEQ ID NO: 92684 - DNA, 50 bp, homo sapien
acccaatgtgaaagcttagtgcctaygatcaattctctcagagtactgga

SEQ ID NO: 92685 - DNA, 50 bp, homo sapien
atatgctataatcaatgaaggtttgraataaatgagatgcttattgaaca

SEQ ID NO: 92686 - DNA, 50 bp, homo sapien
gtcactggaattattattatgagaaygtctttgggccccatttgtgccaa

SEQ ID NO: 92687 - DNA, 50 bp, homo sapien
acatctaatacttcattgtctcttarcatcactatatgtgctcatcaatg

SEQ ID NO: 92688 - DNA, 50 bp, homo sapien
taagaagcaaatcctcatgcattaargtttaatcataaaactgcagcaat

SEQ ID NO: 92689 - DNA, 50 bp, homo sapien
ggtttacaattccataaatgaggacraggaaaaggattcaaggtcatacg

SEQ ID NO: 92690 - DNA, 50 bp, homo sapien
aagggtcaagtaaagtaatagaatargcatattttacactacaaagataa

SEQ ID NO: 92691 - DNA, 50 bp, homo sapien
atgcccaaatgtagctaaaaaaatcracgtgagtacagtgagacacaatt

SEQ ID NO: 92692 - DNA, 50 bp, homo sapien
ctggggctgagagacatcaaaagggwactcttaagttatgaaagacgatc

SEQ ID NO: 92693 - DNA, 50 bp, homo sapien
agggtcacttcatgcatttggagaayattaagaagctgagattgtccctg

SEQ ID NO: 92694 - DNA, 50 bp, homo sapien
agtcctgtttttctcattgatgtacygagtgctcaacgtatcccgggcac

SEQ ID NO: 92695 - DNA, 50 bp, homo sapien
gataattctgaatcctacttcttaasctaagccaaaatgggaggtgaaaa

SEQ ID NO: 92696 - DNA, 50 bp, homo sapien
tcaaccccattttatatacaaatgaygtaagtagcttatccaaagtccca

SEQ ID NO: 92697 - DNA, 50 bp, homo sapien
gctgggtatgagctctgtgacttccsgatgacatgattattggccaaatc

SEQ ID NO: 92698 - DNA, 50 bp, homo sapien
aacgttggcacaattaagaagtttawctgacaataacagaacccaaggaa

SEQ ID NO: 92699 - DNA, 50 bp, homo sapien
gagaaagacaatttggtttcattgaygtttcattcataggctctcgttcc

SEQ ID NO: 92700 - DNA, 50 bp, homo sapien
atgttttctggcaatatctaagaaayagtctcttggccaggtgtcatggc

SEQ ID NO: 92701 - DNA, 50 bp, homo sapien
tttggactcagaagaatctggctttraatatctgccttaccacatttttt

SEQ ID NO: 92702 - DNA, 50 bp, homo sapien
tttggaaatagtatactgcttttaaygcatcgtatacttgttgtcagacc

SEQ ID NO: 92703 - DNA, 50 bp, homo sapien
aatgtctacatgacagagttatcaaratgaatgctacaatactttcaaac

SEQ ID NO: 92704 - DNA, 50 bp, homo sapien
aaaagcacatttcacatatgcaaagkacaagaattattttgtccctaaga

SEQ ID NO: 92705 - DNA, 50 bp, homo sapien
tagcatggcatgcagaatttcacccracctataatctctttacacatcct

SEQ ID NO: 92706 - DNA, 50 bp, homo sapien
gttttctgctcttcctaaagattcargatgtaataatatactgtcacagg

SEQ ID NO: 92707 - DNA, 32 bp, homo sapien
cattccaggtcatttcyagctttaggaatatt

SEQ ID NO: 92708 - DNA, 50 bp, homo sapien
acttgggcagaggggtttgaggagaygatgatgatattctagagcagtca

SEQ ID NO: 92709 - DNA, 50 bp, homo sapien
gaggtttctgggatgacgtttgctcrgtcttatttcatgcctgagtataa

SEQ ID NO: 92710 - DNA, 50 bp, homo sapien
acaagcctataggtaaggaagaatcsactgctggtaattcaagaactcca

SEQ ID NO: 92711 - DNA, 50 bp, homo sapien
ttctcaaatatttcacttggccgtawcttacagactcagggatgctctca

SEQ ID NO: 92712 - DNA, 50 bp, homo sapien
gaaccatgctagatggtgctgtctawatggaagctctttatctacacaga

SEQ ID NO: 92713 - DNA, 50 bp, homo sapien
cagcttgtccctgcagttatctatayggctggtaatctcctctccctctg

SEQ ID NO: 92714 - DNA, 50 bp, homo sapien
ttatatttaaaattcagaaaggaaaygattgggattgcactcaaagaaag

SEQ ID NO: 92715 - DNA, 50 bp, homo sapien
tctcaaccactttacaaggtagctawaattaagcacattttgctgatgag

SEQ ID NO: 92716 - DNA, 50 bp, homo sapien
ccaatagacctgccttgcaagaaacrttaacagaagttcttcagaaagaa

SEQ ID NO: 92717 - DNA, 50 bp, homo sapien
ttattcacatattcattcagttgacyaacagttactgaatgcttacgatg

SEQ ID NO: 92718 - DNA, 50 bp, homo sapien
aatttccctagttaattgttgtaackcttatttccaggacagtagtagtt

SEQ ID NO: 92719 - DNA, 50 bp, homo sapien
tgactgttaggatggtgtgagctcargtaacatcgtaatgcctaaccttg

SEQ ID NO: 92720 - DNA, 50 bp, homo sapien
acatggaatccaggagaagtggtcaygtgtacatctaagataaaagccag

SEQ ID NO: 92721 - DNA, 50 bp, homo sapien
tattattcagcatgtattcatgccasgaacactaattatataattcctaa

SEQ ID NO: 92722 - DNA, 50 bp, homo sapien
tgagagaaaaaatatcatttcttctsattaaatctcctgcattaaatcta

SEQ ID NO: 92723 - DNA, 50 bp, homo sapien
ttcttgtatcacctcagtgccgagtraagtgtgatacaaagtggggactc

SEQ ID NO: 92724 - DNA, 50 bp, homo sapien
acatattttaggatatagcaaacaaygaaaggagtgaaatgagaggaaat

SEQ ID NO: 92725 - DNA, 50 bp, homo sapien
gataatatacaatatgcaaataatayaccaaagaacagagtcttgatcaa

SEQ ID NO: 92726 - DNA, 50 bp, homo sapien
agtattaataacaataaaaacaataygtaaagcataggcaaagtgctaag

SEQ ID NO: 92727 - DNA, 50 bp, homo sapien
ccaatttctgcaaaaagctagcggarattctgaaggggattgcattgctg

SEQ ID NO: 92728 - DNA, 50 bp, homo sapien
gatctctcagcatacctgtgtggacragataaagaaatatggctagatgc

SEQ ID NO: 92729 - DNA, 50 bp, homo sapien
gttgttttcctggaagggcaagaaaygtgtattgcattatagaacaaatc

SEQ ID NO: 92730 - DNA, 50 bp, homo sapien
ggccttgtactaccgctgccataaayaatagctttggtgtcagccaacca

SEQ ID NO: 92731 - DNA, 50 bp, homo sapien
gtattttcatttcgatgtgctgtagsattgtatttgttaatatttttgta

SEQ ID NO: 92732 - DNA, 50 bp, homo sapien
tattgttaatgcaaacttaggtggtraaactatacagcaaatcaaggaaa

SEQ ID NO: 92733 - DNA, 50 bp, homo sapien
aaacactgggggctatttgtattgaygccaaaactctggactcctctgcg

SEQ ID NO: 92734 - DNA, 50 bp, homo sapien
aagcctctggccctagcacttcctaygaaaaggatctgagagaattaaat

SEQ ID NO: 92735 - DNA, 50 bp, homo sapien
gagtcctcagaggccctaaaccttaygtcaaatgttatctgtatatgcat

SEQ ID NO: 92736 - DNA, 50 bp, homo sapien
caaatgccaggctggatgatgaaaargagatccctccactccaatatttt

SEQ ID NO: 92737 - DNA, 50 bp, homo sapien
tcgcttcttaaggatgaatggtagayaactccatagcctttccattttag

SEQ ID NO: 92738 - DNA, 50 bp, homo sapien
atgactcagactttgttgggtttggyagccaaaatggccaagattatttt

SEQ ID NO: 92739 - DNA, 50 bp, homo sapien
tttttgggcctccttgttgtacctcyactaagctgcgagggagaataggt

SEQ ID NO: 92740 - DNA, 50 bp, homo sapien
atatgactcttaagtcagatagcagragcttaactagattctaagtcttg

SEQ ID NO: 92741 - DNA, 50 bp, homo sapien
agttcacacaggccgtcaaagataaygcaggaactcagatggtggtttcc

SEQ ID NO: 92742 - DNA, 50 bp, homo sapien
taactagttgaaacttgattgctacmaaattagaaatggaggaaattata

SEQ ID NO: 92743 - DNA, 50 bp, homo sapien
gtttccgctggtaacccaatatacartatcttctccagaaaaacaaatgc

SEQ ID NO: 92744 - DNA, 50 bp, homo sapien
tttccctggatttcctgtattctcaraagcatggtgtcactgaattcagc

SEQ ID NO: 92745 - DNA, 50 bp, homo sapien
atgttattgtacttatactttcaaakatcatttcatgcatctgttttata

SEQ ID NO: 92746 - DNA, 50 bp, homo sapien
aaccaagtaatagcccacagaaaatkgacatttgttagtttttataaact

SEQ ID NO: 92747 - DNA, 50 bp, homo sapien
agtgaagacaacctactagagcagaraagaatggtcaaaggaagtggctc

SEQ ID NO: 92748 - DNA, 50 bp, homo sapien
ccttggagtgcaaagcattaacttaraccattggaacatccctcctttag

SEQ ID NO: 92749 - DNA, 50 bp, homo sapien
tagtcctgtttccagtggagactccraagctaccttcatgcttaactttc

SEQ ID NO: 92750 - DNA, 50 bp, homo sapien
taaaaaggaagctaactcattttctsaagggataattcaataagataaag

SEQ ID NO: 92751 - DNA, 50 bp, homo sapien
tgcatttcctcttccactagatactraaaaggaattatcacactgattgt

SEQ ID NO: 92752 - DNA, 50 bp, homo sapien
atgtatgtgtaaagcatttttcaatracatatataaagtagaaacaaatt

SEQ ID NO: 92753 - DNA, 50 bp, homo sapien
aagctgtagcatccctaaaccaagayaaatgtctactatcagtcccaaac

SEQ ID NO: 92754 - DNA, 50 bp, homo sapien
atgaaagatggttagaattttgacaygtagaaatgaacaacaaagcattt

SEQ ID NO: 92755 - DNA, 50 bp, homo sapien
ctgaggtttgctctaagggattaaaygaagatgtatgtgatggtatttat

SEQ ID NO: 92756 - DNA, 50 bp, homo sapien
accctctggcctggagtcaggaaaaytgggttcgagcccattgactcttt

SEQ ID NO: 92757 - DNA, 50 bp, homo sapien
gaaaatgaacgaatctttagcagtarccacaaaggatatgcctgatcata

SEQ ID NO: 92758 - DNA, 50 bp, homo sapien
aaaaatttccaattgagaaagtaagyagattatagatgaccaggtatctc

SEQ ID NO: 92759 - DNA, 50 bp, homo sapien
tcctccctcatctcaaagggtcctcmaagctctgacgatctaagatacaa

SEQ ID NO: 92760 - DNA, 50 bp, homo sapien
ttggaaaattgcttacatatagtatkaagaagaaaacagccaggtagaaa

SEQ ID NO: 92761 - DNA, 50 bp, homo sapien
agagtagtttaggagaccgtactaayatggagtccacgctacagctgggt

SEQ ID NO: 92762 - DNA, 50 bp, homo sapien
catatattttttctgtatgccatgaygtagactgaaagcaacctgatggc

SEQ ID NO: 92763 - DNA, 50 bp, homo sapien
tgtaattgtgattagtgctaccatgkaaaagtggaagatgcagtgttctc

SEQ ID NO: 92764 - DNA, 50 bp, homo sapien
atcagaattctttggtgaaatgttasaaaatatagaccacttctctctgc

SEQ ID NO: 92765 - DNA, 50 bp, homo sapien
gaatgtgctttggaaagcctctctcrctttaatagacattcgtattatca

SEQ ID NO: 92766 - DNA, 50 bp, homo sapien
atgctgaaagttgttcagacccttcmagttcaagatcacatgcatctctc

SEQ ID NO: 92767 - DNA, 50 bp, homo sapien
tagggaaagctgtcatattccaggarcaagggtaactgcaaagtaatttt

SEQ ID NO: 92768 - DNA, 50 bp, homo sapien
acttggacaaagggtgataggagacmaagattaggatttaagctctggca

SEQ ID NO: 92769 - DNA, 50 bp, homo sapien
ggaccggggaccagaatgctcttccyaaatcaaatagaaaacaggaaggc

SEQ ID NO: 92770 - DNA, 50 bp, homo sapien
ttacatcagtgctccaattgcattgytccatagctgttctcaacctggaa

SEQ ID NO: 92771 - DNA, 50 bp, homo sapien
cccaaaatgcccatatgcagtctgcraggttttcagtgtccccgggataa

SEQ ID NO: 92772 - DNA, 50 bp, homo sapien
cattattactagattgatgtagcagrattttggcatgtttatcttagtgt

SEQ ID NO: 92773 - DNA, 50 bp, homo sapien
cataggatgtattgtgtgctagcagyctatgtttgaacagctctgtttta

SEQ ID NO: 92774 - DNA, 50 bp, homo sapien
gtggtaactgaaatgtctaaaatcaygtatgtgtgttgcattataatttc

SEQ ID NO: 92775 - DNA, 50 bp, homo sapien
ttagtgtagcacagaaggaagtgatsaaatgttaaacattgctttttggg

SEQ ID NO: 92776 - DNA, 50 bp, homo sapien
ctcagcggggcactcatacaagggcyaacttggaaagggacagataccag

SEQ ID NO: 92777 - DNA, 50 bp, homo sapien
tgggagacatctattattcttcctaygagtttatccaaaagagaaaataa

SEQ ID NO: 92778 - DNA, 50 bp, homo sapien
atatcaatttgaagtggcagttccakccagttaaaaaataaaaagtatgg

SEQ ID NO: 92779 - DNA, 50 bp, homo sapien
agagcttctgtcctgtagaatccaawccaaccaaagtggtgccatattcc

SEQ ID NO: 92780 - DNA, 50 bp, homo sapien
acctttcatccactgtgtacagagayagaataatattttgatatagttat

SEQ ID NO: 92781 - DNA, 50 bp, homo sapien
tctcaataattgttggactataaaamatcaatattatgctagatcccaac

SEQ ID NO: 92782 - DNA, 50 bp, homo sapien
gttctgaagcatatttgttccacgayatgtgaaaaactgaggggcttaaa

SEQ ID NO: 92783 - DNA, 50 bp, homo sapien
aggaatacaatgggaattcataagaragagaaacattcttgagtaacgaa

SEQ ID NO: 92784 - DNA, 50 bp, homo sapien
aatacatatggagaaaatagtttcayggaatcaaagttatctggttcacc

SEQ ID NO: 92785 - DNA, 50 bp, homo sapien
tgattctctttaataacagagttgaraggtgttaatgagcatgacacagg

SEQ ID NO: 92786 - DNA, 50 bp, homo sapien
cgctttcatgacatctctatggaaarttaagaattgtagttttcttgagg

SEQ ID NO: 92787 - DNA, 50 bp, homo sapien
aaattttgaaaaatgaaaatgaatcragccctttattctcacagaaaact

SEQ ID NO: 92788 - DNA, 50 bp, homo sapien
atttatggaaccctttgattgtatartgaatcaacattttatccactaat

SEQ ID NO: 92789 - DNA, 50 bp, homo sapien
agtaatctgcagcatcactgccatayatagcacccaccaaggactccact

SEQ ID NO: 92790 - DNA, 50 bp, homo sapien
ttgaaaaacaaaattctgtagcaaaygagtccccgaaagtgttttttttc

SEQ ID NO: 92791 - DNA, 50 bp, homo sapien
atacacaaatgagctataatgtggtmaagattagtattgttaagtttctc

SEQ ID NO: 92792 - DNA, 50 bp, homo sapien
tgggagttctccaaagaatagactayatgtgtgtatttgtgtgtctgtgg

SEQ ID NO: 92793 - DNA, 50 bp, homo sapien
aacaataaactaatgaaaaacatgaygtgggcagtttaccattacgtagt

SEQ ID NO: 92794 - DNA, 50 bp, homo sapien
gatttccttgtcctcctttcttaaayggatgaaagtataggcacataaac

SEQ ID NO: 92795 - DNA, 50 bp, homo sapien
aagtaatttattgcctgcttcccaamtaatttcctctattcgaatgtcta

SEQ ID NO: 92796 - DNA, 50 bp, homo sapien
ttatcaggatgcatttagtatggatkaaggtgaaatagcaatgaaatgag

SEQ ID NO: 92797 - DNA, 50 bp, homo sapien
ccttattatccttggatatgtgtagsatctatggagctatcccctctttc

SEQ ID NO: 92798 - DNA, 50 bp, homo sapien
aagtagcaggtgtttttccttgacaygctaccgctagaccacagtctgct

SEQ ID NO: 92799 - DNA, 50 bp, homo sapien
ggccgtgctgaccatgaccctgacartgactatgaccatggccctccatt

SEQ ID NO: 92800 - DNA, 50 bp, homo sapien
gccctttgtggaattagcaagaatcmatttaactagttggctcatttgtt

SEQ ID NO: 92801 - DNA, 50 bp, homo sapien
gttgtgcagaataaggaaggtaatasagtaacatcatctaatagccacct

SEQ ID NO: 92802 - DNA, 50 bp, homo sapien
gttggaaaacaaagtgaagcgccgcmataaaatggatggggatgggaaag

SEQ ID NO: 92803 - DNA, 50 bp, homo sapien
aaacattttcctacctcaaagcatayggagataaaaaggtctcttacatc

SEQ ID NO: 92804 - DNA, 50 bp, homo sapien
ttggagaggggacctagaaatctcaytgaaagctcatacccctgccattg

SEQ ID NO: 92805 - DNA, 50 bp, homo sapien
ggtatagagcaagcatacatgaaacrgtacttattatttcaagcagatca

SEQ ID NO: 92806 - DNA, 50 bp, homo sapien
aggttgtgtcagtcacacagcaatgyagttttagtaacctgaatgtttta

SEQ ID NO: 92807 - DNA, 50 bp, homo sapien
tttctctgtgtgacccaaatcaatcraggacaattttttttttcttcttt

SEQ ID NO: 92808 - DNA, 50 bp, homo sapien
tgagtgctgtgagaactgacttgacraataaagcctgtcaggggattttg

SEQ ID NO: 92809 - DNA, 50 bp, homo sapien
cttcagtttcttcataagatggaaaygctataccttacctacctcgtaaa

SEQ ID NO: 92810 - DNA, 50 bp, homo sapien
cagagagtatgttttgacttaaaatrtaccattcatcagttaactttcta

SEQ ID NO: 92811 - DNA, 50 bp, homo sapien
ctaggttagctctcagaaagaagcaygtcctttgggaggctgaggtgggc

SEQ ID NO: 92812 - DNA, 50 bp, homo sapien
catttgcaattcttggggtctgtaayggccacgtgagtgatgaagaaaca

SEQ ID NO: 92813 - DNA, 50 bp, homo sapien
agtttgattcctgaggaactttggaratgatgtttcagcatctagtgaaa

SEQ ID NO: 92814 - DNA, 50 bp, homo sapien
atagtggttttaaaataaatccacayattctttgcagtgtgctcccttca

SEQ ID NO: 92815 - DNA, 50 bp, homo sapien
tgttaagaggatttcaagggtcatasgacgtgtagaaaatttagaaagta

SEQ ID NO: 92816 - DNA, 50 bp, homo sapien
ttccaaactcttcatttacagactcwataacaaagggtaagagagaggca

SEQ ID NO: 92817 - DNA, 50 bp, homo sapien
aaaggacattcagacagtattttcakggcccctcaacttttttttgttgt

SEQ ID NO: 92818 - DNA, 50 bp, homo sapien
tttaatagtatgaataatggaaagasagtaaaatgagtgtatgagtttaa

SEQ ID NO: 92819 - DNA, 50 bp, homo sapien
gagtctcacagacacaaccgagtagyggagccaagatttgacccaagtct

SEQ ID NO: 92820 - DNA, 50 bp, homo sapien
tttttcttccccaagaactgccacartggattttattatcactttttatc

SEQ ID NO: 92821 - DNA, 50 bp, homo sapien
tcttggattccttgtgtagtttataycttttgttataatttaatgctctt

SEQ ID NO: 92822 - DNA, 50 bp, homo sapien
agcagaactgtaagtattatatgcartgaccaaccacaacaagcagagaa

SEQ ID NO: 92823 - DNA, 50 bp, homo sapien
tcttggacttgaaacttggttattaygattgtagcaatatttatgtccag

SEQ ID NO: 92824 - DNA, 50 bp, homo sapien
ctccagccaagacaataaaagaagaygaaacacaagaggtgacatttgaa

SEQ ID NO: 92825 - DNA, 50 bp, homo sapien
actccagagcccttgtatttaaccawtatttagaggggcctcgactttga

SEQ ID NO: 92826 - DNA, 50 bp, homo sapien
gcacaaggttttagaaaaagaactayagaagattttgttggaaagcagac

SEQ ID NO: 92827 - DNA, 50 bp, homo sapien
gggcctcgactttgacaaaaagtaargcaagtgtgagcaaatagctcaga

SEQ ID NO: 92828 - DNA, 50 bp, homo sapien
caaagactcaagctttaaaacctcaycatttacactgtctttcctccagc

SEQ ID NO: 92829 - DNA, 50 bp, homo sapien
gtgagcaaatagctcagaagagtaaygataactgttcttatcaaggcaat

SEQ ID NO: 92830 - DNA, 50 bp, homo sapien
ctaagtataaagctgtttgaaaccayacatgactgaagttagaggggagc

SEQ ID NO: 92831 - DNA, 50 bp, homo sapien
taattaaaattctgtgcttcttagayggagacactctatgttttacaatg

SEQ ID NO: 92832 - DNA, 50 bp, homo sapien
caggcagcaaaagaaaatgtaaatayagcagtgattttacaattttgtga

SEQ ID NO: 92833 - DNA, 50 bp, homo sapien
taacagaatataccttacaggaacartagataggtataaaatgacttcgg

SEQ ID NO: 92834 - DNA, 50 bp, homo sapien
acttgaatgattcttctggaaaggaygaattagaggtaataaagggggag

SEQ ID NO: 92835 - DNA, 50 bp, homo sapien
gcctgatgaggctgtcctcaactaaygacttccgggttgtgtgatcttgg

SEQ ID NO: 92836 - DNA, 50 bp, homo sapien
gcaaaggaaagaatggataaaattaktaactcatgaaactccctctgtac

SEQ ID NO: 92837 - DNA, 50 bp, homo sapien
cccttctcctttgtaatcttctcagsctatttttcttgctgttaagttca

SEQ ID NO: 92838 - DNA, 50 bp, homo sapien
agcaaagggacgtgggtaataaacayagattctcagtgtctaaattagag

SEQ ID NO: 92839 - DNA, 50 bp, homo sapien
ttaggccccattgcaataatctaaarctaagctctaatttagacactgag

SEQ ID NO: 92840 - DNA, 50 bp, homo sapien
agaaacttgttacaaaattacaaaaytgagagtgtttgaactccaagctg

SEQ ID NO: 92841 - DNA, 50 bp, homo sapien
caaaccagttactcaccatgaaaaaytgtgatatgtaggatgagttatta

SEQ ID NO: 92842 - DNA, 50 bp, homo sapien
ttcctgggtttctactatttgtcagrccttatgcaagtggtttacacatt

SEQ ID NO: 92843 - DNA, 50 bp, homo sapien
gccagattctacatgaatgttggtamgtatttatgtaaatgtatttttaa

SEQ ID NO: 92844 - DNA, 50 bp, homo sapien
aaaacaaaaagtccagtttggaaatyagcaagatcgtgttcatgtatctt

SEQ ID NO: 92845 - DNA, 50 bp, homo sapien
acatgactttccaatttcattcaccyatgtcaaattatcacaacccccaa

SEQ ID NO: 92846 - DNA, 50 bp, homo sapien
agtgtatacgaacagaagtgaaaatkatatgtagaatcaaaagtgaaagt

SEQ ID NO: 92847 - DNA, 50 bp, homo sapien
gtagatttaagcctacccgtatcgayaagtacattaatttaattaaacac

SEQ ID NO: 92848 - DNA, 50 bp, homo sapien
ctaaggtaagcagaatatgatgaccygatagatactctggccagaatagt

SEQ ID NO: 92849 - DNA, 50 bp, homo sapien
caataataaaacctgtgacattttayggactgctaagcattttcacttac

SEQ ID NO: 92850 - DNA, 50 bp, homo sapien
tccatgttgttctccccactgacatktttcctcactttcttctgtctgga

SEQ ID NO: 92851 - DNA, 50 bp, homo sapien
ccaaggttgtacatctggtaagtgayggattaaggtctcaaacccatgcc

SEQ ID NO: 92852 - DNA, 50 bp, homo sapien
gttctgtgttgaattaatcaatcaaycttatgcggctgtctagaggtcta

SEQ ID NO: 92853 - DNA, 50 bp, homo sapien
cctcaaggtcactcctaatactgtcraccccagcacaattaccccatgga

SEQ ID NO: 92854 - DNA, 50 bp, homo sapien
atcctgaatgtttttccatagcttgyatcctgcacagggatcgtctgtct

SEQ ID NO: 92855 - DNA, 50 bp, homo sapien
tctcgtcactctctcccttatcctgmatgtttttccatagcttgcatcct

SEQ ID NO: 92856 - DNA, 50 bp, homo sapien
attttattggtgacagtttccctcayggtccaaggtaagtgacccacttt

SEQ ID NO: 92857 - DNA, 50 bp, homo sapien
tgacttggttgtcactttcactgacmaccgtgtgttaaacagcacctctc

SEQ ID NO: 92858 - DNA, 50 bp, homo sapien
cagactgcacttcagggacatcagargcggaaacctgggctggggaggtg

SEQ ID NO: 92859 - DNA, 50 bp, homo sapien
atcattttaacccccaactgtttccratcaaatgagaaacattcatggag

SEQ ID NO: 92860 - DNA, 50 bp, homo sapien
gtggggtgatccagtcctcagcaacyacagggaggatccagccactgggg

SEQ ID NO: 92861 - DNA, 50 bp, homo sapien
ggatttaaaacacagaaggaccaggratacctgcttagttataggaacct

SEQ ID NO: 92862 - DNA, 50 bp, homo sapien
ttttgtttcttttctatccatccccwatctatgtctgatgcaggagacag

SEQ ID NO: 92863 - DNA, 50 bp, homo sapien
ctaccctgagctctgcccatcgcgtmtatcaactcatccacaatggcctc

SEQ ID NO: 92864 - DNA, 50 bp, homo sapien
gctcaagagagaggcgtgaggaaccyaagaaggagaaatggaaaggagat

SEQ ID NO: 92865 - DNA, 50 bp, homo sapien
ataaactgactttattaagagacacratttgaaatggactttgaatacta

SEQ ID NO: 92866 - DNA, 50 bp, homo sapien
tttctcttggcaatgcccttgtggcyaaaggaaagtaagatctcaagatg

SEQ ID NO: 92867 - DNA, 50 bp, homo sapien
gattctagaacagcgcctgagtccasagtgagtaattaatacaggcttat

SEQ ID NO: 92868 - DNA, 50 bp, homo sapien
tctgcccagataggatgctattgggycacatgtagcctatgtgaagtcat

SEQ ID NO: 92869 - DNA, 50 bp, homo sapien
gagcatatatcagcaaataaacaaayagtatgtcaggtgataataagtgc

SEQ ID NO: 92870 - DNA, 50 bp, homo sapien
gcaaatgtgctaatctgaatccttgmaaatggcttcagatttatgccatt

SEQ ID NO: 92871 - DNA, 50 bp, homo sapien
tatgcacactttcatacaggttagasaacagtgatgcaacacaaggacct

SEQ ID NO: 92872 - DNA, 50 bp, homo sapien
atacactctaaagccagtgagatacwcagctactgaattacctagacctt

SEQ ID NO: 92873 - DNA, 50 bp, homo sapien
gcttccactgcctgctactcttctayacgaccaggccaggagcacaggta

SEQ ID NO: 92874 - DNA, 50 bp, homo sapien
tagacactcctatctacttgccgttrtttacatttatgtctgtccttata

SEQ ID NO: 92875 - DNA, 50 bp, homo sapien
agaggaatgcagcttgtccagcctaygctaatgtggactctcacagttcc

SEQ ID NO: 92876 - DNA, 50 bp, homo sapien
gtaaaaggtattctgagtccaattayaggatgtttttaacttcaacacta

SEQ ID NO: 92877 - DNA, 50 bp, homo sapien
accagccatgcccatgataggggtcrccttaattctagctcgacaaaatt

SEQ ID NO: 92878 - DNA, 50 bp, homo sapien
tcattttcttgcttaactgagatcargttgggaatttagaaaacatccaa

SEQ ID NO: 92879 - DNA, 50 bp, homo sapien
ggtatcagaggaagctccaaagtacraaatagttgccataaaccataatc

SEQ ID NO: 92880 - DNA, 50 bp, homo sapien
catttcatgtaatactcacaacaacmcgtatgaagcagtctgattctcat

SEQ ID NO: 92881 - DNA, 50 bp, homo sapien
atgtgtttacatacatttagttgaartctagcaacatatctaagaactag

SEQ ID NO: 92882 - DNA, 50 bp, homo sapien
atgccaagtcaattctttctaggtcrggtccaaacaatactatggagtgc

SEQ ID NO: 92883 - DNA, 50 bp, homo sapien
caaactgcacagcccacactcctagraagtcatgataagtaaacagcatg

SEQ ID NO: 92884 - DNA, 50 bp, homo sapien
ctgtgaatgccccctggctgacgtgktgcccatcaggacctgcggtcaaa

SEQ ID NO: 92885 - DNA, 50 bp, homo sapien
aactttcttcccttttatgggctgayccctcttctacatgctgtttactt

SEQ ID NO: 92886 - DNA, 50 bp, homo sapien
aacctaagtttcattatctcccttayaaggttttgtcctggtccccttct

SEQ ID NO: 92887 - DNA, 50 bp, homo sapien
acatgagagtcagtggatgtgtgccratctcctgaaactccaggtgcctg

SEQ ID NO: 92888 - DNA, 50 bp, homo sapien
tgtacctaccctcctagcatgacaamgaaacataaagtgttcaaagcggc

SEQ ID NO: 92889 - DNA, 50 bp, homo sapien
tgccctgagagctggggtactgagargtattatatcattttgttccatgc

SEQ ID NO: 92890 - DNA, 50 bp, homo sapien
agaaaattgtccttattttacagacrcaaaagctcaccaggtgaggggat

SEQ ID NO: 92891 - DNA, 50 bp, homo sapien
aacaacaaaaaaatcttgttactaawgatctgtgagaactgtctctttta

SEQ ID NO: 92892 - DNA, 50 bp, homo sapien
attcagttagctggctagttaaacargatgcatgaaacagagctgctgag

SEQ ID NO: 92893 - DNA, 50 bp, homo sapien
tcctcagccctctgcccacagtgtcrcagaacataacacaggaggactcc

SEQ ID NO: 92894 - DNA, 50 bp, homo sapien
aaaggtgtccctattagacttactayatcttaaaacactaaattagaaca

SEQ ID NO: 92895 - DNA, 50 bp, homo sapien
aaacttcaagagcatctgaatgagamgaaatcaaattatggtccccctca

SEQ ID NO: 92896 - DNA, 50 bp, homo sapien
acatctggaggttttcacatctaatwagttacagaaactgagagtatgac

SEQ ID NO: 92897 - DNA, 50 bp, homo sapien
gccctttactgctgtgtcctataacraaagatgtggcatgacctctgcaa

SEQ ID NO: 92898 - DNA, 50 bp, homo sapien
tcaaagtgcttgacttactacccagsatacatgaccacctgagtaaggcc

SEQ ID NO: 92899 - DNA, 50 bp, homo sapien
atttctatcgatgatgaagtttccakacctcagtgcacaagatactgatc

SEQ ID NO: 92900 - DNA, 50 bp, homo sapien
aagtattcacagcagcaagaacaaayaatcataattggttagagtgaaaa

SEQ ID NO: 92901 - DNA, 50 bp, homo sapien
aataaactcataataataatgctaasaatgatgataatagccactaccat

SEQ ID NO: 92902 - DNA, 50 bp, homo sapien
agcaaaagtccaagtagataaaagaygaagctcctatgaagcttatcatg

SEQ ID NO: 92903 - DNA, 50 bp, homo sapien
gcctccttaacaaagtgagtacaaamtagtctctgaaactaaatctttga

SEQ ID NO: 92904 - DNA, 50 bp, homo sapien
gacactcaagagcagtttacagacaygtgtagtctatttgcttctttata

SEQ ID NO: 92905 - DNA, 50 bp, homo sapien
tgaaactaaatctttgagaatagttwaaaaattacaaaatgtaagaacat

SEQ ID NO: 92906 - DNA, 50 bp, homo sapien
attgaggcctccaccattgcggagasgacatggatgctgagcagtcccct

SEQ ID NO: 92907 - DNA, 50 bp, homo sapien
gcagaaaatggggagaattgtatggyataggcggatatgaaggtagaatc

SEQ ID NO: 92908 - DNA, 50 bp, homo sapien
tggcgaccagggttcactgacctacratcggttgactcacatgaacaccc

SEQ ID NO: 92909 - DNA, 50 bp, homo sapien
gccccaagcccctcaagcactctgayctaggaaagccagtgaagcaagga

SEQ ID NO: 92910 - DNA, 50 bp, homo sapien
ttttttctaattaaacatttttagcrattttcatctaagcattcacttct

SEQ ID NO: 92911 - DNA, 50 bp, homo sapien
taacttctacttttttttcttctcargcaagattgtatctgagttaaaac

SEQ ID NO: 92912 - DNA, 50 bp, homo sapien
taagggcacacgctggagggaataaygttaaaattaggaataagaggata

SEQ ID NO: 92913 - DNA, 50 bp, homo sapien
attgttggcttacagaaatccttcastagacatttgaggtcttccaatat

SEQ ID NO: 92914 - DNA, 50 bp, homo sapien
tggaaaaaaagtatcctgaaatctcrccttcatagctgaatggtttcaat

SEQ ID NO: 92915 - DNA, 50 bp, homo sapien
gtgaacagagcaggtgctgaccaagracaggttaaacctagttcaactta

SEQ ID NO: 92916 - DNA, 50 bp, homo sapien
gattgaaggagttcattatttgcctygactgtctctaatttttaccacag

SEQ ID NO: 92917 - DNA, 50 bp, homo sapien
gcttgacagtccatctagtgctatgragtatttcctaggtacacgatgga

SEQ ID NO: 92918 - DNA, 50 bp, homo sapien
tattgaaacgagcacgtgtttattasccactcatcagggagactgaagtg

SEQ ID NO: 92919 - DNA, 50 bp, homo sapien
ggataggatttcccattgttcctaayttaactaaatctcagtactttttt

SEQ ID NO: 92920 - DNA, 50 bp, homo sapien
gtgcccagacacgtttggcccttgamcacttgaaaaggatagttattggg

SEQ ID NO: 92921 - DNA, 50 bp, homo sapien
gacgtagcaatcacgattttcttggwcaattatcaactctcacactgaaa

SEQ ID NO: 92922 - DNA, 50 bp, homo sapien
atactctgcttgaatacctgtcatcytagagaaaaaacatagcctttgga

SEQ ID NO: 92923 - DNA, 50 bp, homo sapien
tttctatttttgtgtaaggtttttawcattcataatatattcgtaggtat

SEQ ID NO: 92924 - DNA, 50 bp, homo sapien
tttctctagaaatttatccgtaacasactgtttaacacattgcagttttg

SEQ ID NO: 92925 - DNA, 50 bp, homo sapien
tagattttgttggtgaagaaatgggyatatttagggaagacagcctacct

SEQ ID NO: 92926 - DNA, 50 bp, homo sapien
gagcacgtaggaggggctgtttcagkaaagttctcaccaccaaagcccta

SEQ ID NO: 92927 - DNA, 50 bp, homo sapien
aaaggcatcacacgacaggctacaarggggcattctaattcaaaccttct

SEQ ID NO: 92928 - DNA, 50 bp, homo sapien
gcagccactgtgattgactactggarcattccatcatcggccatttctgt

SEQ ID NO: 92929 - DNA, 50 bp, homo sapien
tactgtaaggcttgacacactgtatwataaatccccgtttttatctggca

SEQ ID NO: 92930 - DNA, 50 bp, homo sapien
gcccaagggcatggttgcccattcayataaaccattgtgagcagcttcct

SEQ ID NO: 92931 - DNA, 50 bp, homo sapien
gactgagactataagtcagtaaaagyaagggatgaaaatactgtccatat

SEQ ID NO: 92932 - DNA, 50 bp, homo sapien
ccattgggtctgggttagtgtatttygcagtgtcacagacagcacagtgg

SEQ ID NO: 92933 - DNA, 50 bp, homo sapien
gttcaatggcaattttagacagatcraacatatttcagttagacaattta

SEQ ID NO: 92934 - DNA, 50 bp, homo sapien
ttgcctagattaactagaaaagccartaacgacacaaagacaaaccaaac

SEQ ID NO: 92935 - DNA, 50 bp, homo sapien
ttggagtctgacctcccctggcacasggtttgagatggtctttacccggc

SEQ ID NO: 92936 - DNA, 50 bp, homo sapien
agttatggtgttataaaacagagggwccgaaagactctcacagggaagca

SEQ ID NO: 92937 - DNA, 50 bp, homo sapien
aataccgttgtcattttttgaatccraaccctaggtccttgagctagaac

SEQ ID NO: 92938 - DNA, 50 bp, homo sapien
ctccacatcaatacccagcttcaaarggagcctccaagcaaagtgttttt

SEQ ID NO: 92939 - DNA, 50 bp, homo sapien
aatttgaactcgcagttcagataaaygacgaataactttttagcatgagt

SEQ ID NO: 92940 - DNA, 50 bp, homo sapien
tgcttgcctggcatactggatgttamatgattttcaatctcatcttaggt

SEQ ID NO: 92941 - DNA, 50 bp, homo sapien
ggcaagccctaccttcaatatagatsaaactcagcccctacagtgaagta

SEQ ID NO: 92942 - DNA, 50 bp, homo sapien
cagcttttctgcgaaacaggatggayatagattgttagtggaggagggct

SEQ ID NO: 92943 - DNA, 50 bp, homo sapien
acatcctctattccctcatcaccgaycatctttattgagtctcgaagcca

SEQ ID NO: 92944 - DNA, 50 bp, homo sapien
aatctttgttaaatggacaagcatayggatgagtgattctcaaacagcat

SEQ ID NO: 92945 - DNA, 50 bp, homo sapien
acatgataacaaactcatgcattaastacatcagagcctttattattctt

SEQ ID NO: 92946 - DNA, 50 bp, homo sapien
ggaaccacgagggagtatggttgcamatcaaggcctgcatctgcccccct

SEQ ID NO: 92947 - DNA, 50 bp, homo sapien
accagtgtttggagaacctgatccaygatgatagtttataacagaatagt

SEQ ID NO: 92948 - DNA, 50 bp, homo sapien
gtcaacagcccaacatgggactggaygataggcatttctctagataaagc

SEQ ID NO: 92949 - DNA, 50 bp, homo sapien
caactaaaggcagcatcgtgtattgragaaaacatgactgggagctccag

SEQ ID NO: 92950 - DNA, 50 bp, homo sapien
agcatttcagatgataaccaacttayagtgactatggatgactgaagctt

SEQ ID NO: 92951 - DNA, 50 bp, homo sapien
gtgaattttctaagaaggctccacamaacttcttcaaagtacatttacgt

SEQ ID NO: 92952 - DNA, 50 bp, homo sapien
gactttactcattaaattatatgacrcttcacaaaggaggggggcgaagg

SEQ ID NO: 92953 - DNA, 50 bp, homo sapien
tgagcagcaaatacctgtttaactcrattggagtgttggtcacgatccct

SEQ ID NO: 92954 - DNA, 50 bp, homo sapien
cactggtccctgactgccctttctgwactgcaagctccttgcctttttta

SEQ ID NO: 92955 - DNA, 50 bp, homo sapien
aacccctgttgggagttaaagacggyagataaagagctgttaatatgaat

SEQ ID NO: 92956 - DNA, 50 bp, homo sapien
aacgaaagccacgtttgtgattctcrcttcttccattacttaccttctaa

SEQ ID NO: 92957 - DNA, 32 bp, homo sapien
aacatctagtatcaaarcatgttcaactggaa

SEQ ID NO: 92958 - DNA, 50 bp, homo sapien
ttcatatacaatcataaaacactccraatacccagaacaatcctgagcag

SEQ ID NO: 92959 - DNA, 50 bp, homo sapien
taacaatcaaagcaatatttattcargaaacacggctgaatctcagtaag

SEQ ID NO: 92960 - DNA, 50 bp, homo sapien
ccttggagaactattcattggttcartattcaagaagaggtcatatagta

SEQ ID NO: 92961 - DNA, 50 bp, homo sapien
ttcatggctaatatggagttactaayatgtaggtatgcagaaattttagc

SEQ ID NO: 92962 - DNA, 50 bp, homo sapien
cagattttacaatgaggatcctggcygcaacacagtgaatggattggagg

SEQ ID NO: 92963 - DNA, 50 bp, homo sapien
aaagaaagaggaatgggtgctgacastgtaaaacaacagatacccactta

SEQ ID NO: 92964 - DNA, 50 bp, homo sapien
aggggaagaaagaggcaatctgcatrgcatcagaacagaaaactaggact

SEQ ID NO: 92965 - DNA, 50 bp, homo sapien
ttcattcattcaagaaatatgtggaygcctcgttttgccaggtcttatcc

SEQ ID NO: 92966 - DNA, 50 bp, homo sapien
atgtttttttatttacttagttcttygacgcagagcttttcctgtacaca

SEQ ID NO: 92967 - DNA, 50 bp, homo sapien
tccaaaattaactgatatctttatakgtttattatccatcttattcacta

SEQ ID NO: 92968 - DNA, 50 bp, homo sapien
atcatgatgccctgagagtaaagatrctaaccagccagagagattctgtt

SEQ ID NO: 92969 - DNA, 50 bp, homo sapien
gccagtgctatgccgtccttacggcrcttgggcaggtacccccagcttga

SEQ ID NO: 92970 - DNA, 50 bp, homo sapien
atgaatgaactaagcaatccattaawcttctcctggctactacatgtata

SEQ ID NO: 92971 - DNA, 50 bp, homo sapien
ctaattaactggttagttaattacaycctgttgcctccgaagaacatcct

SEQ ID NO: 92972 - DNA, 50 bp, homo sapien
gcaacacccacctgctactctcacaraagaatcttacgcttggattcctg

SEQ ID NO: 92973 - DNA, 50 bp, homo sapien
gctcgttgaaggtgcctttgtaaaaygttagtgaatcacgttaagcaaag

SEQ ID NO: 92974 - DNA, 50 bp, homo sapien
acatcatggtaaactccaatatgccmggaagtggtttagttttctcactg

SEQ ID NO: 92975 - DNA, 50 bp, homo sapien
aacacaagtaaatgctcaagtttaargttcttctggctgaagcataaagc

SEQ ID NO: 92976 - DNA, 50 bp, homo sapien
catcagaaaaagcccagggacacatsatggtaaactccaatatgccagga

SEQ ID NO: 92977 - DNA, 50 bp, homo sapien
acacagagaaatccactgtccctaamgcaattaagttcacaaggcaaagg

SEQ ID NO: 92978 - DNA, 50 bp, homo sapien
cagattggtctcccaaccttagttascaagatgtcaccatgtgatccctg

SEQ ID NO: 92979 - DNA, 50 bp, homo sapien
aaattagttcctgtatgtcctgtatraaaaccttgaagcaaataatttct

SEQ ID NO: 92980 - DNA, 50 bp, homo sapien
atgttgtgtatgtgattcttgcttartaagaaaaggagctttctgataga

SEQ ID NO: 92981 - DNA, 50 bp, homo sapien
acagcatttggggactgcagtttgtytcagccaagaactagagcttggaa

SEQ ID NO: 92982 - DNA, 50 bp, homo sapien
atagcattaggagaaatacctgatgwagacgatgggttgctgtgtgtagc

SEQ ID NO: 92983 - DNA, 50 bp, homo sapien
aagcttcaagttttatcttaagaackgcatatttcaggaaactatttttt

SEQ ID NO: 92984 - DNA, 50 bp, homo sapien
ccaattacatcccaaataaaatccgmagactctcagaatcatatatacac

SEQ ID NO: 92985 - DNA, 50 bp, homo sapien
tggggtagtggtttcatgatttttayggttagcaaaatcctttcagctga

SEQ ID NO: 92986 - DNA, 50 bp, homo sapien
gctcccagaggctaagccagctgacygggatcacaaagtaaatggttttg

SEQ ID NO: 92987 - DNA, 50 bp, homo sapien
aaaatcttcaaaaattgtcctgattyaataagaaaatacaacatcctaaa

SEQ ID NO: 92988 - DNA, 50 bp, homo sapien
acttgtccaaagactcaggcaaggasgtagcatagccgtgagggtctggg

SEQ ID NO: 92989 - DNA, 50 bp, homo sapien
aaataagcagctgagattaaaaaaamatatgtaccacatcattgtcatca

SEQ ID NO: 92990 - DNA, 50 bp, homo sapien
gttggcaagataatataaaatatgaytatggtctttactaaatgtcagtt

SEQ ID NO: 92991 - DNA, 50 bp, homo sapien
gtgtgaacctgtatatgaaacaggamtattggaatttgctgtgttcaaaa

SEQ ID NO: 92992 - DNA, 50 bp, homo sapien
ccagggggtgtgcttaggtaggaaayctgccgggcaccttcctcatctag

SEQ ID NO: 92993 - DNA, 50 bp, homo sapien
ggtgtcagttcttttcgacacagaasagcgcatctataaccagaggggca

SEQ ID NO: 92994 - DNA, 50 bp, homo sapien
agcttctttctgcttggtttcctaawatgtgaatgccgtgaaaggaaatt

SEQ ID NO: 92995 - DNA, 50 bp, homo sapien
attgccctgccttggagattcaaccrccagggaccagagcttcaagccca

SEQ ID NO: 92996 - DNA, 50 bp, homo sapien
accacatctgatataggaaatgtcawgttgtaaggatcctggtctcctct

SEQ ID NO: 92997 - DNA, 50 bp, homo sapien
gcaaagaattagagaatgttattaamaagcacaaagattcaagcagagaa

SEQ ID NO: 92998 - DNA, 50 bp, homo sapien
attaaaacaataagctaaatttcacrgactgttaacctctgaacaactgc

SEQ ID NO: 92999 - DNA, 50 bp, homo sapien
ataggagtgcctggttgttgttcccrattcactggctcaggcatagcatt

SEQ ID NO: 93000 - DNA, 50 bp, homo sapien
acagggacaggataaggcccattggyaagggaagaatgaaggggtgaaat

SEQ ID NO: 93001 - DNA, 50 bp, homo sapien
ctcccccagaagtttagctttgaaamagatgtgcaaaaaaaagcgaggga

SEQ ID NO: 93002 - DNA, 50 bp, homo sapien
tgcttttcctgagtttccgacattcygtattagacatatgttgctcattt

SEQ ID NO: 93003 - DNA, 50 bp, homo sapien
tttctgtggactggggctattaaccrggaacatgactgagttttggatat

SEQ ID NO: 93004 - DNA, 50 bp, homo sapien
tattcaagatttagtcatgtgtaaartgaaagtggtgcctgccttcacag

SEQ ID NO: 93005 - DNA, 50 bp, homo sapien
gttattcctggagacccagcccagasactgctgatttaggcttctccttc

SEQ ID NO: 93006 - DNA, 50 bp, homo sapien
actctctcccaaataagaatgggaayggaaaataaaaaggacaaatactt

SEQ ID NO: 93007 - DNA, 50 bp, homo sapien
gaaatcaaatcctcatagaaaattaratgcttccaaatctaatggatata

SEQ ID NO: 93008 - DNA, 50 bp, homo sapien
aaaaaaagtacctattgcacttttcratagtctttatgcctagctaggaa

SEQ ID NO: 93009 - DNA, 50 bp, homo sapien
atgagtgctgcattatgggagctcaytatctgctcagtgggttcctgcag

SEQ ID NO: 93010 - DNA, 50 bp, homo sapien
tctgcagtttccctccatgatgcaaygaagatttctcagtaaagaatatt

SEQ ID NO: 93011 - DNA, 50 bp, homo sapien
tgggagaagaggtgctttatgataaygcaggcctgtacgataacttgccg

SEQ ID NO: 93012 - DNA, 50 bp, homo sapien
ttttaatgtctgtcttctctaactaygtataaactccacaggcaaggacc

SEQ ID NO: 93013 - DNA, 50 bp, homo sapien
attcactgatttattcattcaagaartaatgactcatcacctactctggg

SEQ ID NO: 93014 - DNA, 50 bp, homo sapien
ggtttgaatataaccccacaagatcmatatcctcctggaagctgtgaatg

SEQ ID NO: 93015 - DNA, 50 bp, homo sapien
acatgctaagatctgttgagcttatyacataacaggtactaagtatctca

SEQ ID NO: 93016 - DNA, 50 bp, homo sapien
tctgcatgcaacctcaaatactatayggagatggtgatatggtggagaca

SEQ ID NO: 93017 - DNA, 50 bp, homo sapien
taaacttaaatagaaatatacaggcraaagatagtacttgatgagataaa

SEQ ID NO: 93018 - DNA, 50 bp, homo sapien
catgtggattgtactctaggtggacyatcatgcatacccactgagatggc

SEQ ID NO: 93019 - DNA, 50 bp, homo sapien
gtactcctgtgatacagaagctctaycattcccattttatacattcagag

SEQ ID NO: 93020 - DNA, 50 bp, homo sapien
cacgtagaaagcacttacactaacargtaatcaaaagtcagttttctccc

SEQ ID NO: 93021 - DNA, 50 bp, homo sapien
cacaacgtaacaggatgtgaattacyctctaagtaccattctatatggca

SEQ ID NO: 93022 - DNA, 50 bp, homo sapien
tattcattgttttttttctatccaartacagcttaattcacatatttcca

SEQ ID NO: 93023 - DNA, 50 bp, homo sapien
catacttcctctcagcaatagatgakgacattttggactcagccacctaa

SEQ ID NO: 93024 - DNA, 50 bp, homo sapien
gggtgtcacccccactgcactgctgytttcctatgattggtttgacagct

SEQ ID NO: 93025 - DNA, 50 bp, homo sapien
aatgttctccggaagaactggaaaasgtatcagtgggctatgttcaggtc

SEQ ID NO: 93026 - DNA, 50 bp, homo sapien
catctgcagggaggagggtggtctawcacaggtgagtttcatctactttc

SEQ ID NO: 93027 - DNA, 50 bp, homo sapien
gtgaatagttaccttctgtttcagaragaataggttcccacaagccattt

SEQ ID NO: 93028 - DNA, 50 bp, homo sapien
atcaaacaagttatactaatcagaarcagggaaaagtttaagagcagcaa

SEQ ID NO: 93029 - DNA, 50 bp, homo sapien
atggaggagggaatgaatgaatgtcyatctgtgctcaacagcagatagtg

SEQ ID NO: 93030 - DNA, 50 bp, homo sapien
tgatagttactacacaattgaaagasgttaaaagctagaagtattcacag

SEQ ID NO: 93031 - DNA, 50 bp, homo sapien
agagcaatgagactgattatctgcaraatatgagtgaagatcattaccaa

SEQ ID NO: 93032 - DNA, 50 bp, homo sapien
accgactggttaaatgaaatatggcygagtaaaagatagaatgttaaaca

SEQ ID NO: 93033 - DNA, 50 bp, homo sapien
agccctctagccagaataaagtcagyttgtgaggtaaaaagatttaaaaa

SEQ ID NO: 93034 - DNA, 50 bp, homo sapien
tttacctaagggtttgatagcgttakgttctccatttaggcctttaataa

SEQ ID NO: 93035 - DNA, 50 bp, homo sapien
acttatggaatattaatcaagttagwcactgtattttcaccgtatgcact

SEQ ID NO: 93036 - DNA, 50 bp, homo sapien
caacataaatactgtgtgtattatcyagtattccaatcaatatttgttct

SEQ ID NO: 93037 - DNA, 50 bp, homo sapien
atagcccaccttttctatctgaaackgcatccccaattgctggaccttgt

SEQ ID NO: 93038 - DNA, 50 bp, homo sapien
aaaattagaaaaaatgcattattcastatgtttccattacttttatatat

SEQ ID NO: 93039 - DNA, 50 bp, homo sapien
aaaaaaaaattcatcaggttgaagayagttttacaaattacttagttgaa

SEQ ID NO: 93040 - DNA, 50 bp, homo sapien
tgggataatccattatttttgacacmaatgtgtatgataatccacatttt

SEQ ID NO: 93041 - DNA, 50 bp, homo sapien
aagagatggcacatttgccgtcttcrctctaggaacattcggatgggaga

SEQ ID NO: 93042 - DNA, 50 bp, homo sapien
ttggagtttatagaaaataaggggasatgatggattatgagaggaagctt

SEQ ID NO: 93043 - DNA, 50 bp, homo sapien
tgcctgagtgagccttataatcagayggtgtaagcttccctgcgtaaaac

SEQ ID NO: 93044 - DNA, 50 bp, homo sapien
ttctggttctctgaaggaccctaackaatacacctcccctccctcattct

SEQ ID NO: 93045 - DNA, 50 bp, homo sapien
aagtactgtttgaactgaaatctaamgggatgaatttgtcacccacccag

SEQ ID NO: 93046 - DNA, 50 bp, homo sapien
gaaatatacaaaagagggcatcccamagtgagacgggccagagatacact

SEQ ID NO: 93047 - DNA, 50 bp, homo sapien
agatttaagatttaaaaattagtagygtttctacatgctaacagtgaaca

SEQ ID NO: 93048 - DNA, 50 bp, homo sapien
ccctcatggagtttataatctagtasagagctacacataaatagaatatt

SEQ ID NO: 93049 - DNA, 50 bp, homo sapien
ggcatgcttgccttctacttatccaygggaacagagtttggatggtgtgt

SEQ ID NO: 93050 - DNA, 50 bp, homo sapien
gcacagatagagtacatcaaatctcmacgaagtttgctagcagttccttt

SEQ ID NO: 93051 - DNA, 50 bp, homo sapien
aagacacattacattccacttccgayggactacagctctgctctctcctt

SEQ ID NO: 93052 - DNA, 50 bp, homo sapien
ctcttggactttcagtcaccaaaatyatgaaccaaataaacctctttctt

SEQ ID NO: 93053 - DNA, 50 bp, homo sapien
gtcacaataacctgcagtaacctgcsatggtcaaaatagtccaaagattc

SEQ ID NO: 93054 - DNA, 50 bp, homo sapien
attacctttgctatcaccaacttacrcatgagaaaatgggagcagagaaa

SEQ ID NO: 93055 - DNA, 50 bp, homo sapien
ttacaaaacagaaacataaagttcayctcatcatgtagtatggatcactc

SEQ ID NO: 93056 - DNA, 50 bp, homo sapien
gggttaattataaaagttctgattayattgtagagttttattgtagagtt

SEQ ID NO: 93057 - DNA, 32 bp, homo sapien
acatacttgtcatgtcrcgaaaacatctagga

SEQ ID NO: 93058 - DNA, 32 bp, homo sapien
acctatgtatatggtayaggctattgttccta

SEQ ID NO: 93059 - DNA, 50 bp, homo sapien
gtacaagttgacatagtgagcagcakagcaggaatttgaatctagactcc

SEQ ID NO: 93060 - DNA, 50 bp, homo sapien
accaagactcaggagcagttcagcaycatagctaagataatgcagttaat

SEQ ID NO: 93061 - DNA, 50 bp, homo sapien
tatttgtacccattgagttcccagasattctttccacctccaattttacc

SEQ ID NO: 93062 - DNA, 50 bp, homo sapien
aaatatggataactggatccctcaasataaattagttagtaaagtaggat

SEQ ID NO: 93063 - DNA, 50 bp, homo sapien
cacaatggtggagaacatcaactctraatgaaaattccacttctacattt

SEQ ID NO: 93064 - DNA, 50 bp, homo sapien
cagccatgtcttcagggaacaaacartctggtagggaggacaagatctag

SEQ ID NO: 93065 - DNA, 50 bp, homo sapien
gtgtcctactccattcagtttcttgraataataccatagactaggtaact

SEQ ID NO: 93066 - DNA, 50 bp, homo sapien
tctctggtgtagtttggaaatatgaratttgtgccccatctgctcctgag

SEQ ID NO: 93067 - DNA, 50 bp, homo sapien
atgagcagatttaaagcacacaactyaggagcagatggggcacaaatctc

SEQ ID NO: 93068 - DNA, 50 bp, homo sapien
aaacaccatcatgtcaggggttaacrcttcaacacagaaatgtcagggga

SEQ ID NO: 93069 - DNA, 50 bp, homo sapien
ttttatgtttagttaccaactcataygtttaccgcttatttcacattggg

SEQ ID NO: 93070 - DNA, 50 bp, homo sapien
tacctatgtcttattctttgtgtaaytgaaaatttgtcagtttcttctta

SEQ ID NO: 93071 - DNA, 50 bp, homo sapien
cataacatgaggtttgaaagctgtakaaaagtttacataaaacaatgtat

SEQ ID NO: 93072 - DNA, 50 bp, homo sapien
ggcacacacactgtttaagatgtaaytgctgtggaggcatcgcaagtcca

SEQ ID NO: 93073 - DNA, 50 bp, homo sapien
tatcatacatttaaagagttgaacawcataaactaataaacacatatata

SEQ ID NO: 93074 - DNA, 50 bp, homo sapien
tgaaaaaccaatactttcagaaacastagaacctaactcaactagaagtg

SEQ ID NO: 93075 - DNA, 50 bp, homo sapien
aggctgcatgacaaattatcacacayttagcagatgaaaacataattttt

SEQ ID NO: 93076 - DNA, 50 bp, homo sapien
tttcagtaacagcacatttctctctkacagtcccattgaaagcaagtggg

SEQ ID NO: 93077 - DNA, 50 bp, homo sapien
aagtggggcttagcacctttcaactmtgatattgcctttggctctcacac

SEQ ID NO: 93078 - DNA, 50 bp, homo sapien
ctctctctcattctgctctatccacwatgacctactttctgttttgctgc

SEQ ID NO: 93079 - DNA, 50 bp, homo sapien
ctcccagatttatatttctagcattraacttttcttgaaatgtcattttc

SEQ ID NO: 93080 - DNA, 50 bp, homo sapien
gttacctagagtccctctcacactgwaggaagctcaggtcatttgttttc

SEQ ID NO: 93081 - DNA, 50 bp, homo sapien
cataaaccagattcatcagcatccasggttgagtcatgtgacaaccttgg

SEQ ID NO: 93082 - DNA, 50 bp, homo sapien
tgcctgtctgcttttaacagttaaaygcacctgaatggcataacacaacc

SEQ ID NO: 93083 - DNA, 50 bp, homo sapien
ctaagtatacaggcttagcaatgcayattaaagttcaaattctaggtcta

SEQ ID NO: 93084 - DNA, 50 bp, homo sapien
aagatttgaacagatgtcaaggaacygtactctttcagcccttttttttt

SEQ ID NO: 93085 - DNA, 50 bp, homo sapien
tggcttagaattacagcctgttagarcccaaaggaacttgtagaaggaca

SEQ ID NO: 93086 - DNA, 50 bp, homo sapien
cggatcctgagagttttgagggtcargctgagataagactcatcctgtgc

SEQ ID NO: 93087 - DNA, 50 bp, homo sapien
ttgctcccaggcccctttctgtataktaagcacaattgttaatgaataat

SEQ ID NO: 93088 - DNA, 50 bp, homo sapien
attccttgccccctcactcattctayaaaggagaggaccaaggaggaaga

SEQ ID NO: 93089 - DNA, 50 bp, homo sapien
ggaggaaagttttctttgcttaaatrattcagtcagagaaatttcacaag

SEQ ID NO: 93090 - DNA, 50 bp, homo sapien
atgcaagagttatttggaaagtagartcattaatacttggcaaatgagaa

SEQ ID NO: 93091 - DNA, 50 bp, homo sapien
atgctagtgttaatatagctggcacraaagaataggaaataaatgcctga

SEQ ID NO: 93092 - DNA, 50 bp, homo sapien
ttcatttctttcaatcattttaacayataaggcattgggtacaaagatca

SEQ ID NO: 93093 - DNA, 50 bp, homo sapien
cttgaaatcaatgtgttggagaactstttggccttggtcagtttgtgatt

SEQ ID NO: 93094 - DNA, 50 bp, homo sapien
ttgtggcgtctggtgataggaagacygcactttgcaatcacacagaactt

SEQ ID NO: 93095 - DNA, 50 bp, homo sapien
catccaatggcattcaaacatgttcrccagaaatttatttttttaatcat

SEQ ID NO: 93096 - DNA, 50 bp, homo sapien
gtggcaatgtgtcactgcagcaatarggaagtaatacagtgctgtttcca

SEQ ID NO: 93097 - DNA, 50 bp, homo sapien
ggcagaagggataaatgtcatgaacrgcatagtggaagggcaaacaagga

SEQ ID NO: 93098 - DNA, 50 bp, homo sapien
aataggtcatgcaggataaaaataaratattaacagagctgtggtctgga

SEQ ID NO: 93099 - DNA, 50 bp, homo sapien
tttttcttgcctcttctgctagaaaktcagcatcttacaagcagatggtg

SEQ ID NO: 93100 - DNA, 50 bp, homo sapien
taattttccaaagctgcttttcaagrctcggcttgctttctttgtggggt

SEQ ID NO: 93101 - DNA, 50 bp, homo sapien
aagtgtcatcaaagagatctgtttamatagtgtgccataatttttaggat

SEQ ID NO: 93102 - DNA, 50 bp, homo sapien
tttataaacagcttgacttttacaayggtaagaaagaggaacagataaga

SEQ ID NO: 93103 - DNA, 50 bp, homo sapien
taataacatggaaacaggcatatgaygatattataagaaaatataaatac

SEQ ID NO: 93104 - DNA, 50 bp, homo sapien
taattcaagtatcagaatcttgagtscaataattaggtaaggtccatgca

SEQ ID NO: 93105 - DNA, 50 bp, homo sapien
gtatgagtgggtgaattatttaagayagatcagctatggtgtggtaaccc

SEQ ID NO: 93106 - DNA, 50 bp, homo sapien
tgcattaagaatacaaaaagatggawatgctccttgcttggaatgtatga

SEQ ID NO: 93107 - DNA, 50 bp, homo sapien
atacaatattggatatatggatggastattcctcatttaatgactatcaa

SEQ ID NO: 93108 - DNA, 50 bp, homo sapien
ctgacattgttttttctctctttaaygtaattggagtgtgtgggcatctc

SEQ ID NO: 93109 - DNA, 50 bp, homo sapien
ctcattactaggtttttctttaagaycctaacatgcaagaaatatggggg

SEQ ID NO: 93110 - DNA, 50 bp, homo sapien
aaataaacgacttgccctggagtcaytggtgtagggtctgcttcaggggg

SEQ ID NO: 93111 - DNA, 50 bp, homo sapien
catccctatcatgtagatgagaacaytgagaataagaacatttaagtgag

SEQ ID NO: 93112 - DNA, 50 bp, homo sapien
gatagaggtttggagccagacagacsaaataaaaatctcagccacttagt

SEQ ID NO: 93113 - DNA, 50 bp, homo sapien
caatcttcagcacatcttacctaccraaaaatttccatcttttgctgtca

SEQ ID NO: 93114 - DNA, 50 bp, homo sapien
caaagagagagattagagaattgcaygggatattgtcaatgactaattct

SEQ ID NO: 93115 - DNA, 50 bp, homo sapien
cttcccttcttttcatttcttttcaygtcccttttccattcttttatcat

SEQ ID NO: 93116 - DNA, 50 bp, homo sapien
ggaagagaccctctttctgccgagakgtggttttataaggaaagagagac

SEQ ID NO: 93117 - DNA, 50 bp, homo sapien
tctactttgtcacacgttaactccarataaccacatgtagctgacctcat

SEQ ID NO: 93118 - DNA, 50 bp, homo sapien
agccctaagtaaaccagacaaccaaygccaatttttccagtgtcctgagg

SEQ ID NO: 93119 - DNA, 50 bp, homo sapien
gaaaaactggattatttttataaacwgtcatacagaagtatgatgggagg

SEQ ID NO: 93120 - DNA, 50 bp, homo sapien
actaatatttctctctcactcatctytgtaacagttcaagtaaaaatagc

SEQ ID NO: 93121 - DNA, 50 bp, homo sapien
tatgttgtattttaacgattaataaytgtttataactcttcctgaaatgc

SEQ ID NO: 93122 - DNA, 50 bp, homo sapien
ttcctaggaagatgggtcatacagayaaaatgatcattgtagagaagatg

SEQ ID NO: 93123 - DNA, 50 bp, homo sapien
acacataataaagaaataaaagtggytgctgattggagtgagctggggca

SEQ ID NO: 93124 - DNA, 50 bp, homo sapien
tatttaactatgaccaaatgtttgasacacactgccagaaaaattgtcag

SEQ ID NO: 93125 - DNA, 50 bp, homo sapien
tcagcccccttttctcagcctttccrgatgtagcaaaactaacacttccc

SEQ ID NO: 93126 - DNA, 50 bp, homo sapien
tcaaagcaagtcaagttaaacagacratattaaccatgatagactacttt

SEQ ID NO: 93127 - DNA, 50 bp, homo sapien
attttcctcttatttgtggaggatcmatgacctttcttttttattgctag

SEQ ID NO: 93128 - DNA, 50 bp, homo sapien
cttcatcttttctctgcctgatgaartcctattgaactttctagaaagat

SEQ ID NO: 93129 - DNA, 50 bp, homo sapien
gcagtgtggcattatggctaagcatwaagctgttatcagaccattctaga

SEQ ID NO: 93130 - DNA, 50 bp, homo sapien
cacttttaatttctatctgggttgargtttaatttctgcctgaacacatg

SEQ ID NO: 93131 - DNA, 50 bp, homo sapien
gcaagggaccatgtggtctccatacmtcatcttcactgggggttttatta

SEQ ID NO: 93132 - DNA, 50 bp, homo sapien
acccagtttgttctcccattatccaygtttatcctcccagccaaactttt

SEQ ID NO: 93133 - DNA, 50 bp, homo sapien
cagaaagatctctgtatttctcacamactatccttaaaaaatgaagtgat

SEQ ID NO: 93134 - DNA, 50 bp, homo sapien
tgggtatgaaatggttaaactgcaakctcctagactgtacaaacacaatt

SEQ ID NO: 93135 - DNA, 50 bp, homo sapien
tcagagaggtacacttaggaaatcgsaagtatttaggtggattcttatag

SEQ ID NO: 93136 - DNA, 50 bp, homo sapien
tggagaattgggtacttatctatcartattagtgcagtagctaactcaaa

SEQ ID NO: 93137 - DNA, 50 bp, homo sapien
tggattgcattatagacgaagggcaytgagtttaaggaattccatctatt

SEQ ID NO: 93138 - DNA, 50 bp, homo sapien
atgtctaattaaagtcttaacaaaamagtttctatcttattataaaatcc

SEQ ID NO: 93139 - DNA, 50 bp, homo sapien
atttttctaacattttcggtttggcrtagcacattgtgccaacattcctt

SEQ ID NO: 93140 - DNA, 50 bp, homo sapien
gatgggatggaacatatttaatgaamcagaatagttgttgtctttattgg

SEQ ID NO: 93141 - DNA, 50 bp, homo sapien
gtggatgcatgtgatttctatttaawtcctatcattatgaatggaagaca

SEQ ID NO: 93142 - DNA, 50 bp, homo sapien
ggaagccctctctgaaggggattaaygtgagcagagaaatgaaggatagg

SEQ ID NO: 93143 - DNA, 50 bp, homo sapien
taatattgttgaataaaagtttaaaycatatcatactgaattgtcatgct

SEQ ID NO: 93144 - DNA, 50 bp, homo sapien
ccaaatttattttttatcatctctaygcttatattttgtactttcctgta

SEQ ID NO: 93145 - DNA, 50 bp, homo sapien
gtgtgttaagtggttcatgagtaaakcttaaatgccaaaattaatagcac

SEQ ID NO: 93146 - DNA, 50 bp, homo sapien
cttaagatacaatattcagtctccaraaagcaaagtcataacggagttaa

SEQ ID NO: 93147 - DNA, 50 bp, homo sapien
agactgcagagccaggtccatgaccrcctctggaagcttgaagttaacat

SEQ ID NO: 93148 - DNA, 50 bp, homo sapien
gggccttaaaggctgctattgagagraacaatcatataagggctttagat

SEQ ID NO: 93149 - DNA, 50 bp, homo sapien
aaccattaaagggtttatgcaggtamgtaaggaatagcaccatccaatga

SEQ ID NO: 93150 - DNA, 50 bp, homo sapien
catggtgtgttgcttcttcactgcaygaattcccagtgggttaaaggaac

SEQ ID NO: 93151 - DNA, 50 bp, homo sapien
cctttgctgtgctccttgaaggataraaagatatacgtgatatgatcctg

SEQ ID NO: 93152 - DNA, 50 bp, homo sapien
ttgtagtatgccaacagcaaattcawtgaaggaaatccaaaaagcaatgc

SEQ ID NO: 93153 - DNA, 50 bp, homo sapien
tgcaatcttgcagtgtcatataccartgtcattctttataaaaaagccta

SEQ ID NO: 93154 - DNA, 50 bp, homo sapien
tttgagaatcaagcaagatgatgaaygtataaaagctctttgtaaactat

SEQ ID NO: 93155 - DNA, 50 bp, homo sapien
tacatgaccagaagtccagagttcgyatggctcggggaaatgaattttag

SEQ ID NO: 93156 - DNA, 50 bp, homo sapien
aacaacctttagcttttaactgggaygcatatatagccagtggttctcaa

SEQ ID NO: 93157 - DNA, 50 bp, homo sapien
caaaagatagagaaaaacgaatgaamgagaaacatttcactgtgaaaacc

SEQ ID NO: 93158 - DNA, 50 bp, homo sapien
ctattcttctctgttgtaaccatgawaaatgtattcagaccttgccaaat

SEQ ID NO: 93159 - DNA, 50 bp, homo sapien
gccaaagtgtaaaaatgataatgacygatctgttggcaagagcatggaaa

SEQ ID NO: 93160 - DNA, 50 bp, homo sapien
ttccttagagcaagtgaaagtaggaracagaatagaatcaattaacaata

SEQ ID NO: 93161 - DNA, 50 bp, homo sapien
gccactgtttagtgtttgcttagagrcaagaaagctaattataagccctg

SEQ ID NO: 93162 - DNA, 50 bp, homo sapien
gcaatgacagtcctgcctgttcatgraaatgttgtacccacaaggtacaa

SEQ ID NO: 93163 - DNA, 50 bp, homo sapien
caagagcttcagcatctttcgcctaygttttaatactctaagatgtattt

SEQ ID NO: 93164 - DNA, 50 bp, homo sapien
gtagtgtaatatggttcaagttacamatacatcttagagtattaaaacgt

SEQ ID NO: 93165 - DNA, 50 bp, homo sapien
tgcaaataattccttttactaagtayaaatgtccagcatacagcaaaaag

SEQ ID NO: 93166 - DNA, 50 bp, homo sapien
aaaatttaaggacacatttgtctcaragcatcgtataaagtgtcaagtcc

SEQ ID NO: 93167 - DNA, 50 bp, homo sapien
ttttccccctgccctgacactatgarcttatcttaaaaagaaaattaact

SEQ ID NO: 93168 - DNA, 50 bp, homo sapien
ttgtgccctatggaagaatattacaygagtgaagtttactgtcttatgag

SEQ ID NO: 93169 - DNA, 50 bp, homo sapien
aaacttgatctttccactctagtgcrcttcgacaatcaaagtcagaattc

SEQ ID NO: 93170 - DNA, 50 bp, homo sapien
caaatgtagcacagaaagaaaaacaytgaagatgataggaaggacaattt

SEQ ID NO: 93171 - DNA, 50 bp, homo sapien
cagagaggctatcagcatttctaggmagtcactggttcatgtgaaagaat

SEQ ID NO: 93172 - DNA, 50 bp, homo sapien
gtaagcatgtagtattgcttttaaaktctcctagtagagcaatagatgag

SEQ ID NO: 93173 - DNA, 50 bp, homo sapien
gtcctgctttcttccagaacccacartaactaatcatgtcactgccacca

SEQ ID NO: 93174 - DNA, 50 bp, homo sapien
atatggtagaaggagttagtccaggkaatctaggaacactaataccctgt

SEQ ID NO: 93175 - DNA, 50 bp, homo sapien
gtagcttcattctctctaagcttaawcttgaaactcaccatccaaagtat

SEQ ID NO: 93176 - DNA, 50 bp, homo sapien
tggtcaaagataggtaatgggtatastaacagccacttcacctaaaacca

SEQ ID NO: 93177 - DNA, 50 bp, homo sapien
tgttaatagggcacttagtcacttgyaaggttaaaatagcctactgggat

SEQ ID NO: 93178 - DNA, 50 bp, homo sapien
ttaggcagaggggtagcagagatgamgaccgcaggcaagagaaatcctaa

SEQ ID NO: 93179 - DNA, 50 bp, homo sapien
gtcatttcagcctcatgcgtatgaaytaagaatcctggaagacacctgga

SEQ ID NO: 93180 - DNA, 50 bp, homo sapien
atggggcttcagcttttcctaatgargtttcacgtgtcccttcctgaaaa

SEQ ID NO: 93181 - DNA, 50 bp, homo sapien
atgcaaactcctttcagacagacaaytcgggatccaacccctggcagttc

SEQ ID NO: 93182 - DNA, 50 bp, homo sapien
taaatattctaggttttgccagcaaygggataaaatcaaagatattatgt

SEQ ID NO: 93183 - DNA, 50 bp, homo sapien
agtgacctccctaaggttatataacwacaaatgagaaacagaagggaggt

SEQ ID NO: 93184 - DNA, 50 bp, homo sapien
cattaaagaacttgcaggtgttcagrataactgaaatgtcttctttgcaa

SEQ ID NO: 93185 - DNA, 50 bp, homo sapien
taactgaaatgtcttctttgcaaacrgaatggttattggtgtaagcattc

SEQ ID NO: 93186 - DNA, 50 bp, homo sapien
ccaattgcagaaacattaatttgaayaactatgcatgcataaaagcaact

SEQ ID NO: 93187 - DNA, 50 bp, homo sapien
ccccaagttagactagtgacttttamaatagaaagcaacgactgtttcgt

SEQ ID NO: 93188 - DNA, 50 bp, homo sapien
tgttatgttcataaaaagtcactaamaatttccataataaactcactttt

SEQ ID NO: 93189 - DNA, 50 bp, homo sapien
atcttgttagctgtattaaatacacsaaacgtcatgaattctctatggct

SEQ ID NO: 93190 - DNA, 50 bp, homo sapien
atccacattgataactgaagcaaackgatagataatccaaaatataaggg

SEQ ID NO: 93191 - DNA, 50 bp, homo sapien
tatttgtactttccctaggaaagagyagagctgtttaggcaagtgatttc

SEQ ID NO: 93192 - DNA, 50 bp, homo sapien
atctcttaagaaacttagattttaastaccattttctggattgacagagg

SEQ ID NO: 93193 - DNA, 50 bp, homo sapien
actcttgcacgattggaattgattaycttgccctctaccaagatcatcca

SEQ ID NO: 93194 - DNA, 50 bp, homo sapien
aggaatttaatctgaggaaatactayatatgcacgcacaagttgagcccc

SEQ ID NO: 93195 - DNA, 50 bp, homo sapien
aaaggaatgtttgtgtcagtaaatargagaaggaaatctgaattgcttat

SEQ ID NO: 93196 - DNA, 50 bp, homo sapien
ttaattcagtttcctcctttgattcragaacatctgaaacattgttttct

SEQ ID NO: 93197 - DNA, 50 bp, homo sapien
tcacttaatctttaccacaactctamgaaaaggattaaatgagttaatac

SEQ ID NO: 93198 - DNA, 50 bp, homo sapien
gctccaaactttcgtgtcccctcgartcactacatcctatcatgtctggg

SEQ ID NO: 93199 - DNA, 50 bp, homo sapien
agggcctggtgtgcctgtatgtatarctctcatccacacagcctaagtcc

SEQ ID NO: 93200 - DNA, 50 bp, homo sapien
agtatatttacatagtataatcaaartttcacccacaagttttagcatca

SEQ ID NO: 93201 - DNA, 50 bp, homo sapien
tgtagagattgggttaagctttccamagaaaatggatcatatatattttt

SEQ ID NO: 93202 - DNA, 50 bp, homo sapien
ttacaaatgttaagtgaagttataaracaaggtgcataatttagaccaga

SEQ ID NO: 93203 - DNA, 50 bp, homo sapien
tgcacactattagaaggtgccacaayttacatcttttaaaatagaaaaca

SEQ ID NO: 93204 - DNA, 50 bp, homo sapien
ttttttctatttcctgcaatgaagasagattgattcagaaatgcactgat

SEQ ID NO: 93205 - DNA, 50 bp, homo sapien
ttatgtggttgtcataagatatgaayagcaaatgtttgtttaatgaatga

SEQ ID NO: 93206 - DNA, 50 bp, homo sapien
gtcagcagctatgacacttggggaayaacagttgcttttccaaatcaata

SEQ ID NO: 93207 - DNA, 50 bp, homo sapien
gactagatagagggtttcttagcagwagaaggaaagaagtttaagcagat

SEQ ID NO: 93208 - DNA, 50 bp, homo sapien
gtcttctgcctagaagcctcttctayaaccttttcttgtgggacaaccac

SEQ ID NO: 93209 - DNA, 50 bp, homo sapien
aacccagtgaggacggagaaaacacrcaattctgtttcaaaatgatgagc

SEQ ID NO: 93210 - DNA, 50 bp, homo sapien
ttgttcccacaaaaacgtctatactyagcaaaatgacatctttccctgtg

SEQ ID NO: 93211 - DNA, 50 bp, homo sapien
agtcacaacctcatggaatggaaagkatcttacagtggctttgagttggg

SEQ ID NO: 93212 - DNA, 50 bp, homo sapien
attatctcattttgccatatcaaatwaaaatatatcttggaattccctgt

SEQ ID NO: 93213 - DNA, 50 bp, homo sapien
ctacagcttggttttatacattatarggagacataagacctcaaccaata

SEQ ID NO: 93214 - DNA, 50 bp, homo sapien
actgggaaacactgtcaccattttamaaccataagagggctcattggtat

SEQ ID NO: 93215 - DNA, 50 bp, homo sapien
tcatgaaacactggtaaaggcattaygacttactgacacagatcttcccc

SEQ ID NO: 93216 - DNA, 50 bp, homo sapien
ctataagctcttgatagtttttagaraattcactttcagcctgtgatggt

SEQ ID NO: 93217 - DNA, 50 bp, homo sapien
agaaagattgaattaacagagacaaygggtgactaacatgtcaaggtcaa

SEQ ID NO: 93218 - DNA, 50 bp, homo sapien
accttcaggctgcaattttgagatascattgaggctgagcactcactttg

SEQ ID NO: 93219 - DNA, 50 bp, homo sapien
atactacatcccttgtttggctacaygggtgcgctgcttcctgattggct

SEQ ID NO: 93220 - DNA, 50 bp, homo sapien
agcaataatgtagtggctatacaaayaaacattggagtcagaaagacttt

SEQ ID NO: 93221 - DNA, 50 bp, homo sapien
tatgcaatgcagaattcctggaactsaaagaaatggtagctaggaataat

SEQ ID NO: 93222 - DNA, 50 bp, homo sapien
gtcaaaactgagttttaaaataacamgtgattgaattaaaggctcatatg

SEQ ID NO: 93223 - DNA, 50 bp, homo sapien
ggtagcagaaaaattctgattgtggycaactatcttcagcttctggtttt

SEQ ID NO: 93224 - DNA, 50 bp, homo sapien
ttaatgacccagtaaatcaccatgaraatctgaatatctgtaaaatatgg

SEQ ID NO: 93225 - DNA, 50 bp, homo sapien
atgcatgaactcaagaaaagttagargtctctcatttagtttcacacgtc

SEQ ID NO: 93226 - DNA, 50 bp, homo sapien
tccttgactctctgaagttcctccarttcagaaagggatgggaaatgaac

SEQ ID NO: 93227 - DNA, 50 bp, homo sapien
tcttcccaggcatctaaagttcccaktacaccaagtttgtgtttggcatc

SEQ ID NO: 93228 - DNA, 50 bp, homo sapien
acaactactacagtatttaaccggaygatttgaactcaccaaactgtttg

SEQ ID NO: 93229 - DNA, 50 bp, homo sapien
ttttttttaaatatgaaagtactagwaatgagagtctggaaaaaaaaagt

SEQ ID NO: 93230 - DNA, 50 bp, homo sapien
ggttaaatactgtagtagttgtagaygtcaaatgtcagtaccattcttag

SEQ ID NO: 93231 - DNA, 50 bp, homo sapien
cagttttgtagtcttatttataaccrctttcaatggaatgctaattaagt

SEQ ID NO: 93232 - DNA, 50 bp, homo sapien
gagcctccatttttcctatgataagsacaaactagtaaataatttctgct

SEQ ID NO: 93233 - DNA, 50 bp, homo sapien
agggatgggagtagaggtggcaatayagaagtagcccaagggagatctct

SEQ ID NO: 93234 - DNA, 50 bp, homo sapien
gtaatgtaaaagaaagccaatgttaractcagctggttagaaacacaaca

SEQ ID NO: 93235 - DNA, 50 bp, homo sapien
tggtgagcatcacgagccaatggcaycaacagagaggggctcgcattgga

SEQ ID NO: 93236 - DNA, 50 bp, homo sapien
agcccaagggagatctctgtggtaayggaatgtctgtgttttgatcacag

SEQ ID NO: 93237 - DNA, 50 bp, homo sapien
gtaatcacggctttccccattacttkttgcgattaccacgattacatttg

SEQ ID NO: 93238 - DNA, 50 bp, homo sapien
gttgcatggctgcccaagataagacsagccctactttataattcagcttt

SEQ ID NO: 93239 - DNA, 50 bp, homo sapien
agtagatgttcaatatccattaaacmaataagccacaataataattgtta

SEQ ID NO: 93240 - DNA, 50 bp, homo sapien
caatattcccatcatttctaagataygtcccttgccctaagcctgcatat

SEQ ID NO: 93241 - DNA, 50 bp, homo sapien
ttataattgaaatgttaacagataaytgcccatgtaattactccaagtca

SEQ ID NO: 93242 - DNA, 50 bp, homo sapien
atactgatatcagccatattcccagwctcttcatccggacccatcttact

SEQ ID NO: 93243 - DNA, 50 bp, homo sapien
taatgtctccaaatgaaattatatakgcactaatacataaagttacagaa

SEQ ID NO: 93244 - DNA, 50 bp, homo sapien
ggtgggctaccatggcaggctaggaktagaccccagaaaggcctgaatgg

SEQ ID NO: 93245 - DNA, 50 bp, homo sapien
gctagaagaaatgatgaaggatagaraatggaatcctggcaatggaagtt

SEQ ID NO: 93246 - DNA, 50 bp, homo sapien
gtatctatggactgatgacttgaacrtttcccaagtttggcatttgctga

SEQ ID NO: 93247 - DNA, 50 bp, homo sapien
ctagttcaaactgtttctaatgtaartaaactgagtcttggtaagcagta

SEQ ID NO: 93248 - DNA, 50 bp, homo sapien
ccacaacaaaatgaggtaagtgcaaygggacagggatcacatacccagtg

SEQ ID NO: 93249 - DNA, 50 bp, homo sapien
tgccagatgactctgtgccaaacacygcaagccatttaactaaccctcac

SEQ ID NO: 93250 - DNA, 50 bp, homo sapien
agagggggatgtctctatcatcttgsacagctatagcaaactattatagc

SEQ ID NO: 93251 - DNA, 50 bp, homo sapien
ggagaatgtggatccagggagacatsaaggtcttggcaaaggcagaaaca

SEQ ID NO: 93252 - DNA, 50 bp, homo sapien
ttttgagggacacataacataacacragattaaaatacacaagttaattg

SEQ ID NO: 93253 - DNA, 50 bp, homo sapien
tatattggctttgtgttgactcccamgttaagagaacctccaaatacctc

SEQ ID NO: 93254 - DNA, 50 bp, homo sapien
ctaaaaatttgtttttgcaattagcygaacacgtagcccagtctctacaa

SEQ ID NO: 93255 - DNA, 50 bp, homo sapien
aatagcacaaagtctcactgtaacartctccagagtcggttgggaatgga

SEQ ID NO: 93256 - DNA, 50 bp, homo sapien
gatctgcttcttcacatcctgtttcrcaatcactagtcctttatttctca

SEQ ID NO: 93257 - DNA, 50 bp, homo sapien
aagggatggagagaagtgcatacgcygaagaggcattgtggaggtggggt

SEQ ID NO: 93258 - DNA, 50 bp, homo sapien
taatgtcacctttatgatagtaggasaacaataacaaaaccaaaatgatt

SEQ ID NO: 93259 - DNA, 50 bp, homo sapien
gcatttctccttgctaggaattttayaggaatgaggagtttaatgggtgc

SEQ ID NO: 93260 - DNA, 50 bp, homo sapien
gctcaccacatcatcccatgtaccartagagaaagctaacagagtttgcc

SEQ ID NO: 93261 - DNA, 50 bp, homo sapien
gagaaagaacatgacactctcaggaygctgcaagttgtggggtgcagctg

SEQ ID NO: 93262 - DNA, 50 bp, homo sapien
atgttttatcatttcaactctatgcrcttcacaaataatattttcaaaat

SEQ ID NO: 93263 - DNA, 50 bp, homo sapien
aaaatattctacaataaaatacaaastcaaatatatatttttataatata

SEQ ID NO: 93264 - DNA, 50 bp, homo sapien
atatcacaaacataagtctttagacrcaacttttgattctgtaccaagaa

SEQ ID NO: 93265 - DNA, 50 bp, homo sapien
atgccttctacatgaacagcttatawctttcaatgtatttagccagagaa

SEQ ID NO: 93266 - DNA, 50 bp, homo sapien
gttgatgatatttgctattattttayggtatctgcaggttttgtttgtcc

SEQ ID NO: 93267 - DNA, 50 bp, homo sapien
aactatattttctactattttgcacygacctaccgtggttcaacttggga

SEQ ID NO: 93268 - DNA, 50 bp, homo sapien
atttctcatctaggatgctcctatarctaagaagaaagctgtgtaatttg

SEQ ID NO: 93269 - DNA, 50 bp, homo sapien
atgctttcaaagttcgtttgagaaarcatccaagtcatagaagtttgtat

SEQ ID NO: 93270 - DNA, 50 bp, homo sapien
tggggtacctcttcttgccaggaatsagcttaaaatgctcacttataatg

SEQ ID NO: 93271 - DNA, 50 bp, homo sapien
aaattgaaaactattaaatgagatayacagtgaaaaacataataagagat

SEQ ID NO: 93272 - DNA, 50 bp, homo sapien
tgcattaaaagctgaagaggaattayacacttattctgagcagctttgtg

SEQ ID NO: 93273 - DNA, 50 bp, homo sapien
tgtccaatccctaaaggaactagtaygtaaataatgggagtcatatgggt

SEQ ID NO: 93274 - DNA, 50 bp, homo sapien
aggtactatagagatgataatgaagyattcctggccattttaatcacaca

SEQ ID NO: 93275 - DNA, 50 bp, homo sapien
cacagatgaggaaatggaagcttagwagagttaaataattgcccacagtc

SEQ ID NO: 93276 - DNA, 50 bp, homo sapien
tggctctttggggaagtattagtaaygataaatcaaattgatttaaaaca

SEQ ID NO: 93277 - DNA, 50 bp, homo sapien
gagcatggtggtcttagaacttgaaygatgtccaatagaagaaaaggatt

SEQ ID NO: 93278 - DNA, 50 bp, homo sapien
attctaaatcatagcccaaattatarctgcatgctgcattagccatccta

SEQ ID NO: 93279 - DNA, 50 bp, homo sapien
ctgcaagtacgtggagggggacagargtacacttgaagggactttctgaa

SEQ ID NO: 93280 - DNA, 50 bp, homo sapien
caaagatggccagtggttcctgtackagacaacacaactctaaggactaa

SEQ ID NO: 93281 - DNA, 50 bp, homo sapien
gatcctaaactgtgaagataaattayggaacttaaatgtatgacccaatt

SEQ ID NO: 93282 - DNA, 50 bp, homo sapien
gttgtttgtgtaattatgattggcaytaaaaatgaactacaagcctaagt

SEQ ID NO: 93283 - DNA, 50 bp, homo sapien
cacttctctcaaggaatatggtctcrcgttacttgtttttcagtgcgtga

SEQ ID NO: 93284 - DNA, 50 bp, homo sapien
atactctggggaccatcctgagaacyaggctggaagagcaagaccaacct

SEQ ID NO: 93285 - DNA, 50 bp, homo sapien
tcaatgagaaggtgttaaaaagtcarccttatgaataatcgcattttgtg

SEQ ID NO: 93286 - DNA, 50 bp, homo sapien
cagaaacagagactgaaataacgcawctacaaaccaaggaatgccagtgt

SEQ ID NO: 93287 - DNA, 50 bp, homo sapien
aacatgcgaagtagcagcatataaakataagtggacagtcagagttgcct

SEQ ID NO: 93288 - DNA, 50 bp, homo sapien
aaatattggagagattttcatttctyacaccctttattgtcaccatttta

SEQ ID NO: 93289 - DNA, 50 bp, homo sapien
atttttctctgggattcaatggcacygtatgcaactgttttttcttatat

SEQ ID NO: 93290 - DNA, 50 bp, homo sapien
cacacgtctgtgtatgcttaaccggmgttctcaccattcaaatcaaatgt

SEQ ID NO: 93291 - DNA, 50 bp, homo sapien
aagtcaatgatattcttaataagacratgaaagtccaattgggagaggtg

SEQ ID NO: 93292 - DNA, 50 bp, homo sapien
tccactacagttatggctgatcttaygatctattcacttcctcaagttag

SEQ ID NO: 93293 - DNA, 50 bp, homo sapien
tttagcagtgcctgaaaccaatttayctcagatttgtttttagttccata

SEQ ID NO: 93294 - DNA, 50 bp, homo sapien
atttcaggaaatataccccgttaaasaatattacaagcagcttactgcaa

SEQ ID NO: 93295 - DNA, 50 bp, homo sapien
ttctaaatgtattcttagttcatcayaagcagattgatttgtatttattt

SEQ ID NO: 93296 - DNA, 50 bp, homo sapien
atgtcttcttacccctctagccaagmaggtttattccatttgtaatggca

SEQ ID NO: 93297 - DNA, 50 bp, homo sapien
tggaagaacaattcctgccttctaamaccaggtctttcaggtctggtgaa

SEQ ID NO: 93298 - DNA, 50 bp, homo sapien
gtaataaacaataaacataatgggtmaatggtatggtaagttagaaggtg

SEQ ID NO: 93299 - DNA, 50 bp, homo sapien
ggaaggtggacatgccgggacgcagratccattttagcagccaaggagca

SEQ ID NO: 93300 - DNA, 50 bp, homo sapien
catcttgctgataaagttgatgatgrattccatgatgtcacataataggg

SEQ ID NO: 93301 - DNA, 50 bp, homo sapien
tcaggaatctgtcttcttgcaccaamgtttgattgatttgagaggtggaa

SEQ ID NO: 93302 - DNA, 50 bp, homo sapien
tttattctgatagattctttcactaygggtagaggtagcctggttaggtt

SEQ ID NO: 93303 - DNA, 50 bp, homo sapien
cagggttatggattagaaaattcaaygatactaggtagcttctgaagtga

SEQ ID NO: 93304 - DNA, 50 bp, homo sapien
ttcaccttcttttattgtatttccaytatagtctctaattactcaaccca

SEQ ID NO: 93305 - DNA, 50 bp, homo sapien
ctaaggcctcttcttagtgcccaaakgaaagtatagtaaagatatccagg

SEQ ID NO: 93306 - DNA, 50 bp, homo sapien
tagatttcaaactcagttctattcaytactaaagtccatactttcacatt

SEQ ID NO: 93307 - DNA, 50 bp, homo sapien
atcaatgttgtactgtctttatgaamatcaatatggaatctttccaacta

SEQ ID NO: 93308 - DNA, 50 bp, homo sapien
atggattattgtcatagaggtatctractaggtatcaaaaagactttcaa

SEQ ID NO: 93309 - DNA, 50 bp, homo sapien
tctctttgtcaaaacaaatatgggayccaattatcatgaaccaggtaagt

SEQ ID NO: 93310 - DNA, 50 bp, homo sapien
agtcaaagaggttagttgccttacasgtctttctgattccaaagtctctt

SEQ ID NO: 93311 - DNA, 50 bp, homo sapien
gtcactgatataaattctgcattcaygattttagtcaagatagcatagaa

SEQ ID NO: 93312 - DNA, 50 bp, homo sapien
cacactgtgaaaacataattcccaaytcattagggagcaaagggatgagt

SEQ ID NO: 93313 - DNA, 50 bp, homo sapien
tatgttgtcatttagttattttaaarcctattcacatagtatggccaaga

SEQ ID NO: 93314 - DNA, 50 bp, homo sapien
attttgaatttattagtaaacatacraactatttcttaaagaatcacagt

SEQ ID NO: 93315 - DNA, 50 bp, homo sapien
catttaaaatactgtatatccttaakgtttaatttaacatgagacccaga

SEQ ID NO: 93316 - DNA, 50 bp, homo sapien
aagaagtacagtaagaaatgcatacraattaaggaaactatttgtaagga

SEQ ID NO: 93317 - DNA, 50 bp, homo sapien
ccaaggatatactacaccacaacaawcaggaaagaaaggtattccagcct

SEQ ID NO: 93318 - DNA, 50 bp, homo sapien
agccacaagtagtttgattaccaagratatactacaccacaacaaacagg

SEQ ID NO: 93319 - DNA, 50 bp, homo sapien
accccacaaaaagtattgcaagcatkaaatacgatactatatgagaaagt

SEQ ID NO: 93320 - DNA, 50 bp, homo sapien
atgtgtggtggtggtaatgagacagwcacgttctataaaatgcagtcatc

SEQ ID NO: 93321 - DNA, 50 bp, homo sapien
ctccaaaaaacattgacagaagcgaygaagattaatgattgtccatgctg

SEQ ID NO: 93322 - DNA, 50 bp, homo sapien
gaaagatacagggctttttcatcaaygtttgatctgatagatgtgtctaa

SEQ ID NO: 93323 - DNA, 50 bp, homo sapien
tataaccaaatagcaaacttgtagargattaaccagccacagccctcctc

SEQ ID NO: 93324 - DNA, 50 bp, homo sapien
ttatttgtgcatgtaaaacatacacmgcaatgttaaaggtattgaggatt

SEQ ID NO: 93325 - DNA, 50 bp, homo sapien
tatgctctccacacaccatcgtttgmaacattaggaaaaatactgttggt

SEQ ID NO: 93326 - DNA, 50 bp, homo sapien
gtctaatacacctttgtgtctatcaygcttaactctgaaccaagcactct

SEQ ID NO: 93327 - DNA, 50 bp, homo sapien
aaatgttgatagagtaataaaaaagragaatgatagggaactaactcatt

SEQ ID NO: 93328 - DNA, 50 bp, homo sapien
ataatgactcatactcatgataaaarcagtatatttgaaagttcaagaat

SEQ ID NO: 93329 - DNA, 50 bp, homo sapien
atgtaacaggcattatgctaggagaygtgaggttagtagtttgagtaaaa

SEQ ID NO: 93330 - DNA, 50 bp, homo sapien
catttgtgtgtgttattttagttggmaaatgtgattgggatgtcccattt

SEQ ID NO: 93331 - DNA, 50 bp, homo sapien
gaatgaacgatgaattatttaaaagyccaatctgtagctaatttaaatac

SEQ ID NO: 93332 - DNA, 50 bp, homo sapien
caaagcaaaggagaaataagctaagmaacaatgggataatttattctcca

SEQ ID NO: 93333 - DNA, 50 bp, homo sapien
gttgtgctcattaaaatcacccgtcraatctttactagctactgatgccc

SEQ ID NO: 93334 - DNA, 50 bp, homo sapien
attaaatcagtctgcattagggaacrctttcgtcaggttgaaccagagag

SEQ ID NO: 93335 - DNA, 50 bp, homo sapien
cctattcacttctgtaaaatgaacarcttacttttcccaataactcaatg

SEQ ID NO: 93336 - DNA, 50 bp, homo sapien
atgtttatcgaacaactatacatgayaagaaaagtgctaagcatttatgt

SEQ ID NO: 93337 - DNA, 50 bp, homo sapien
aaaggaaaggagaggattaagagtasatccattgcacctgtcatgccttt

SEQ ID NO: 93338 - DNA, 50 bp, homo sapien
aatgaatatatgaattaattaggaasagtaaaatcagtatgatctactaa

SEQ ID NO: 93339 - DNA, 50 bp, homo sapien
aacgggttacttcctacaacacaggrattacatagacagggcaggatggg

SEQ ID NO: 93340 - DNA, 50 bp, homo sapien
atcataatgtcagacaatgacggaamagaaaagtagatttaacccctgta

SEQ ID NO: 93341 - DNA, 50 bp, homo sapien
gtgtagtcacagtaccaaacaaaggkagttctgaagaaaataggcatgga

SEQ ID NO: 93342 - DNA, 50 bp, homo sapien
caattacatatacaagatgatgtttrtatttccatgtaaatgtgtatagc

SEQ ID NO: 93343 - DNA, 50 bp, homo sapien
ccttcatgcttaattcaacgactaaygacaatatcaataattttaagaca

SEQ ID NO: 93344 - DNA, 50 bp, homo sapien
ctttcccttgtatatagtactactamtaacaagtcctaactaatcagaag

SEQ ID NO: 93345 - DNA, 50 bp, homo sapien
tgagatttagcctctgactgtttaawtctgaacaaactaggatgtatttt

SEQ ID NO: 93346 - DNA, 50 bp, homo sapien
tttctctttcctttaatcatgttccwcctaattcctaccaaccctttacc

SEQ ID NO: 93347 - DNA, 50 bp, homo sapien
ctatctcaaatctatacagaaccaaytacatgcctgtaaatacagaagac

SEQ ID NO: 93348 - DNA, 50 bp, homo sapien
tagattcttccccaagtaacaaggartaaaaatgggatgctattaaaaca

SEQ ID NO: 93349 - DNA, 50 bp, homo sapien
aaaaaatctgtatagtaaaggaatakgtagctctgtgtatatctccttag

SEQ ID NO: 93350 - DNA, 50 bp, homo sapien
gggcaacatcccatagttttcggtakattcttccctctgcctctccattt

SEQ ID NO: 93351 - DNA, 50 bp, homo sapien
gaaaacaaaattaattccttaaaacsatctataaaatccactatcatact

SEQ ID NO: 93352 - DNA, 50 bp, homo sapien
cattgctgcacataaatgctcattckcctgacaaactaaaggtttttatt

SEQ ID NO: 93353 - DNA, 50 bp, homo sapien
accaggcatggtagcctttagacagwacatcttattttcactctcttgaa

SEQ ID NO: 93354 - DNA, 50 bp, homo sapien
gactgcatacttgtcagtttctcaastaatatgtaatgtaattttgaaca

SEQ ID NO: 93355 - DNA, 50 bp, homo sapien
tccctgtaataattctgaattgaccmatggtggatgcatgtgatttctat

SEQ ID NO: 93356 - DNA, 50 bp, homo sapien
gcaagcttttgtttcagtttagcaamtcctcctttaatgcctactctgtg

SEQ ID NO: 93357 - DNA, 50 bp, homo sapien
cagagttgtgtgtgggctggtccacrattctcactgtggtcgccccaggg

SEQ ID NO: 93358 - DNA, 50 bp, homo sapien
tcttcctatacctgactctctaaatytgtttgggatttctattgctccct

SEQ ID NO: 93359 - DNA, 50 bp, homo sapien
caaaagattaagcagaaaatattatyagggaaatgtttatctgcacttta

SEQ ID NO: 93360 - DNA, 50 bp, homo sapien
ggttccaaccttagaattttgaagasacacaggcattcaaaccgtagccc

SEQ ID NO: 93361 - DNA, 50 bp, homo sapien
tgatacaacctaccttccacattcawtatctttacacccaccttatttag

SEQ ID NO: 93362 - DNA, 50 bp, homo sapien
tcctgacaaggctggtttggcaaacrattatgatgtatgtccttgactgt

SEQ ID NO: 93363 - DNA, 50 bp, homo sapien
tatatggtaatgtcctaggtgttcamattcattcatcacccaccactcac

SEQ ID NO: 93364 - DNA, 50 bp, homo sapien
aatttagagaattgttagttttgtawcagagagcaattatttcttcaagc

SEQ ID NO: 93365 - DNA, 50 bp, homo sapien
gcctctggaggttccttttaactgaygcttcaaagtgtacaggcaagtga

SEQ ID NO: 93366 - DNA, 50 bp, homo sapien
tcttagttctgtcctgcaggttggamatcttttatcataggagtggctta

SEQ ID NO: 93367 - DNA, 50 bp, homo sapien
ttgaagtgtccaataatggctatcayagtgaaggtctacatttttaaacc

SEQ ID NO: 93368 - DNA, 50 bp, homo sapien
ctacaccattttgtaggaactcatgkattcaattagtgatttaaaaatat

SEQ ID NO: 93369 - DNA, 50 bp, homo sapien
ttctagaattaagtcatatgccgtayaaaaaacttgagtatagaatgctt

SEQ ID NO: 93370 - DNA, 50 bp, homo sapien
gttggaagaactagaatttgaaagaygctaagaagccacatgagacacca

SEQ ID NO: 93371 - DNA, 50 bp, homo sapien
tacattcctggttaacatctgccaartactctgtggattgcagtcagtac

SEQ ID NO: 93372 - DNA, 50 bp, homo sapien
attcaggtcagcagttctggctttasgagcactgtgtaattaaatggttg

SEQ ID NO: 93373 - DNA, 50 bp, homo sapien
ttatattacggtaactatcaataccraaaactgttatttcctattatatt

SEQ ID NO: 93374 - DNA, 50 bp, homo sapien
taaaaatgtaaatatggtcgtaaaargtcaaatggatcatatatacactt

SEQ ID NO: 93375 - DNA, 50 bp, homo sapien
accccatttcctgatctaccaagcaytctagtggatgagacaaagatggt

SEQ ID NO: 93376 - DNA, 50 bp, homo sapien
ttatttttaaagtttattgtcagtasagagtgtttgaaaatcaaattcct

SEQ ID NO: 93377 - DNA, 50 bp, homo sapien
agatgaagaaagtcatgtaagaaggrccatgaaagagtatgggcagcatt

SEQ ID NO: 93378 - DNA, 50 bp, homo sapien
aaactgtgaaatatctatcatcctakaagaactggcatcacattctgaca

SEQ ID NO: 93379 - DNA, 50 bp, homo sapien
tagcatttcacagtctcactattaaygtatgaaagttctagtcactccat

SEQ ID NO: 93380 - DNA, 50 bp, homo sapien
tccatacctagtgaaaatatacttcraaatgaggatggaagaaagaaata

SEQ ID NO: 93381 - DNA, 50 bp, homo sapien
ctggtccttggagtttgggtcttccyaaagtcaatgtgaggtccagaaac

SEQ ID NO: 93382 - DNA, 50 bp, homo sapien
tttgggttgcattgttttgttctaawtctcatatggcagatagctgggaa

SEQ ID NO: 93383 - DNA, 50 bp, homo sapien
tcccttccatttattgtcattagcaraagagtctatctcctgcaagatgt

SEQ ID NO: 93384 - DNA, 50 bp, homo sapien
tagaggaaagagatctaattaaggcyatgtgctttagacactcaaatatt

SEQ ID NO: 93385 - DNA, 50 bp, homo sapien
ctctaccataatgtagatttttctcratttcaatactttccccttatgaa

SEQ ID NO: 93386 - DNA, 50 bp, homo sapien
tattcttgttcctctcctggctcctkgtcattacgggaaatccttggcat

SEQ ID NO: 93387 - DNA, 50 bp, homo sapien
ggtcccttctcagccctgagccacaragattaacattctcaagtaataat

SEQ ID NO: 93388 - DNA, 50 bp, homo sapien
ccacatacacttcaatacaacaatakaactttctctttttaaaatagcta

SEQ ID NO: 93389 - DNA, 50 bp, homo sapien
gtcatatgtattacatctgtatacaytgaaagcaccaggcaatgttagaa

SEQ ID NO: 93390 - DNA, 50 bp, homo sapien
tgacctgctgtgatactgtgctatawcttgggagccttgaggcttggccc

SEQ ID NO: 93391 - DNA, 50 bp, homo sapien
gcaactgttactcagggccagataamtacatacttgaagacatctttaga

SEQ ID NO: 93392 - DNA, 50 bp, homo sapien
gtgcccttaaaaccaacttctaggcyacttaggtgtcttgaccagacttt

SEQ ID NO: 93393 - DNA, 50 bp, homo sapien
ccctgcgatttctcccatctttgaaygccttttgggatcatcatcaatat

SEQ ID NO: 93394 - DNA, 50 bp, homo sapien
acaaagtaaaataattattagatccktagcttcttaacattatttctttc

SEQ ID NO: 93395 - DNA, 50 bp, homo sapien
tttgagttctgtcctgaaaagacaayttgtccgctttggctctacttcct

SEQ ID NO: 93396 - DNA, 50 bp, homo sapien
ttttgtttgtgtgaattcaaccacartgaaggaattattgtctggtgaac

SEQ ID NO: 93397 - DNA, 50 bp, homo sapien
tattatgagctacttcagtggggtcragggaatccatagaccagctctcc

SEQ ID NO: 93398 - DNA, 50 bp, homo sapien
ctttgaagatggaataggctcgatakgtttagatgcttattggaaggaac

SEQ ID NO: 93399 - DNA, 50 bp, homo sapien
agtcaaggcacatcttagtcttacayggtggtaggcaaagagagaatatg

SEQ ID NO: 93400 - DNA, 50 bp, homo sapien
tctctttcacactggatatagacacrcttgagctgaagttgttgcctctt

SEQ ID NO: 93401 - DNA, 50 bp, homo sapien
ttcaatcaagccaatgcatttccttygtgtccaagctagtctgagttgtt

SEQ ID NO: 93402 - DNA, 50 bp, homo sapien
cctgagtaacagttgcctaattctgyaaatgtgtcagaatcacagataaa

SEQ ID NO: 93403 - DNA, 50 bp, homo sapien
gctaactacagttggtaagtggtaarctgggatacaaactaagccccagg

SEQ ID NO: 93404 - DNA, 50 bp, homo sapien
tctgacaaagtgctgcagtaggaatraaaaagatcaagatttaggcccag

SEQ ID NO: 93405 - DNA, 50 bp, homo sapien
cattacagttccaaaattagttgtcrcagtcaggctataaatcctgtagg

SEQ ID NO: 93406 - DNA, 50 bp, homo sapien
caatctactaatatctgaacccgtayaaagatttagtaatatgtattaag

SEQ ID NO: 93407 - DNA, 50 bp, homo sapien
tctttctttgttaaaaatgtctttcraactccaaaaatatgtttacctac

SEQ ID NO: 93408 - DNA, 50 bp, homo sapien
tctgctccaggtaagccaatctctaytacaactatctgaattctactgtc

SEQ ID NO: 93409 - DNA, 50 bp, homo sapien
aaaagaaatcacaaaattaaatgtastacaagttgaatatccataatctg

SEQ ID NO: 93410 - DNA, 50 bp, homo sapien
tgtttacacggaaaatgtagaactaygctttattcctcctgaataatttc

SEQ ID NO: 93411 - DNA, 50 bp, homo sapien
aatcatgtttgcatgaccagcaacartgtgtcaatcaaaatgtacatcca

SEQ ID NO: 93412 - DNA, 50 bp, homo sapien
aaatatcttttaaaatgtggttgtcraagcatttggagcaggtaattgag

SEQ ID NO: 93413 - DNA, 50 bp, homo sapien
aattcctaagataataacaccttccrcatacatttaggacactcaatcac

SEQ ID NO: 93414 - DNA, 50 bp, homo sapien
ctgaccaagcagaaagcattaattcraatcctgttacaaatggacattga

SEQ ID NO: 93415 - DNA, 50 bp, homo sapien
gagtgagtggactggctaacatgaargatacctgaacatgtagagagagt

SEQ ID NO: 93416 - DNA, 50 bp, homo sapien
aacaaaatactggtccagatggttcyattagtaaattttactaaacaata

SEQ ID NO: 93417 - DNA, 50 bp, homo sapien
aactgctcctttaaaagtgagttcargacttctgcctaagaacacggacc

SEQ ID NO: 93418 - DNA, 50 bp, homo sapien
cgagagttcaactttctgagataccmaaggcgagctccataaatctctgc

SEQ ID NO: 93419 - DNA, 50 bp, homo sapien
cactgcactcgaaagaagaaggtcamaatctcctaactggaggatcaggg

SEQ ID NO: 93420 - DNA, 50 bp, homo sapien
caaacacaactgattgttcctttatkacatacactgcatccgcacttatt

SEQ ID NO: 93421 - DNA, 50 bp, homo sapien
gtttcattccagtcacatatggtaaygtagtttcggtacagacttgatat

SEQ ID NO: 93422 - DNA, 50 bp, homo sapien
aacacgtgaaacctctgtctgtggcyatgaatagataatcctaaggagct

SEQ ID NO: 93423 - DNA, 50 bp, homo sapien
ggttttggccattcctacctttcaawataggagccaaagatgagcagctc

SEQ ID NO: 93424 - DNA, 50 bp, homo sapien
gatctcctctacatataattccctgraaggcagatatctccagtgctaaa

SEQ ID NO: 93425 - DNA, 50 bp, homo sapien
ataattggttttctatatgattaaaytcactgaacctaacttaaaatgtt

SEQ ID NO: 93426 - DNA, 50 bp, homo sapien
tagaacaacactgccatttccaagtytgggttaatcatttaatttctctg

SEQ ID NO: 93427 - DNA, 50 bp, homo sapien
tctcttttcctctataagagtagaaktgtatggaagatttgataaagact

SEQ ID NO: 93428 - DNA, 50 bp, homo sapien
tcactaaatgttagttgttattctayatagcatcttgggaacctggagag

SEQ ID NO: 93429 - DNA, 50 bp, homo sapien
aagaagattaaaaatgcaataatagwatagaaatctgcattaaaagcaat

SEQ ID NO: 93430 - DNA, 50 bp, homo sapien
actgagtccgtgacaccacatagtaycatagaaaattccagtttcacatg

SEQ ID NO: 93431 - DNA, 50 bp, homo sapien
aatttgaatactttattgtgttgccrctgactagcatttagattctctaa

SEQ ID NO: 93432 - DNA, 50 bp, homo sapien
gctaatatgaaagttctgctctatamatgagaaggacaaagaagcactga

SEQ ID NO: 93433 - DNA, 50 bp, homo sapien
aggagaatttgattgcagctatcaasaatagacacttacaagtgcttcct

SEQ ID NO: 93434 - DNA, 50 bp, homo sapien
attaaagcaaaaaaacttgggctatracacgatcatttattaactattga

SEQ ID NO: 93435 - DNA, 50 bp, homo sapien
ataatacatgggtagaatttataaaygtagagataagaaaaaaagctggt

SEQ ID NO: 93436 - DNA, 50 bp, homo sapien
gctctagttcattctttttcaccgcratataaaattccatcatagagctt

SEQ ID NO: 93437 - DNA, 50 bp, homo sapien
agctattaaagttttctgttccatgrcatataaggggttactctgggctt

SEQ ID NO: 93438 - DNA, 50 bp, homo sapien
tgtctcaaaagactttgtgacagtaygctaaattgaagatacttttccaa

SEQ ID NO: 93439 - DNA, 50 bp, homo sapien
attttacatattccacatttttagaygatattgcatttagatactcattt

SEQ ID NO: 93440 - DNA, 50 bp, homo sapien
tagcccaggaaggatgaaagctataygtggaggatctattctgaagccag

SEQ ID NO: 93441 - DNA, 50 bp, homo sapien
tccctaaaatccacatgaccattgaratcttcttcagatgactggaacct

SEQ ID NO: 93442 - DNA, 50 bp, homo sapien
ggtatggtgggagctgggaaacagasagtgataagtaagaaggttccagt

SEQ ID NO: 93443 - DNA, 50 bp, homo sapien
aaaatttagaaaatagtatgtgtctyagaatgtaattgttagaaataagt

SEQ ID NO: 93444 - DNA, 50 bp, homo sapien
tgaaaaataggcacagcaactccaargactttatcataaaaaaacttatt

SEQ ID NO: 93445 - DNA, 50 bp, homo sapien
ggagtattaattataggaaaccgtaygacataaactgcagggcagtaagg

SEQ ID NO: 93446 - DNA, 50 bp, homo sapien
ttaggaataggatcagactcagttayggtggtaatataggtaaaagggct

SEQ ID NO: 93447 - DNA, 50 bp, homo sapien
agtctgaaaacctgctggagagagakatcaaaagttctgttctttggacc

SEQ ID NO: 93448 - DNA, 50 bp, homo sapien
taagattcttaatcttgtccggtcasagtcaatgtctttccaaggactcc

SEQ ID NO: 93449 - DNA, 50 bp, homo sapien
gtaacattcaacttctgaattgataygtactatttaaagagtatgccctt

SEQ ID NO: 93450 - DNA, 50 bp, homo sapien
taaataaattctattatttcagatasattgtgaagaaaaaataaacaaaa

SEQ ID NO: 93451 - DNA, 50 bp, homo sapien
tgttaaatttctaagacaaattaaayctctgacttcccttgaaatatcgg

SEQ ID NO: 93452 - DNA, 50 bp, homo sapien
agttatatgtagacaatgcaaaagargtaggacagccttgatgtgtggta

SEQ ID NO: 93453 - DNA, 50 bp, homo sapien
atggcagttaagatgcaataatttarccaagaaaactgtgtaggaggaga

SEQ ID NO: 93454 - DNA, 50 bp, homo sapien
tggtttcatgttcctctttggctgcraccctgttttcttcactccttttt

SEQ ID NO: 93455 - DNA, 50 bp, homo sapien
gctttaaagaaatatgagggaactaygagcaatgaaatatggcaagtctc

SEQ ID NO: 93456 - DNA, 50 bp, homo sapien
ccaacaagccaggtataccatgttasgtggactgagttacaggtcaggag

SEQ ID NO: 93457 - DNA, 50 bp, homo sapien
ttttcttcctctttcaccagataccrctactatctactcaccttcatcta

SEQ ID NO: 93458 - DNA, 50 bp, homo sapien
ttctagaatgaccatactgaaatggraaattcagagatttgagattatac

SEQ ID NO: 93459 - DNA, 50 bp, homo sapien
agtcagaaatgaagtgtagcttgacygggtgtctcttgctcacagtttct

SEQ ID NO: 93460 - DNA, 50 bp, homo sapien
ttataagcagaatgataaataccaasttcgatgcaggattttagactgaa

SEQ ID NO: 93461 - DNA, 50 bp, homo sapien
gagcccagtgtactttgtaaaagtgmaagctcctggcccatgactgagat

SEQ ID NO: 93462 - DNA, 50 bp, homo sapien
atgtggcactctgagggaatgcccamaaacttccacacgtgatattttaa

SEQ ID NO: 93463 - DNA, 50 bp, homo sapien
atatatcttggctagcacttgggtarcattacttgaagggaatatatcaa

SEQ ID NO: 93464 - DNA, 50 bp, homo sapien
gttaccaatttgtttcctggtagaayttacgaggacttcactaaaagact

SEQ ID NO: 93465 - DNA, 50 bp, homo sapien
gtgtttttgaaaatctcaaaattccwctccaaaattcagtgtttttgaaa

SEQ ID NO: 93466 - DNA, 50 bp, homo sapien
accacttttaccactatgtcataccrcctgtcatttcctttgtaccttta

SEQ ID NO: 93467 - DNA, 50 bp, homo sapien
ggaccatatgtaatgcacattagaartattgtttaaggaatcattaaatc

SEQ ID NO: 93468 - DNA, 50 bp, homo sapien
ttataaatagatatatgaaaaggtgsatatacagatggaggtaattagtt

SEQ ID NO: 93469 - DNA, 50 bp, homo sapien
tcatagtttcctcaaacactgtgaargaactgatttatttttttaactcc

SEQ ID NO: 93470 - DNA, 50 bp, homo sapien
cttccagtattatgttaaagagtggyaaagtggacaccctggtttcattc

SEQ ID NO: 93471 - DNA, 50 bp, homo sapien
tgcctgacgtgggcatgatctccaasaataaagctgaaatgcacaaatag

SEQ ID NO: 93472 - DNA, 50 bp, homo sapien
cctacattttatttctattgataacmcagtttgaagtttaggtaatgaac

SEQ ID NO: 93473 - DNA, 50 bp, homo sapien
acactatttacgtttttattcaccawgtgagaaatattgaactgtttcca

SEQ ID NO: 93474 - DNA, 50 bp, homo sapien
cactgttgtgtctatcagaaatcackcattaaattgctaaaagatttgac

SEQ ID NO: 93475 - DNA, 50 bp, homo sapien
atgatggaaacctgtgatttggtacygctatccatcatgaccaacattga

SEQ ID NO: 93476 - DNA, 50 bp, homo sapien
cctttctttgaagtaaagcctaatayattaaagttaaatgtctttaaaga

SEQ ID NO: 93477 - DNA, 50 bp, homo sapien
atagtaacaattctgatttttgcacsaatgagggacacgaggctaacaca

SEQ ID NO: 93478 - DNA, 50 bp, homo sapien
agaactgtgggactggtacaaaagaygtaaaacatgtataatgaaagtac

SEQ ID NO: 93479 - DNA, 50 bp, homo sapien
aaaaaaaaatgtttatttgttaagcrgcaactatttgtgtggaacaatgc

SEQ ID NO: 93480 - DNA, 50 bp, homo sapien
aaatgtgagggaaagaataacatagrcataagcaatttaaaagggtctga

SEQ ID NO: 93481 - DNA, 50 bp, homo sapien
tgctgtagaacactaatctgtcaatratatttgaggtcatattacataat

SEQ ID NO: 93482 - DNA, 50 bp, homo sapien
atgtctgatgttagatcacaaagaartgaaggtatgttatctaagaaatt

SEQ ID NO: 93483 - DNA, 50 bp, homo sapien
agatagtgacaaacttaagatgaaakgcaacatagaacatgaagtcaatt

SEQ ID NO: 93484 - DNA, 50 bp, homo sapien
aacaaatggaaatactttatttaccrgaactacactcatccaagaactat

SEQ ID NO: 93485 - DNA, 50 bp, homo sapien
atggaggtttagtggatgatcctaaycaatttaaagtcagctaatgtttt

SEQ ID NO: 93486 - DNA, 50 bp, homo sapien
acactatatgacaacacattatagaygatagttgtttagatagatatatg

SEQ ID NO: 93487 - DNA, 50 bp, homo sapien
gcaaggacataaccaagctgaccatsaaggatctgcctgcccccaagacc

SEQ ID NO: 93488 - DNA, 50 bp, homo sapien
attgcttcattagtgtaactggtgakgccagaagaacctaagaattaatc

SEQ ID NO: 93489 - DNA, 50 bp, homo sapien
agaaagcaagattgaagacagcttcrataagaaagttaaaagaattgctt

SEQ ID NO: 93490 - DNA, 50 bp, homo sapien
agtttcttgcataaagctcatactasaaatgaggttaaaaacaatatagt

SEQ ID NO: 93491 - DNA, 50 bp, homo sapien
aaagcacaagatacaatgctttcaasaactctgggcatattaattgaaga

SEQ ID NO: 93492 - DNA, 50 bp, homo sapien
aatcataggagtcactatctcattaygtacccttatattcacagatcccc

SEQ ID NO: 93493 - DNA, 50 bp, homo sapien
agatgcttatcataggtaatgcgaarataatacagactgagtgtgtagtt

SEQ ID NO: 93494 - DNA, 50 bp, homo sapien
ttagggttttaaaagcatcccttcckatcaatcatttctaaaagagcaat

SEQ ID NO: 93495 - DNA, 50 bp, homo sapien
gatgcttctctatgaggatttaaaargtgaaatcttgatcataagatttg

SEQ ID NO: 93496 - DNA, 50 bp, homo sapien
cactcattcctcctctagtcacctasgccttatcctgttgttcagctggt

SEQ ID NO: 93497 - DNA, 50 bp, homo sapien
tttttaagttttattatttaaccaakgtcataccaactcataagaggtag

SEQ ID NO: 93498 - DNA, 50 bp, homo sapien
agagagaggcaattcactgaagggartatagaaatgcaaattaacatcat

SEQ ID NO: 93499 - DNA, 50 bp, homo sapien
taactatgctattggcactttaatgraagccgtggtgagtaataagatat

SEQ ID NO: 93500 - DNA, 50 bp, homo sapien
tattacatttttagatgagcttatcraggcacagctaatttaaatcattt

SEQ ID NO: 93501 - DNA, 50 bp, homo sapien
atttgaattactgaggcaaaatatasaagctttaggaagagggaacaaaa

SEQ ID NO: 93502 - DNA, 50 bp, homo sapien
gattactcaacactagctttatgagwcatacagattggaagttcatatag

SEQ ID NO: 93503 - DNA, 50 bp, homo sapien
ggtaaggtaggattatatttctccartgcaaaactctgtccactttctta

SEQ ID NO: 93504 - DNA, 50 bp, homo sapien
tgctaagcctagccacagaaagttawaggaaccatatttgtttgtttgtt

SEQ ID NO: 93505 - DNA, 50 bp, homo sapien
gggtcccaaatcaagcttaacttcargtgaatagattcaaacaaaaaatc

SEQ ID NO: 93506 - DNA, 50 bp, homo sapien
gaatacacttttcttccaggagttaygtttctcaactgacagatgaagta

SEQ ID NO: 93507 - DNA, 50 bp, homo sapien
acagtttccaatttcagataaataawttaaccagagctacttctgatata

SEQ ID NO: 93508 - DNA, 50 bp, homo sapien
ttcctgacgaatttttcacttttccrccaaatgccgacacagcctcacat

SEQ ID NO: 93509 - DNA, 50 bp, homo sapien
ggtctagaactgtcatcagattctcyaggagaccataacttcaaaaaagt

SEQ ID NO: 93510 - DNA, 50 bp, homo sapien
tcagtaacagactgaagtcccatcamcacttcatgaaagacctggagaat

SEQ ID NO: 93511 - DNA, 50 bp, homo sapien
gtcattgcatgtgaaggatccctcartgaaaagagaggtattgtccaaag

SEQ ID NO: 93512 - DNA, 50 bp, homo sapien
gaaattagactagtacacctagcaarctaatttatagaaaaaatatgctc

SEQ ID NO: 93513 - DNA, 50 bp, homo sapien
tgcaaccttaatccatgacgcttgtragtggagctatttttcaatctacg

SEQ ID NO: 93514 - DNA, 50 bp, homo sapien
atataaggtgatactaaggctcggcrtcctttaacctgtcattagtcaag

SEQ ID NO: 93515 - DNA, 50 bp, homo sapien
tcaaacatccagtatttagcagctayctgatttcttcttcgaatttttgg

SEQ ID NO: 93516 - DNA, 50 bp, homo sapien
aagtgaagtttttctgattttaatcygtcaggtttccatgttctataatc

SEQ ID NO: 93517 - DNA, 50 bp, homo sapien
gaaaacagaaattaaacgatgctatmaaatgtatcttctcttaatctaat

SEQ ID NO: 93518 - DNA, 50 bp, homo sapien
ttttaatgtgtttcatgtatttggaytatttctcccaattattttcttgt

SEQ ID NO: 93519 - DNA, 50 bp, homo sapien
aacctgctgtaacttccatctgtacratttccacatcctcaaaatactga

SEQ ID NO: 93520 - DNA, 50 bp, homo sapien
ctgaagacagagcagagaaacatctyacttttcaatttacccctctagtt

SEQ ID NO: 93521 - DNA, 50 bp, homo sapien
gattttcagatatagaggaactaccmgatagacagttaagaaaaagtcat

SEQ ID NO: 93522 - DNA, 50 bp, homo sapien
gcaaagctagactgactcattgttaygtgaaaaactgacacttagtgtta

SEQ ID NO: 93523 - DNA, 50 bp, homo sapien
aataggacattacaaagtcgcaatayagccaatggttcttgccatctgac

SEQ ID NO: 93524 - DNA, 50 bp, homo sapien
tagttttctatgctctggaaacaaaygtcttgatttagaaacctaaaaaa

SEQ ID NO: 93525 - DNA, 50 bp, homo sapien
ctggcacagttaatgggtgtaggtaygttaatctcatttacagatgggaa

SEQ ID NO: 93526 - DNA, 50 bp, homo sapien
gaggtacaggcattggataaacatamctttccaaatgggacaaattgaag

SEQ ID NO: 93527 - DNA, 50 bp, homo sapien
tggcttaatttgaagccaagtcttawctcatagcatccctttaactcttt

SEQ ID NO: 93528 - DNA, 50 bp, homo sapien
ctaacacttttatgcaacaatatcasaatgccttttttatatgtctagaa

SEQ ID NO: 93529 - DNA, 50 bp, homo sapien
cactacacatttatagggaactactkaataatgagagattcttggtctag

SEQ ID NO: 93530 - DNA, 50 bp, homo sapien
tttgacatgctaaatgtggtcaatcracatagttctccatttggaaagaa

SEQ ID NO: 93531 - DNA, 50 bp, homo sapien
agttcagatgagaaacatctaatgaygaaactggagatataatcaagacc

SEQ ID NO: 93532 - DNA, 50 bp, homo sapien
ttactatcatatcataaaagcagtcraacaaaatattgttattctgacct

SEQ ID NO: 93533 - DNA, 50 bp, homo sapien
ttctagtcctcaaggtcatttaactwccaggactaattactccctctact

SEQ ID NO: 93534 - DNA, 50 bp, homo sapien
gtgtcacttgtttgtatagagtcaaycacatgtttaacctccagaccaat

SEQ ID NO: 93535 - DNA, 50 bp, homo sapien
atttatgtttcagagatcacataggrccaaaattgtgtaaatgcacacaa

SEQ ID NO: 93536 - DNA, 50 bp, homo sapien
cccactattgcagaatcaccgtaaasttctgtaccatgaaatatgtaatt

SEQ ID NO: 93537 - DNA, 50 bp, homo sapien
tcaaattgcatgttaagcagaattayggttgacgctcaaatatttgttga

SEQ ID NO: 93538 - DNA, 50 bp, homo sapien
atacaggcaaaaatattaaaaataaygactacagcagtagatgtgacatc

SEQ ID NO: 93539 - DNA, 50 bp, homo sapien
ttacctacagaaaactacctgtgtcwatctttttccttcctctgtgctgc

SEQ ID NO: 93540 - DNA, 50 bp, homo sapien
ccagttcagctctgaagtgttaatcrtttacacaagcatggaaaaataga

SEQ ID NO: 93541 - DNA, 50 bp, homo sapien
tttaataagaatggctgttaaaaaawttcacattcatattttgagtaaaa

SEQ ID NO: 93542 - DNA, 50 bp, homo sapien
aaatatagtcagagcaaaagcatatkatagcaaagcatatagtcagtggg

SEQ ID NO: 93543 - DNA, 50 bp, homo sapien
tgtgctccacaacatgtctaagatayatcaggagtggattttcattataa

SEQ ID NO: 93544 - DNA, 50 bp, homo sapien
ggaaataaagcttatttttctgtaaytaatatagtcttcttcatgagcct

SEQ ID NO: 93545 - DNA, 50 bp, homo sapien
ttacaatttcacatgatgccgagaarcagtcataacaataagtcatgatc

SEQ ID NO: 93546 - DNA, 50 bp, homo sapien
gaggacaaaatacatgttatcttcartcaatcacatcatctagagataat

SEQ ID NO: 93547 - DNA, 50 bp, homo sapien
ctttgtctcataggcaagagaaatastataaacagaggaatggaattata

SEQ ID NO: 93548 - DNA, 50 bp, homo sapien
ctaggcggtccttgattaaattcatmactgatttgcttctagaaaactcc

SEQ ID NO: 93549 - DNA, 50 bp, homo sapien
ataggtaatgataccattcctcatcrattatatgaagcatcatattggaa

SEQ ID NO: 93550 - DNA, 50 bp, homo sapien
actgggattcactacagggtctcaayctaaccattagagaatagagaaag

SEQ ID NO: 93551 - DNA, 50 bp, homo sapien
tcttattcatttatctgcaacattgsatttgtcctacaactttgaacctg

SEQ ID NO: 93552 - DNA, 50 bp, homo sapien
tctcaacttgataaagcacatatacraataacctctattggacaatgtat

SEQ ID NO: 93553 - DNA, 50 bp, homo sapien
tagtcacaaattttttctttagctaygttcgatctgctgttaatcagatc

SEQ ID NO: 93554 - DNA, 50 bp, homo sapien
agtagaggggtaagaaaaatgctacrattgccagtaacagagatgaatca

SEQ ID NO: 93555 - DNA, 50 bp, homo sapien
tgagaatcaattttttaagccttcamatttacattgatctactgagaatc

SEQ ID NO: 93556 - DNA, 50 bp, homo sapien
attttattcatcaatgcttcaaataygttgtcatctcccctttcttggga

SEQ ID NO: 93557 - DNA, 50 bp, homo sapien
ctagatcttctatttattaattacakgatctgggacacatgacctaaatg

SEQ ID NO: 93558 - DNA, 50 bp, homo sapien
ttttctaaaaataaaatgctagagayatgtaagtgttatgagacatagtg

SEQ ID NO: 93559 - DNA, 50 bp, homo sapien
aaaatcacttctgtcattatatctgkctacattttatccatcaacccagt

SEQ ID NO: 93560 - DNA, 50 bp, homo sapien
cccctttctccatttacatcattttyttcctagtaactagaaaactcctg

SEQ ID NO: 93561 - DNA, 50 bp, homo sapien
ttgtggaaacaattacaaaatatgasatgtgtctaatatcttttctttgc

SEQ ID NO: 93562 - DNA, 50 bp, homo sapien
tttttcctactcaaggtgatttttarataccagagtgccataaccaaaga

SEQ ID NO: 93563 - DNA, 50 bp, homo sapien
taatgtgtaatgaaactaaagtatasgagaatcaaactcaaaaccctttt

SEQ ID NO: 93564 - DNA, 50 bp, homo sapien
tttgagatatttcactgaaacaaaaygggcataattatttagacggacat

SEQ ID NO: 93565 - DNA, 50 bp, homo sapien
tgtctatagtttagtctctgtagtamatttttaatctcaggtattatatt

SEQ ID NO: 93566 - DNA, 50 bp, homo sapien
atattgaaagtcacattatcaagacrctcatatcttaccacagtctttct

SEQ ID NO: 93567 - DNA, 50 bp, homo sapien
taacacaaagcagaatgtactaccartaaccgcgagccagttcttcaaaa

SEQ ID NO: 93568 - DNA, 50 bp, homo sapien
agaggcctccttgctattttgccaaytatcgagttattaccaagaaatat

SEQ ID NO: 93569 - DNA, 50 bp, homo sapien
aattggtcgctactaatctattaackattgggatcataaacaggaatagg

SEQ ID NO: 93570 - DNA, 50 bp, homo sapien
ctgtgcatgctactctgcctcttgarccatatgatctagcagatccaatg

SEQ ID NO: 93571 - DNA, 50 bp, homo sapien
aaactgttctatacttagcactcccraaagggtaatggagacactgaaat

SEQ ID NO: 93572 - DNA, 50 bp, homo sapien
tgtatttgatgtatgaaaaatataargcttagaacaatgaagtataagtc

SEQ ID NO: 93573 - DNA, 50 bp, homo sapien
gtagaagaacagtatctctctaaccyaaacgttttgctagaaacactgcc

SEQ ID NO: 93574 - DNA, 50 bp, homo sapien
tgaatcatgaagcataattatctaamtccctgaatctagtacatgagggc

SEQ ID NO: 93575 - DNA, 50 bp, homo sapien
agtgaaatctcttttgaactgactargatttgagccagtaagaaggcagt

SEQ ID NO: 93576 - DNA, 50 bp, homo sapien
gctaagtaaccagagaggcataaaayacgttgccaggaatgtctgtcagg

SEQ ID NO: 93577 - DNA, 50 bp, homo sapien
ggtattgtcttatatggattaaataygattgaacacctttaacttttccc

SEQ ID NO: 93578 - DNA, 50 bp, homo sapien
ataaatatacaaataacatagtagcragaagataaatttgggagtataaa

SEQ ID NO: 93579 - DNA, 50 bp, homo sapien
agcaccttaatccaaactcaaacaayatttgccatcagcgcaaacctcac

SEQ ID NO: 93580 - DNA, 50 bp, homo sapien
cctaagacagtataatgctgatctcrcacagatataaatatgtgaaattg

SEQ ID NO: 93581 - DNA, 50 bp, homo sapien
ctgagcatgaaatgtctctgtttacygaaatgtgacaaaagctcattctc

SEQ ID NO: 93582 - DNA, 50 bp, homo sapien
aaatagcatgcataaatttgtaacasctcaaatacacacattttacaact

SEQ ID NO: 93583 - DNA, 50 bp, homo sapien
agataggggaacagaggataatggamaggaaacatcagtgctcacatgtt

SEQ ID NO: 93584 - DNA, 50 bp, homo sapien
ttcagtacgtagaaagttgttgaagkacaataagggtataagaatacaaa

SEQ ID NO: 93585 - DNA, 50 bp, homo sapien
attttataaagattttttttgtgcckaagggattaagaaacacatctaca

SEQ ID NO: 93586 - DNA, 50 bp, homo sapien
cgtattgaatctataagttaaaaccratcatcttactttggtctttattg

SEQ ID NO: 93587 - DNA, 50 bp, homo sapien
tgaacatctgtgctaatggaacataygagagagaattctaatcctgattc

SEQ ID NO: 93588 - DNA, 50 bp, homo sapien
agcccatatttatacttttattgtaygctgcctataatttggttaaatgt

SEQ ID NO: 93589 - DNA, 50 bp, homo sapien
gcagcatacaataaaagtataaataygggcttttgacgctcctggtccta

SEQ ID NO: 93590 - DNA, 50 bp, homo sapien
ctgacaagcagaatatttgaccaatkacaactaatacttcttttagtaga

SEQ ID NO: 93591 - DNA, 50 bp, homo sapien
gtgttgaactcctgtataaaaatcayactacatagaaagagatcagaatc

SEQ ID NO: 93592 - DNA, 50 bp, homo sapien
ggcattacatgctttgaaaactagasgtgagacaaaaatcaacctgttga

SEQ ID NO: 93593 - DNA, 50 bp, homo sapien
gttatgttttctattttgtgggtaayagtacctgctatactgattgattc

SEQ ID NO: 93594 - DNA, 50 bp, homo sapien
tagccagtgctgtgggaatttacttsaacaatcacagtgatcattttaaa

SEQ ID NO: 93595 - DNA, 50 bp, homo sapien
aagagtactagataaatgtatcaccyatgcttattgcagtagaaacaaat

SEQ ID NO: 93596 - DNA, 50 bp, homo sapien
agcttgattattgtcctggcaagcamgtaaattactaaatgaccaccagg

SEQ ID NO: 93597 - DNA, 50 bp, homo sapien
aaatcttttgttttggatatcatttwaaaaacatatagattaactatgaa

SEQ ID NO: 93598 - DNA, 50 bp, homo sapien
gatcagtttgcttgttgttaataagragaccatgaggtatctctaaaatt

SEQ ID NO: 93599 - DNA, 50 bp, homo sapien
ttcttcagaatccactaacagcagakatattattaattcatcatgtgaaa

SEQ ID NO: 93600 - DNA, 50 bp, homo sapien
tgcagttctagagctatgctttcatragaaaatttttaaaaaaatgttta

SEQ ID NO: 93601 - DNA, 50 bp, homo sapien
atatcatgaaattcgatgaaagcagractttaacatgataattttaatga

SEQ ID NO: 93602 - DNA, 50 bp, homo sapien
tcttgggctcttacctaagttctcaygttctaaatagaatttaagctcct

SEQ ID NO: 93603 - DNA, 50 bp, homo sapien
caaaaatgcaccagtaacgtaaacakggaatctttgtcattaaaaaaaaa

SEQ ID NO: 93604 - DNA, 50 bp, homo sapien
aagttctattgaatattttgatttargtgcatattaatactacaaattat

SEQ ID NO: 93605 - DNA, 50 bp, homo sapien
taccaggtacactccaactcaaaackagaagaagcttctgtgctcaggac

SEQ ID NO: 93606 - DNA, 50 bp, homo sapien
ttctaaaatataataaactggtaacygtaagtaaatgtttcccggagttc

SEQ ID NO: 93607 - DNA, 50 bp, homo sapien
tagcttggcttagaagtgttcctcartcttggtgctattgtcattttaag

SEQ ID NO: 93608 - DNA, 50 bp, homo sapien
gtcactttgttagacccattaatcawcctcagcaactcagcttcccctgg

SEQ ID NO: 93609 - DNA, 50 bp, homo sapien
atctaacaacatgctctacagttcaktcctaaatcaatcactggagtttc

SEQ ID NO: 93610 - DNA, 50 bp, homo sapien
tccttgaaggcaagagctttacacayagtaggatttcactcagtttttgc

SEQ ID NO: 93611 - DNA, 50 bp, homo sapien
tactgggtttgtcgctctctttaatyatcagtactgtttcccacctcact

SEQ ID NO: 93612 - DNA, 50 bp, homo sapien
gctggatattaaaacatatggttaaytgaaacagtactagtaaaactaaa

SEQ ID NO: 93613 - DNA, 50 bp, homo sapien
attaagcttctcttgttaattcttcwcctataatagtatttctcttcttt

SEQ ID NO: 93614 - DNA, 50 bp, homo sapien
ttgtcaatttgcataaattcagatgyaatgagatgttgcacagtgattca

SEQ ID NO: 93615 - DNA, 50 bp, homo sapien
ttagaacagtgcttgatatacaatargatttgaatacatgcatgtggaag

SEQ ID NO: 93616 - DNA, 50 bp, homo sapien
agctgtaaacaaaatagaccacttayctatcttcgtggagattatattcc

SEQ ID NO: 93617 - DNA, 50 bp, homo sapien
ctcttcagttaatatttagataagaygaagtatcaatagtcagtatttta

SEQ ID NO: 93618 - DNA, 50 bp, homo sapien
aacccagggttttagatgttattgcwagcattgattttacaaaagttcac

SEQ ID NO: 93619 - DNA, 50 bp, homo sapien
tatgcctacctttatgacttatcaargattcaagtgttccaattgtttta

SEQ ID NO: 93620 - DNA, 50 bp, homo sapien
cttcagatttgtatgccaggatataygtaataatgtgttcatgacttaaa

SEQ ID NO: 93621 - DNA, 50 bp, homo sapien
taccattgcaaaacaaaccgactcaraacattggattaaaatcatttatt

SEQ ID NO: 93622 - DNA, 50 bp, homo sapien
caggaaggacttccgggcagaaatawctacaaatgcaaaggcttgagaaa

SEQ ID NO: 93623 - DNA, 50 bp, homo sapien
cacaagacatacaaagaaagagaaamgtatggactattcaaagaaaaata

SEQ ID NO: 93624 - DNA, 50 bp, homo sapien
aaacacaatgagttagagtaatggcratagatttcttagcaatttgaaca

SEQ ID NO: 93625 - DNA, 50 bp, homo sapien
ttcactgtacatcttgggcattttargattttaatgtttctcacctaccc

SEQ ID NO: 93626 - DNA, 50 bp, homo sapien
atcaaatttatcttcacagttatcartaaacaggtacttagcagtcccca

SEQ ID NO: 93627 - DNA, 50 bp, homo sapien
gtgaaaagagaaacagaatcctgtckatttagaagtagaacctagctagt

SEQ ID NO: 93628 - DNA, 50 bp, homo sapien
actagattgcttctaattcaatcagrtatccttagaaccaatgaggaaac

SEQ ID NO: 93629 - DNA, 50 bp, homo sapien
ttaagtaagcagagatttgaagctayatctgaattacttcaagctaaaga

SEQ ID NO: 93630 - DNA, 50 bp, homo sapien
ttaattttccttcctacactcctgaygggttttaaaaatatattgttttc

SEQ ID NO: 93631 - DNA, 50 bp, homo sapien
gaagcccaattttcatggattttaartgtaaatgacctctagccctaacc

SEQ ID NO: 93632 - DNA, 50 bp, homo sapien
ataaggtaagacttcattgtttaatwaattttgacaaacttaacagaagg

SEQ ID NO: 93633 - DNA, 50 bp, homo sapien
catttttacaaaagtgatagtagaartgttaggacctgagtaaaataagc

SEQ ID NO: 93634 - DNA, 50 bp, homo sapien
taaaagctaccaaagacagaagagamggttaaagtagaggacttctaaag

SEQ ID NO: 93635 - DNA, 50 bp, homo sapien
tttaaaatcatatcaaacagaattgyaaactctctaaagcagtgtgtcaa

SEQ ID NO: 93636 - DNA, 50 bp, homo sapien
tattaaccatcacagctatgaatgartagaagtgttaaacctggatggca

SEQ ID NO: 93637 - DNA, 50 bp, homo sapien
ctcttccatcagagtcagagcatcasatataaactgcagggccagagcta

SEQ ID NO: 93638 - DNA, 50 bp, homo sapien
tctagaggtaaagcatggctgacaamttcatagttcctgaattagcctgt

SEQ ID NO: 93639 - DNA, 50 bp, homo sapien
ttctttattgattattctcaccacarcaatttttcccttcgattgtacca

SEQ ID NO: 93640 - DNA, 50 bp, homo sapien
aatgtttataccaattatgtctttckcttaattaactgcattgccaagaa

SEQ ID NO: 93641 - DNA, 50 bp, homo sapien
ctattaaaagtcagaatcttataccracaattgcaaggacttggaaacag

SEQ ID NO: 93642 - DNA, 50 bp, homo sapien
ggatggaggtattcatgtacctaacmgcatatgtatcagcataggctgat

SEQ ID NO: 93643 - DNA, 50 bp, homo sapien
ctaggggtaatggtaagcagggccaytccaactcctactgccaggaccca

SEQ ID NO: 93644 - DNA, 50 bp, homo sapien
gttgcttcaaatattttgtctcctaycttattattcattaatagtgactg

SEQ ID NO: 93645 - DNA, 50 bp, homo sapien
ttcctggaggtatcactcttctcacrcagatttacaatctccagcatgga

SEQ ID NO: 93646 - DNA, 50 bp, homo sapien
caagcccaacactgacaaagaatcayacattgcgtcggtgtttcaattaa

SEQ ID NO: 93647 - DNA, 50 bp, homo sapien
acacatggcaggaaggaaataccacygcttcttatgcatacagaataata

SEQ ID NO: 93648 - DNA, 50 bp, homo sapien
gattctttgtcagtgttgggcttgaytacaatagaatgaagattattttt

SEQ ID NO: 93649 - DNA, 50 bp, homo sapien
gttgtgttattgatttgcagttataraattgattgcataaaagataccaa

SEQ ID NO: 93650 - DNA, 50 bp, homo sapien
atccgtgtgtgttctacagaagcaakaataatggcaatatttaatgacac

SEQ ID NO: 93651 - DNA, 50 bp, homo sapien
tctcaccatcctcatatcaaatctaygcactaatttttatcgaaatacat

SEQ ID NO: 93652 - DNA, 50 bp, homo sapien
agtgccttgatgttaaacggagacaytacagttactttccctgcctgaag

SEQ ID NO: 93653 - DNA, 50 bp, homo sapien
tgacccttcttacttctccaagtcamcacaagctgacactcatttataga

SEQ ID NO: 93654 - DNA, 50 bp, homo sapien
ccgtttaacatcaaggcactatatamcttcctccagaatattggttgctc

SEQ ID NO: 93655 - DNA, 50 bp, homo sapien
agagagagataataatgctaacttayggttgtgttgtctgggctgaagga

SEQ ID NO: 93656 - DNA, 50 bp, homo sapien
gaaaagggtgagtctgaaccgtaggraaactgagtatttaggattcattt

SEQ ID NO: 93657 - DNA, 50 bp, homo sapien
atgcttcaaatgttcccaaaggtgayggtaataggtagtgtatcactgtg

SEQ ID NO: 93658 - DNA, 50 bp, homo sapien
ggtgatagggaaggcatcggaagacyagatacacgcaaatggatgcattt

SEQ ID NO: 93659 - DNA, 50 bp, homo sapien
agctgtcatctaataatcaataacckgcataatacagtttgtgttctagt

SEQ ID NO: 93660 - DNA, 50 bp, homo sapien
cagcataaccatataaattatgaacrctttaactagattgaaatctctag

SEQ ID NO: 93661 - DNA, 50 bp, homo sapien
taagtggagcatttaggctatttacrtaaaactttagtagtgagatgtga

SEQ ID NO: 93662 - DNA, 50 bp, homo sapien
cactgcctctccccatacagacgctsacagaatagacggggaagcaacta

SEQ ID NO: 93663 - DNA, 50 bp, homo sapien
tacagcaggcagaaaaacatgaaaasgagagacaggcctagctcccagcc

SEQ ID NO: 93664 - DNA, 50 bp, homo sapien
atcaactatagtctatgaaaactatsacatgcattaaatatagagttgtg

SEQ ID NO: 93665 - DNA, 50 bp, homo sapien
agagaatagggaaacttagagtaccraatgaatggagactaacgagggtc

SEQ ID NO: 93666 - DNA, 50 bp, homo sapien
ttcaggaagctaatttcgccgattcrttaaaataatcgacttttaacaga

SEQ ID NO: 93667 - DNA, 50 bp, homo sapien
aatagaataatagttcagtaaaaacmaggtgatattcttgatgactcctt

SEQ ID NO: 93668 - DNA, 50 bp, homo sapien
agccataatcacattgtcatttgatstttgtaaatatctcaaactaagtt

SEQ ID NO: 93669 - DNA, 50 bp, homo sapien
acagtttgaacacacaatggacaccragaggaaatctgaatatcatgaag

SEQ ID NO: 93670 - DNA, 50 bp, homo sapien
ttacacacaggtaaaattgaaacccraagaagtgaagggaatttttattt

SEQ ID NO: 93671 - DNA, 50 bp, homo sapien
caaatctagtcttgtcttttgtcaayatagttctaaaatcctgtataagc

SEQ ID NO: 93672 - DNA, 50 bp, homo sapien
gtgctacttgttcctctaaggataarcggatgataggatttcagagctgg

SEQ ID NO: 93673 - DNA, 50 bp, homo sapien
tacctatattttggactctgagttamgactttctggaccttaagagcaag

SEQ ID NO: 93674 - DNA, 50 bp, homo sapien
agccagctaacagggacacctgatcrctccttggcaagatgtaacacatt

SEQ ID NO: 93675 - DNA, 50 bp, homo sapien
acctccctgcacactcattcattacstgccattcaatagtccttggccct

SEQ ID NO: 93676 - DNA, 50 bp, homo sapien
ccagcataaatatagatagacttcayggaatcactgaatattcaatctgg

SEQ ID NO: 93677 - DNA, 50 bp, homo sapien
tataagcctttgcagttgtgttaacrgtcatggtggatcctccgctgccc

SEQ ID NO: 93678 - DNA, 50 bp, homo sapien
gtctgaagacccagagtatactacayagtaagttctacctatcaaatgat

SEQ ID NO: 93679 - DNA, 50 bp, homo sapien
ttttgtagtatttctcaacccactayatagctagggtgacttcacagttc

SEQ ID NO: 93680 - DNA, 50 bp, homo sapien
acagatttgttgctatcctcattagraaattccatttggaggtctagcag

SEQ ID NO: 93681 - DNA, 50 bp, homo sapien
ctagatccataaagatttccataggyattagagtcattaccactctgctc

SEQ ID NO: 93682 - DNA, 50 bp, homo sapien
ctggattgaccctactagaaaatggmaaaatctccctggtgtttctatag

SEQ ID NO: 93683 - DNA, 50 bp, homo sapien
gatttttgtggtaaatgtattccctsagctatttgcatgtatgtgggttt

SEQ ID NO: 93684 - DNA, 50 bp, homo sapien
gggagcttactcccaggaactagtasgtcctcaaatgccttggcttccat

SEQ ID NO: 93685 - DNA, 50 bp, homo sapien
taagcctcttacaattcgtgcataamcgaaaggagatgcagatttgttct

SEQ ID NO: 93686 - DNA, 50 bp, homo sapien
tccaggtgaccaaaataaaattacgraaaagcatccctgtcactattaag

SEQ ID NO: 93687 - DNA, 50 bp, homo sapien
tcaaaggaagcttctattattttgamaaaccatgctgattagcacttaaa

SEQ ID NO: 93688 - DNA, 50 bp, homo sapien
gaatttgctgacatttactgactaaragctttacctatccccaaggaggg

SEQ ID NO: 93689 - DNA, 50 bp, homo sapien
agcagtttccttcagagcctaatgaygaaattattctgttgcagtaaaga

SEQ ID NO: 93690 - DNA, 50 bp, homo sapien
ctgacatcctcaagatagagttgtcrtttttagggagaagtcagagagat

SEQ ID NO: 93691 - DNA, 50 bp, homo sapien
tgttcatctgaatatctgaggtttgraaaaaatctccttcttgtttgaac

SEQ ID NO: 93692 - DNA, 50 bp, homo sapien
acattgataagttttcacgctaaaaytgagattctttcagccaaaggcac

SEQ ID NO: 93693 - DNA, 50 bp, homo sapien
ctaaagatcacctggaaagaaattgkaaggaatttggttcttagtggata

SEQ ID NO: 93694 - DNA, 50 bp, homo sapien
acatctgctaatagctaacctacttkaaccagctggattgtgcttatgat

SEQ ID NO: 93695 - DNA, 50 bp, homo sapien
gtgtaaaatgtgagaaatgatattcrccgccgactgcccaactgtagaga

SEQ ID NO: 93696 - DNA, 50 bp, homo sapien
taaatatgatctatgctggtatgtcratattttagatgccaaattattcc

SEQ ID NO: 93697 - DNA, 50 bp, homo sapien
atcaagcaatcaatggattgaagaartaaagaagcaatcccaagagaaat

SEQ ID NO: 93698 - DNA, 50 bp, homo sapien
caaatagacctatgaaaggcactaaraagagaactccgcctagtatagat

SEQ ID NO: 93699 - DNA, 50 bp, homo sapien
tttaagaagcctctaaattgattgayggtcattttcgtagtcttgcccca

SEQ ID NO: 93700 - DNA, 50 bp, homo sapien
atattgaatttcatgttcaatacacygactaatccacaaactgtaataaa

SEQ ID NO: 93701 - DNA, 50 bp, homo sapien
ctagaaagggagaccaccagttataygcaccataaattatcaagacagct

SEQ ID NO: 93702 - DNA, 50 bp, homo sapien
tcctggagctcttacttggcatgaargactacgcctatgggaactaagag

SEQ ID NO: 93703 - DNA, 50 bp, homo sapien
ggaaaatcctttttatccttaatcaygtagcaagcaaaagtgtgacctgg

SEQ ID NO: 93704 - DNA, 50 bp, homo sapien
ctgaggcggagtaaatatgtaggccygagtgaaagcactgaagaatctga

SEQ ID NO: 93705 - DNA, 50 bp, homo sapien
gtggtggccgtcaacagttcaggcarctttacttagcttgtccttgccca

SEQ ID NO: 93706 - DNA, 50 bp, homo sapien
actcccacaaagtgatctcttcttakgctctaggttgagtactttggttt

SEQ ID NO: 93707 - DNA, 50 bp, homo sapien
tgggccccattccaagtttactgaawcagcatatgcaatttaagaagatc

SEQ ID NO: 93708 - DNA, 50 bp, homo sapien
taatagttttgatgtctactttccawactataacctaccacttggttttc

SEQ ID NO: 93709 - DNA, 50 bp, homo sapien
gcaagtccagagaactatacatctamgtcatagctctacacaattgtcaa

SEQ ID NO: 93710 - DNA, 50 bp, homo sapien
cactgtcccttatgtcctttctttcrctaagaatacatgtagagaaggtt

SEQ ID NO: 93711 - DNA, 50 bp, homo sapien
ccttcaatgtctcgtgctcttcttamagtggagatgattcttttacttta

SEQ ID NO: 93712 - DNA, 50 bp, homo sapien
gcattattgacataaacgatgtagamtattttaataaagaaacagtctgt

SEQ ID NO: 93713 - DNA, 50 bp, homo sapien
cttgttgaattcctctttgtagccaygatgcttaggatagtaatgtaaaa

SEQ ID NO: 93714 - DNA, 50 bp, homo sapien
accttgcccctacatcaagaaactcrcagcttacagtcttccagcttccc

SEQ ID NO: 93715 - DNA, 50 bp, homo sapien
caggtgaagcagataatctcagaacmgtggctactgcgatgtcattcact

SEQ ID NO: 93716 - DNA, 50 bp, homo sapien
ccctggtcccaggttgaggtataagrcaacagggcttgggtcttgagagt

SEQ ID NO: 93717 - DNA, 50 bp, homo sapien
ttaggcttcaccagcaaccgggaagrctcctagattctccttgactgtgg

SEQ ID NO: 93718 - DNA, 50 bp, homo sapien
aaagatgtgctgttgcaaaatatcawgggagatgtttacagtggtgttct

SEQ ID NO: 93719 - DNA, 50 bp, homo sapien
ctttagacatgtttggttttaattayatatcaagcaatcaaacagctagg

SEQ ID NO: 93720 - DNA, 50 bp, homo sapien
aagaccaaatgatagaaaatttaacrgaaagtgaagagaatagattttct

SEQ ID NO: 93721 - DNA, 50 bp, homo sapien
attaaaaccaaacatgtctaaagcckcactcaatcctcctgaaacaatat

SEQ ID NO: 93722 - DNA, 50 bp, homo sapien
tttgggcttaatcatgaaggtaatcrgaagttattggaggattttatccg

SEQ ID NO: 93723 - DNA, 50 bp, homo sapien
tcctaaaagtctcaaaagatgagatyaaattgaataggtccagaaatgga

SEQ ID NO: 93724 - DNA, 50 bp, homo sapien
aggataacactggttctgtcatgcawctacagtactaagatttaaagcta

SEQ ID NO: 93725 - DNA, 50 bp, homo sapien
taataagcatttcatcatttatcccrgaagaatttcaagtaaattagttc

SEQ ID NO: 93726 - DNA, 50 bp, homo sapien
gtatgggtaaagagaaggatgcgtayatagcctaaaaaatttgccagaga

SEQ ID NO: 93727 - DNA, 50 bp, homo sapien
agagaggtggccatgaacctgaaaarcatagattataaccatctgaaatg

SEQ ID NO: 93728 - DNA, 50 bp, homo sapien
agacacttacgctgtataaagcacargtttgagaaacctccctttccaaa

SEQ ID NO: 93729 - DNA, 50 bp, homo sapien
aaaaatgttaatccttatgagggtaygatgaagtagacacgcagtaacta

SEQ ID NO: 93730 - DNA, 50 bp, homo sapien
catcccttctttaagattctctcctraaatagaggaaagccagtatttgc

SEQ ID NO: 93731 - DNA, 50 bp, homo sapien
cagttgcagtactagttggtagtcamatctcaccatcaggaccccttgtt

SEQ ID NO: 93732 - DNA, 50 bp, homo sapien
gttctctctccctggaaatgcccttytgcatatagccatctcctcccatc

SEQ ID NO: 93733 - DNA, 50 bp, homo sapien
cactgcctggggacatttgttcacawtacagaattatccttaactttgta

SEQ ID NO: 93734 - DNA, 50 bp, homo sapien
aatggggagagaggaggaaggttgayggcactattgttctctactttcct

SEQ ID NO: 93735 - DNA, 50 bp, homo sapien
acacaagtataaaaaagaatgccaastcagtgcagggatcacctccctcc

SEQ ID NO: 93736 - DNA, 50 bp, homo sapien
tgaatccaaagctactattagtctaygaggcagtcaaaaacacaaagttc

SEQ ID NO: 93737 - DNA, 50 bp, homo sapien
aaaacaatatccgctgagtacttackgcatgccagatgttttcatatatt

SEQ ID NO: 93738 - DNA, 32 bp, homo sapien
tttgtataatggtgtayatatcctaaaagttg

SEQ ID NO: 93739 - DNA, 50 bp, homo sapien
agagattagacatcagcctcataaayggatgtctcaggagaatgactgaa

SEQ ID NO: 93740 - DNA, 50 bp, homo sapien
gacttccacatgtttattgtgtcaartacctgtggagcatagacagacta

SEQ ID NO: 93741 - DNA, 50 bp, homo sapien
agtcttgattctggctgagatttgcrgaccaaaatgaggatcttgtgtcg

SEQ ID NO: 93742 - DNA, 50 bp, homo sapien
gtaaggtgtggcacagtgtctaaaaycttagctatgaaaaattatagctc

SEQ ID NO: 93743 - DNA, 50 bp, homo sapien
ttagttcatgcattaccaactgcacygataaaagaagtcaaaataaatta

SEQ ID NO: 93744 - DNA, 50 bp, homo sapien
catttgaaaaatactgcatcctgaayagattgcttccttatccttttctt

SEQ ID NO: 93745 - DNA, 50 bp, homo sapien
ttctttcaaaaattattaaaaggtasagtagtcttggaataaataagcat

SEQ ID NO: 93746 - DNA, 50 bp, homo sapien
ttacatggttttagagtcgctctccrcaagattgcttcattcttataatt

SEQ ID NO: 93747 - DNA, 50 bp, homo sapien
atctgttgcttaacagatatgtcaayggttaagaaaatgggaagaacttt

SEQ ID NO: 93748 - DNA, 50 bp, homo sapien
gaaaccaaaatctctagcttcccaayttggcttaataccaattatagcaa

SEQ ID NO: 93749 - DNA, 50 bp, homo sapien
atatctctctttattttgaacatcckgaagtcagtaattctatcaaattg

SEQ ID NO: 93750 - DNA, 50 bp, homo sapien
aaagctagagaaagatacatatccaraataatacatgagttggaactata

SEQ ID NO: 93751 - DNA, 50 bp, homo sapien
gaattaaatttttttggctgactccrcaattttacctacttcacaacgat

SEQ ID NO: 93752 - DNA, 50 bp, homo sapien
agcatattacatagtaaatgctcaaygggtctattattttaagcagattt

SEQ ID NO: 93753 - DNA, 50 bp, homo sapien
catttggaggcatcctattgacctaycttcgttgcaactggacagcaatt

SEQ ID NO: 93754 - DNA, 50 bp, homo sapien
gatacaaaaacatcatggaaaatgamgaactcacagttataaaacacagg

SEQ ID NO: 93755 - DNA, 50 bp, homo sapien
ccttttattacattagatacgttaarcatagctattttatatttttaaca

SEQ ID NO: 93756 - DNA, 50 bp, homo sapien
tgcacattttattggatgaaaagacraacaacataattatacttgaattt

SEQ ID NO: 93757 - DNA, 50 bp, homo sapien
tacatttcatgaaagactagtgtcckacacaaattagcctgtcttccata

SEQ ID NO: 93758 - DNA, 50 bp, homo sapien
tcacccagtgctgttatataagtaaytcaaagtaacagtcattacttaaa

SEQ ID NO: 93759 - DNA, 50 bp, homo sapien
caggctaattaattgattccacgaaygaaagcaaaattacaagtagagac

SEQ ID NO: 93760 - DNA, 50 bp, homo sapien
catctactgaaaaattgaaatccaaraaatatcaattaagtttaataaat

SEQ ID NO: 93761 - DNA, 50 bp, homo sapien
agtaacgcatgtcacttcaccatcartctctaaggttccatgcttgtctg

SEQ ID NO: 93762 - DNA, 50 bp, homo sapien
tgcattatagctttgtcctagagagratttgagctttaaatcaggtctaa

SEQ ID NO: 93763 - DNA, 50 bp, homo sapien
agggaggttacatgacaccaactccracacaaagaggagatctgccttcg

SEQ ID NO: 93764 - DNA, 50 bp, homo sapien
atggggaggacattttcaggtgttcrctagttcctatcctccttgtttat

SEQ ID NO: 93765 - DNA, 50 bp, homo sapien
tctcctcttgttgaaatcgtcctcartgaaaaaccttcctctgtgttcca

SEQ ID NO: 93766 - DNA, 50 bp, homo sapien
ggcaaccagggaccttaatctccaakacctggtacttgtctcagacatgg

SEQ ID NO: 93767 - DNA, 50 bp, homo sapien
tttttacttcagagtttacaccacakagtggacgggctgtttgtgttacc

SEQ ID NO: 93768 - DNA, 50 bp, homo sapien
gtcaggttaagagcaagacttctaaygatacctttgaatggccctttgta

SEQ ID NO: 93769 - DNA, 50 bp, homo sapien
ttaataataattcctgctaatggtayaatgagacaggattacagacaggt

SEQ ID NO: 93770 - DNA, 50 bp, homo sapien
tcattaaaggatttctataaaagacrtagatcacctagaacagcacctaa

SEQ ID NO: 93771 - DNA, 50 bp, homo sapien
ggggattacttgtacctggttcacckgcccacattagagtaattcaccaa

SEQ ID NO: 93772 - DNA, 50 bp, homo sapien
gcggggtgattcactgaaactctgaygggatccctcactcagctgtctca

SEQ ID NO: 93773 - DNA, 50 bp, homo sapien
caggctgttggggagaatgaaatgcmcaacgaaggacaagttctagaagg

SEQ ID NO: 93774 - DNA, 50 bp, homo sapien
tctgcaggaagtccacaaaactcaasataaagtttgcttgtttctagatt

SEQ ID NO: 93775 - DNA, 50 bp, homo sapien
aaaaatgtgtgtgtgtgttttacatkaaatcataaatcactagtattgtt

SEQ ID NO: 93776 - DNA, 50 bp, homo sapien
tgctctaaagactattaggaggaaartgataactaagaaaacagaaagtt

SEQ ID NO: 93777 - DNA, 50 bp, homo sapien
tgggagtacaaggctatctttggaarggtaattcttgactttggcataga

SEQ ID NO: 93778 - DNA, 50 bp, homo sapien
tagtcaggtacgcacaactatattcracttcaggctttgtatgatacaat

SEQ ID NO: 93779 - DNA, 50 bp, homo sapien
ttcaacttcaggctttgtatgatacratctttgagcgaacagagttagtt

SEQ ID NO: 93780 - DNA, 50 bp, homo sapien
aatgatttgtctaacattgtcagtgragtgttgatatcccccactcttat

SEQ ID NO: 93781 - DNA, 50 bp, homo sapien
ctgaccttctgtttcttcttcttacscactgctataaaaccttggcttat

SEQ ID NO: 93782 - DNA, 50 bp, homo sapien
gggaccctgtctctaaaaccaaaaamattatagcagttaattcccttcta

SEQ ID NO: 93783 - DNA, 50 bp, homo sapien
ttaaatattctcagcaatcaatcaaragtttaagagatcttatctcagaa

SEQ ID NO: 93784 - DNA, 50 bp, homo sapien
attgctccaaattaaatgaaacttaygcttatcccttgcttatattgaaa

SEQ ID NO: 93785 - DNA, 50 bp, homo sapien
tcaggggaaagagtgaccctagctgracacagaggagtgaccagacatgt

SEQ ID NO: 93786 - DNA, 50 bp, homo sapien
acttaagacatagtcatcttaaagcrctgcatctttagcaaatgtagtac

SEQ ID NO: 93787 - DNA, 50 bp, homo sapien
tgggccactagaacacccaaaatatsaaaaagggaccaagagccttagtt

SEQ ID NO: 93788 - DNA, 50 bp, homo sapien
tcagtgtgggcgtcaatgacttgtayggattatgacaaatccatgtgcat

SEQ ID NO: 93789 - DNA, 50 bp, homo sapien
ttacagattattcaaaaggtttaaartattggataacatttcccctctac

SEQ ID NO: 93790 - DNA, 50 bp, homo sapien
ctatatgaaaattcagtactgtattsaacacccttccttgtcagtgtctg

SEQ ID NO: 93791 - DNA, 50 bp, homo sapien
aaccgcaacagacagtgtgatagtcygaccaaggtattatgacctcttgg

SEQ ID NO: 93792 - DNA, 50 bp, homo sapien
ccagcagacacaaatgacttctctgmaaatatccaagggattaaaatgga

SEQ ID NO: 93793 - DNA, 50 bp, homo sapien
ggggatttcagaatctttataccagragctctgaaactctatcattatgt

SEQ ID NO: 93794 - DNA, 50 bp, homo sapien
cagaaaccttacatgccagaagagartaagggtctacattcagcatcctt

SEQ ID NO: 93795 - DNA, 50 bp, homo sapien
cacctctctatccctaatatctggaraattacctagtatatagtaaatgc

SEQ ID NO: 93796 - DNA, 50 bp, homo sapien
gatgtctgaaagtcttagcattcaayagaggtaggcctaattattttcat

SEQ ID NO: 93797 - DNA, 50 bp, homo sapien
taaaatctccaatgatttccattgcrtttagagaacatccaaatccttac

SEQ ID NO: 93798 - DNA, 50 bp, homo sapien
tataatacttgagactctcagaactrgtttattcaattatttattgtctg

SEQ ID NO: 93799 - DNA, 50 bp, homo sapien
tgccatgtagcagcttctctaacttmttttgttaatagaggcctcctgaa

SEQ ID NO: 93800 - DNA, 50 bp, homo sapien
atacagtttcaattaactcattcaamtaactcattcaattatcacacaac

SEQ ID NO: 93801 - DNA, 50 bp, homo sapien
attacagtctaatttcttctagggcrcttttgccacatatttgaaccaaa

SEQ ID NO: 93802 - DNA, 50 bp, homo sapien
cttggaatttttattctccctttaakctatccaatcgcatcaacttttaa

SEQ ID NO: 93803 - DNA, 50 bp, homo sapien
aagacggtgtcttcatgtagaaaacrgggcactaaattataattttacag

SEQ ID NO: 93804 - DNA, 50 bp, homo sapien
ggtgagcctccaaccactgaaattaycatcttgctgtagttatgataaat

SEQ ID NO: 93805 - DNA, 50 bp, homo sapien
acttaacaattatactcgctgaaacygtagaaaatagatgataatttaaa

SEQ ID NO: 93806 - DNA, 50 bp, homo sapien
gttatccttctggaactcatttgcckctccgttaaataagaggggtggat

SEQ ID NO: 93807 - DNA, 50 bp, homo sapien
aactcagctcagatatcacattgtcmattcctttattcattcatttaata

SEQ ID NO: 93808 - DNA, 50 bp, homo sapien
taactattccctttatagtttccaargattttgagggtaaaatccatacc

SEQ ID NO: 93809 - DNA, 50 bp, homo sapien
gtttaaatatggttaaattggtagcracagttaattatacaagcaaataa

SEQ ID NO: 93810 - DNA, 50 bp, homo sapien
tcagaagctttctgagaacaaacacmagtacaactaattgctaccaagaa

SEQ ID NO: 93811 - DNA, 50 bp, homo sapien
cttctgtgctaaagcattcaagccaygcgatcgtttgttcacattcactt

SEQ ID NO: 93812 - DNA, 50 bp, homo sapien
tgatgtcctggggttaaagcagagcsacgataactaattattggttgact

SEQ ID NO: 93813 - DNA, 50 bp, homo sapien
gtggcctagactgctggtctactacygcattactaaatttccctcactgc

SEQ ID NO: 93814 - DNA, 50 bp, homo sapien
agatgcattgactgctctctattagraagctattggtgaaattattttgc

SEQ ID NO: 93815 - DNA, 50 bp, homo sapien
gatcctgataaaggatttaccagaarattaagcacaggaagagagggtta

SEQ ID NO: 93816 - DNA, 50 bp, homo sapien
tattctttagctcccgccttcatccyacattagttgagcattggcaattg

SEQ ID NO: 93817 - DNA, 50 bp, homo sapien
ccatatgcaataaaggaacagggaawtaatgagtcccatggaaggagctg

SEQ ID NO: 93818 - DNA, 50 bp, homo sapien
gtccttcagcattaattctattggaragtaagaatggaaaataaattgtc

SEQ ID NO: 93819 - DNA, 50 bp, homo sapien
agtcatataatccaatgaaataaaawtgttcatgttgtaagtctatgttt

SEQ ID NO: 93820 - DNA, 50 bp, homo sapien
tactaaatattttgtgtacaggttcwactgagtgaaataaaaatatatgg

SEQ ID NO: 93821 - DNA, 50 bp, homo sapien
aagtgatactaaaaaggtcactgtayaataaataggaatatgtatatcca

SEQ ID NO: 93822 - DNA, 50 bp, homo sapien
gtgcttttcattccattaaattttaygaagcgtatgcccctacactgttt

SEQ ID NO: 93823 - DNA, 50 bp, homo sapien
gtttatcacagccgattagggcagcrataccaattggaacaaacaaacag

SEQ ID NO: 93824 - DNA, 50 bp, homo sapien
agacgagggacagttgctagaaagayacacctggaagttctatttaacta

SEQ ID NO: 93825 - DNA, 50 bp, homo sapien
tggatctcttgaatgtaggatgtaayaataaatgtcagcaggttttaaaa

SEQ ID NO: 93826 - DNA, 50 bp, homo sapien
gttaaccgtggaagagtgaagaagargagaagatgcccaagccaggtgag

SEQ ID NO: 93827 - DNA, 50 bp, homo sapien
gttttactgttttacattcatcatayaaaagaatcatacagtattggtgt

SEQ ID NO: 93828 - DNA, 50 bp, homo sapien
taggtcagccagataagttagctacycaatgacaaggttaagactttgca

SEQ ID NO: 93829 - DNA, 50 bp, homo sapien
ttaatatcattttgtgttggctttasatctcaaaatatgacaagtattta

SEQ ID NO: 93830 - DNA, 50 bp, homo sapien
caaaggtagaattagtatctaaccartctaactatgtgaacacagaaatt

SEQ ID NO: 93831 - DNA, 50 bp, homo sapien
taggtgttcaaggtgacataagtaayaagtggtgaaagttaagtgttcaa

SEQ ID NO: 93832 - DNA, 50 bp, homo sapien
taagggaaaacaaaacaattaaatartaagcacaagggacagagaatgag

SEQ ID NO: 93833 - DNA, 50 bp, homo sapien
gacagagaatgagtttcaaatatttwaaaaaatctcagcaaaagaaccaa

SEQ ID NO: 93834 - DNA, 50 bp, homo sapien
ttctgatcctgttaatcttttagacygtaatgcatagtttgcttaagttc

SEQ ID NO: 93835 - DNA, 50 bp, homo sapien
aatggaagaaaatatttgtaaactayggatcttactaagggctaatatac

SEQ ID NO: 93836 - DNA, 50 bp, homo sapien
agtcatcagatatagcccatagatgkatgcctgaatagacccggttttca

SEQ ID NO: 93837 - DNA, 50 bp, homo sapien
cttctcccatcttcctaagaatatgsataagagtcaagaagtgcagcagc

SEQ ID NO: 93838 - DNA, 50 bp, homo sapien
tactgcaaagataaaccagtacctasagattgtcctcagcattttcaact

SEQ ID NO: 93839 - DNA, 50 bp, homo sapien
gaaattgacacaattcttccaagctmtttgcaactgtaaacaaggataac

SEQ ID NO: 93840 - DNA, 50 bp, homo sapien
gtcacctctgtgttcttgattgaccsatgtcagataaaaagattgttaaa

SEQ ID NO: 93841 - DNA, 50 bp, homo sapien
atggatgtctttctatatattcagarctgttaaaagcatgtgtctgtttt

SEQ ID NO: 93842 - DNA, 50 bp, homo sapien
ttaggaggcctcacaaagtgctatgractcgtgtgactccctaccttgta

SEQ ID NO: 93843 - DNA, 50 bp, homo sapien
cacaaatttaccccatcagtaactaraaaatatgataatagcaaaaaaga

SEQ ID NO: 93844 - DNA, 50 bp, homo sapien
atcacaatgtgtggggaaagaatccygaatgatgtctagtacagaactcc

SEQ ID NO: 93845 - DNA, 50 bp, homo sapien
tggaaccaactggaaagcagggtacmcgaaaagctagtggtgtcaatggg

SEQ ID NO: 93846 - DNA, 50 bp, homo sapien
catgccaggtgtagagtgaaggctcrataaataggtcttcttaatttttc

SEQ ID NO: 93847 - DNA, 50 bp, homo sapien
tcacccaacgctaagtatcttctgaygcaattatatgagtgttagaaaat

SEQ ID NO: 93848 - DNA, 50 bp, homo sapien
aacttatttacctcctttctccaacygaccttttgcgaatctttgtctcc

SEQ ID NO: 93849 - DNA, 50 bp, homo sapien
aatcagattgattaattacaagaaaygacttattgacagagttttttaaa

SEQ ID NO: 93850 - DNA, 50 bp, homo sapien
attactttcttgctacaacttcaackaataaaagaacaccctgtgtcact

SEQ ID NO: 93851 - DNA, 50 bp, homo sapien
tatcctggggcctttcaatactctamaataatggcccaaatgaatgagaa

SEQ ID NO: 93852 - DNA, 50 bp, homo sapien
tactttctattcaggaggaactatgragagtacaataatgaagaagttat

SEQ ID NO: 93853 - DNA, 50 bp, homo sapien
ggtttccctctcctcatacattaaaytaaagagacagctgtaagcactat

SEQ ID NO: 93854 - DNA, 50 bp, homo sapien
aaataggatacattcagacagggtargagtataaagaaaaagaaatggaa

SEQ ID NO: 93855 - DNA, 50 bp, homo sapien
aaaatggtaagctaagcactacacargctattcaggttttgacttccctt

SEQ ID NO: 93856 - DNA, 50 bp, homo sapien
ctgctcaaaattgtgcttctttggtrttatcagagctttaaaatgagtgt

SEQ ID NO: 93857 - DNA, 50 bp, homo sapien
acagagacaagaaaggtagcgttcamcaacactttgcagaaaaaaataca

SEQ ID NO: 93858 - DNA, 50 bp, homo sapien
gatggaaaattaaaccgggtaatctrcttctaagccttaagaatattccc

SEQ ID NO: 93859 - DNA, 50 bp, homo sapien
tttagctagtaaatagtgtttcagaraggatgtgacagagtttattttcc

SEQ ID NO: 93860 - DNA, 50 bp, homo sapien
caaccacaaatattaaatacgtacckcctagagttgaatgaataagggca

SEQ ID NO: 93861 - DNA, 50 bp, homo sapien
ctcttgttgggtttggtctacattasccttggtctacattaactctgcat

SEQ ID NO: 93862 - DNA, 50 bp, homo sapien
ttagagttatattaaatatagtaacrggagatttgttccaaaggaaatgt

SEQ ID NO: 93863 - DNA, 50 bp, homo sapien
gggtataaggtaatgtttgtttatgyatgagactgaatgagggtgtgtgt

SEQ ID NO: 93864 - DNA, 50 bp, homo sapien
aatgatcacatctggctaaaccaaaycttcctgtaagcacatgttaccct

SEQ ID NO: 93865 - DNA, 50 bp, homo sapien
ttaaattaccaaccaacatctaagargtccaaactcctctctcccttcaa

SEQ ID NO: 93866 - DNA, 50 bp, homo sapien
atatgtaaatcacacgtcttatcaayaggcgtttggttgaactaattact

SEQ ID NO: 93867 - DNA, 50 bp, homo sapien
accattatttgccaagagagtgttawaaacatagtgacctttcacatgct

SEQ ID NO: 93868 - DNA, 50 bp, homo sapien
aattatgggaataaaacctcatagaycaagagcagggaatgtgccagtaa

SEQ ID NO: 93869 - DNA, 50 bp, homo sapien
aattcttgcctcaaaggcttacctgrctctttgaaggcatatagttatat

SEQ ID NO: 93870 - DNA, 50 bp, homo sapien
gaatgcttgaggccatgttatgtacscagttataggtcagataaaactag

SEQ ID NO: 93871 - DNA, 50 bp, homo sapien
gcctggccaacgtggcaaaagctcamctctactaaaaatacaaaaaatag

SEQ ID NO: 93872 - DNA, 50 bp, homo sapien
gtaaccatgtcagacaaattcgctasagttcttaaagagaattaaataaa

SEQ ID NO: 93873 - DNA, 50 bp, homo sapien
aggacagtatgttgtctataaaatayggtacatggagtggatggacaaaa

SEQ ID NO: 93874 - DNA, 50 bp, homo sapien
cagctcacagaaactcaagacttaasagacaggtatttttaaatgaataa

SEQ ID NO: 93875 - DNA, 50 bp, homo sapien
aatgcccacctccacctgcacattgmatcctggaattaaccacaatacag

SEQ ID NO: 93876 - DNA, 50 bp, homo sapien
taatctccatcatagcagtggtcatytcttggttccatatttcttacagt

SEQ ID NO: 93877 - DNA, 50 bp, homo sapien
agatacaggttccagaaagatttccygagagagaaaaatagaactaatat

SEQ ID NO: 93878 - DNA, 50 bp, homo sapien
gagacagatccgactttctttccacyaagagaggtaccagggggtgggga

SEQ ID NO: 93879 - DNA, 50 bp, homo sapien
aaactaaggaaaatgaagtattaaaytctgagagacaaggtacaggaaag

SEQ ID NO: 93880 - DNA, 50 bp, homo sapien
ttatgtcaaaagacaggatgataagwataaaaaaaaaccagaccatcaaa

SEQ ID NO: 93881 - DNA, 50 bp, homo sapien
gttaaatagcaatttgaaatactcargaatgctttaagaacttgttataa

SEQ ID NO: 93882 - DNA, 50 bp, homo sapien
cagactgcttccactcccttctcccraggactgagctctgtcatcaactc

SEQ ID NO: 93883 - DNA, 50 bp, homo sapien
aggatggtagttgaataaataggtcmcagtctactactacttaggcacat

SEQ ID NO: 93884 - DNA, 50 bp, homo sapien
ctaaaatgcaaatggagtttaagcaragaaaaagcattgacttataaaat

SEQ ID NO: 93885 - DNA, 50 bp, homo sapien
tccctgaagccaatgactatcaaaamctctatggatgtatatgtgtgcaa

SEQ ID NO: 93886 - DNA, 50 bp, homo sapien
agattagtaaatacaaccagcataaragtcagctttggagtgtagacttt

SEQ ID NO: 93887 - DNA, 50 bp, homo sapien
tgctcaataactgctgaaagaatatwaggaaatacctgtgcatcttctcc

SEQ ID NO: 93888 - DNA, 50 bp, homo sapien
acaagattttcattcttcttctgaartagttttttctgcatccaacagta

SEQ ID NO: 93889 - DNA, 50 bp, homo sapien
tttgaaaactcaccattatgttacasagttcaaagaacaaaccccaaatt

SEQ ID NO: 93890 - DNA, 50 bp, homo sapien
taacgaatcgtcatctagtatgggaygtttacagtaaagtggtggctgct

SEQ ID NO: 93891 - DNA, 50 bp, homo sapien
aagctcagaaaagttaagtaattcgycaaagcagcgcagatagtgtaagt

SEQ ID NO: 93892 - DNA, 50 bp, homo sapien
cagagcagatctagcatacggataayaggagtcactgaagaaggaaacca

SEQ ID NO: 93893 - DNA, 50 bp, homo sapien
gaacattttcccagccatccgataayccagatcatatttaaacatcttca

SEQ ID NO: 93894 - DNA, 50 bp, homo sapien
ttccctatccttctatcccatacaaytaaagttcaccactgttgttataa

SEQ ID NO: 93895 - DNA, 50 bp, homo sapien
cttattaacttgccaaatatgctcaytcactacttttttacccaaagctt

SEQ ID NO: 93896 - DNA, 50 bp, homo sapien
tacatctatagatttggagcacaaakgtcaaaaataaaaagctttgaaag

SEQ ID NO: 93897 - DNA, 50 bp, homo sapien
taaagagacagctaatcaatgacaaytatattccccacggtccaagaata

SEQ ID NO: 93898 - DNA, 50 bp, homo sapien
ctagacactatgtaatttgaccctgraatacttaaacaaaaattatagtt

SEQ ID NO: 93899 - DNA, 50 bp, homo sapien
ttagtttatgtacttagctctcttcrctaccatcttttaagttcacgaca

SEQ ID NO: 93900 - DNA, 50 bp, homo sapien
gcttgcatctaaaggttatttattascacattctttagtactggaaaatt

SEQ ID NO: 93901 - DNA, 50 bp, homo sapien
ctatggcatgccaaagacaagactaygcagccagttaaaactataatttt

SEQ ID NO: 93902 - DNA, 50 bp, homo sapien
ccaacctaagaaatacagaaatcagratatgtttaagaatagaaaaagaa

SEQ ID NO: 93903 - DNA, 50 bp, homo sapien
caggatgacacaatgagactctggawaaaactgtctgaagccagcccata

SEQ ID NO: 93904 - DNA, 50 bp, homo sapien
aagaaacagtccacccagtaaaacaygaagctctgttggcagggacagat

SEQ ID NO: 93905 - DNA, 50 bp, homo sapien
acactgatgatgactacaacatttascaaatcccagactctggcatggat

SEQ ID NO: 93906 - DNA, 50 bp, homo sapien
tcaatgagccacagagagcaacctaytagacctatcggacctttctagat

SEQ ID NO: 93907 - DNA, 50 bp, homo sapien
ctagctcaccgtgattcagaagagasaaagggaacttggtttctgaaaaa

SEQ ID NO: 93908 - DNA, 50 bp, homo sapien
gttttaggaataccattctgacagcrgcataaagagtagattacaatcag

SEQ ID NO: 93909 - DNA, 50 bp, homo sapien
ttggaactgattttctttaataatarcttcacaagagaaggacacttaac

SEQ ID NO: 93910 - DNA, 50 bp, homo sapien
aaaaggatggtggtataaaaatgaamaaaggcaagttaagagaaagaggt

SEQ ID NO: 93911 - DNA, 50 bp, homo sapien
ttcataactaaatctattagaagtaygtagtgaaataaaatggtaataat

SEQ ID NO: 93912 - DNA, 50 bp, homo sapien
ttttcttagtgtcctccttgtacaayagtagagagatggtgaaaaatttg

SEQ ID NO: 93913 - DNA, 50 bp, homo sapien
atttaaatgaatatgaatttattgcmacactgtgagtttcccctctatat

SEQ ID NO: 93914 - DNA, 50 bp, homo sapien
tgctggcagtacagatggaggtagayagttaataaagacatttaagagct

SEQ ID NO: 93915 - DNA, 50 bp, homo sapien
atgaaagcacaaattagaataagaasctacattgtcagaattattatttc

SEQ ID NO: 93916 - DNA, 50 bp, homo sapien
ctataagataccagcatgtacacatmagagttaccatcaagaaataaaac

SEQ ID NO: 93917 - DNA, 50 bp, homo sapien
tcaattaaatcctttaaacaaatgaygttgcaagtaaaactttccccaat

SEQ ID NO: 93918 - DNA, 50 bp, homo sapien
aacactgaatagttacagctgtgcastattttaaacgaatgaccagacac

SEQ ID NO: 93919 - DNA, 50 bp, homo sapien
agaatccctatctttcataattcatwaccagtataacctaaacaagttaa

SEQ ID NO: 93920 - DNA, 50 bp, homo sapien
tactgatatctacttagatatgaaasagtttaggaattttaattcaagat

SEQ ID NO: 93921 - DNA, 50 bp, homo sapien
atagcagaagatgccatgcattttcmagcctccgtattatgttcattctg

SEQ ID NO: 93922 - DNA, 50 bp, homo sapien
taaacaaataaatctacagttaacawcatacttactgatgaatgacaaca

SEQ ID NO: 93923 - DNA, 50 bp, homo sapien
gcacagttttgtgcctcctgggatayagtgtgtcaggttcatcactatgc

SEQ ID NO: 93924 - DNA, 50 bp, homo sapien
gcaggaaaacataagaagcttacagrattcatcaaataatctaattcagc

SEQ ID NO: 93925 - DNA, 50 bp, homo sapien
agaaaggttaatctcaaagtatcaaygtgcttcccaaaatgtattcctat

SEQ ID NO: 93926 - DNA, 50 bp, homo sapien
caaaaacactgccaacgaacctactrttttgacaggtataccttcttaac

SEQ ID NO: 93927 - DNA, 50 bp, homo sapien
aaaggagaaaacacagaggacagaaytggtgtaaaatgtaagaatgggac

SEQ ID NO: 93928 - DNA, 50 bp, homo sapien
agacctcgcattaagtgtaggaacartcataaatatttcaggggttacaa

SEQ ID NO: 93929 - DNA, 50 bp, homo sapien
tctacccaataaatgttaatgcctayggttgtcatctttaattagaatgg

SEQ ID NO: 93930 - DNA, 50 bp, homo sapien
ctgcctaataaatcacccaaaaacayagtgacttaacaacagtcattttt

SEQ ID NO: 93931 - DNA, 50 bp, homo sapien
gatttattaggcagcaatagatagcrgacacaccttaatgcattattctg

SEQ ID NO: 93932 - DNA, 50 bp, homo sapien
ggatatttaggttggtaagcatttasatacagagatacagaagagatttg

SEQ ID NO: 93933 - DNA, 50 bp, homo sapien
tattccattatctagcaaagaatgasaaagaataaatagcctttcactgg

SEQ ID NO: 93934 - DNA, 50 bp, homo sapien
tatattttgattctttattttgtcastagaaggcaactttctagcatttg

SEQ ID NO: 93935 - DNA, 50 bp, homo sapien
tggattgagggggagagttggaaaaytgcttaaaaagctccatcaataat

SEQ ID NO: 93936 - DNA, 50 bp, homo sapien
attataacttaagcattaaatatacmaaacaggtcattttttatagttac

SEQ ID NO: 93937 - DNA, 50 bp, homo sapien
acagctatagataactaatatactayacttctgacctgatataacaaaaa

SEQ ID NO: 93938 - DNA, 50 bp, homo sapien
tgatgctcaaagccactgcttcaaaygtgggtgtttcccagggttcattt

SEQ ID NO: 93939 - DNA, 50 bp, homo sapien
cagcacttcctggatgtaaggtacaytgaagcaaaaagctgagtttatta

SEQ ID NO: 93940 - DNA, 50 bp, homo sapien
caatttctccaagttttccaaaacartaagtagctaatgtaatcttagca

SEQ ID NO: 93941 - DNA, 50 bp, homo sapien
ctctcttttctacataccaaggatamaacagggaagaaaataggaaaact

SEQ ID NO: 93942 - DNA, 50 bp, homo sapien
gtaaattttaggtgcttcttagcacsagaaaaagtaagtaactatatgag

SEQ ID NO: 93943 - DNA, 50 bp, homo sapien
atgcatgattacctgtattattatcyctactttgccattgggaaacaagc

SEQ ID NO: 93944 - DNA, 50 bp, homo sapien
ttctattaggtaaatacataaatcawcataggtgagagacctacacattg

SEQ ID NO: 93945 - DNA, 50 bp, homo sapien
atcagtttaaattatgacaaacctaygagttacttagaaactgcactttt

SEQ ID NO: 93946 - DNA, 50 bp, homo sapien
taaagagaaagatcttaataaccagmcagaaaaaaagagaaacaatcagt

SEQ ID NO: 93947 - DNA, 50 bp, homo sapien
gatttgtaataagatttaagttaacwattccagtcctattcattaccatt

SEQ ID NO: 93948 - DNA, 50 bp, homo sapien
aaccaattcctgagggatgattgtaygtgttatttttccctctggaaatg

SEQ ID NO: 93949 - DNA, 50 bp, homo sapien
aacttttgatttctcaagaatcttgycaaatagtctagttgtcaggacat

SEQ ID NO: 93950 - DNA, 50 bp, homo sapien
cctagaagatagcaatttcactcaartaggttcaacagtgaaacaaatca

SEQ ID NO: 93951 - DNA, 50 bp, homo sapien
ggcccatttggaggcttattccaaaycccttctagtgtgctaaaactata

SEQ ID NO: 93952 - DNA, 50 bp, homo sapien
tatgaagataactttggagctaaggmattaagtgataccaatttctctct

SEQ ID NO: 93953 - DNA, 50 bp, homo sapien
agcagatgtcattcttcccagttacrgaatatctagcctctggctataca

SEQ ID NO: 93954 - DNA, 50 bp, homo sapien
accctgtcatagtgtaagtgactacygattcaaaagatgtcgttatattc

SEQ ID NO: 93955 - DNA, 50 bp, homo sapien
gcatgaatccattttcaccattcatkaagatccttcttttgctacttcac

SEQ ID NO: 93956 - DNA, 50 bp, homo sapien
ttttagcttaatgctttgcatccacyataataaacactggcttttctact

SEQ ID NO: 93957 - DNA, 50 bp, homo sapien
atgtgtaacatgtatttcaagattaygctttttatttctttacatccagc

SEQ ID NO: 93958 - DNA, 50 bp, homo sapien
gggctgtcatccaacaacttattcamcttaagctccttaaaataattttc

SEQ ID NO: 93959 - DNA, 50 bp, homo sapien
ctgaatgaagttacaaaggaaatacrgaacagaaagaatacctgacctaa

SEQ ID NO: 93960 - DNA, 50 bp, homo sapien
gccacaatgtgtaacagataaattcratctcaatcctctctctatgttcc

SEQ ID NO: 93961 - DNA, 50 bp, homo sapien
agtgaaaacactgacttctggtaacyacatattttgttttcatattcaag

SEQ ID NO: 93962 - DNA, 50 bp, homo sapien
gcaaacataattaatgttgttataaktctgcttgcatcacatttcctatt

SEQ ID NO: 93963 - DNA, 50 bp, homo sapien
gaaaagtgtagtcagttccgtagagrataaatggtaacatgcattcaatg

SEQ ID NO: 93964 - DNA, 50 bp, homo sapien
aaactaagtttgtatctctgcttaartaaccaagatgtgttgcatttgaa

SEQ ID NO: 93965 - DNA, 50 bp, homo sapien
gtataagttttaaatgagtactatawgtgcttggaaatgaaaatctgctg

SEQ ID NO: 93966 - DNA, 50 bp, homo sapien
cagaaacatttaaatgactctgggawtattagagaaaagtcaggctaagt

SEQ ID NO: 93967 - DNA, 50 bp, homo sapien
ttaaagtcaaaatgagactatcagcragcgagtaataaaacctgggtctc

SEQ ID NO: 93968 - DNA, 50 bp, homo sapien
ttcttaaacaggaaaggctaaataaycataaccaaacaattctgtggata

SEQ ID NO: 93969 - DNA, 50 bp, homo sapien
aagatacgaaagaatagcataaatcrgagtgacaaacactcggaaatgag

SEQ ID NO: 93970 - DNA, 50 bp, homo sapien
aaaggcaccctgctagccaaatgccratatcatgaatttgcttagagtga

SEQ ID NO: 93971 - DNA, 50 bp, homo sapien
ttaaaaagtccaattcatttgaagaygggttctccctgcacctattcatt

SEQ ID NO: 93972 - DNA, 50 bp, homo sapien
tctcttctgaaagtctaagacaacayaagccagctcacaaactggccgca

SEQ ID NO: 93973 - DNA, 50 bp, homo sapien
ctcaatctcttactgcaggcctgaaycataactgttctcaaatcaaacat

SEQ ID NO: 93974 - DNA, 50 bp, homo sapien
gggaggaagaagtcagttgcaaatcrctcctctgcattatcctctagtta

SEQ ID NO: 93975 - DNA, 50 bp, homo sapien
ctttgagacatagctttaacaagacrccaaagggatatagagaagaggtt

SEQ ID NO: 93976 - DNA, 50 bp, homo sapien
tgctacacgaagaaaggtacctgaarcaccagactgataaatgagaatga

SEQ ID NO: 93977 - DNA, 50 bp, homo sapien
tataaataatagggctgagacgagasgcataaaccaaccatccctgctag

SEQ ID NO: 93978 - DNA, 50 bp, homo sapien
gctttcatcttttgcttactcttcaygtaaggatttggaggtaacattcc

SEQ ID NO: 93979 - DNA, 50 bp, homo sapien
tttgaggcggaagtgaaagctgtaarggttagagcacaaagggctgagag

SEQ ID NO: 93980 - DNA, 50 bp, homo sapien
ctcaggcttattcagcatatctttaycctctcaggagacaggttatatac

SEQ ID NO: 93981 - DNA, 50 bp, homo sapien
atggtcgtcattcttaaacagtagtwaatttgaagactatactttccaat

SEQ ID NO: 93982 - DNA, 50 bp, homo sapien
ctttctgcctccatctgcgacttcargtgtagtgttgtgagggcctaacc

SEQ ID NO: 93983 - DNA, 32 bp, homo sapien
atgctttttactttgamgttccattttcctga

SEQ ID NO: 93984 - DNA, 50 bp, homo sapien
tacttttctgtgatttactggttagrccctcacaacactacacttgaagt

SEQ ID NO: 93985 - DNA, 50 bp, homo sapien
ctgcttataaacagagctggaattaragcaggaaaaatggccaatccttg

SEQ ID NO: 93986 - DNA, 50 bp, homo sapien
atgtatgcaaagagaataattgtacyaagatcgatatatttctagtgagg

SEQ ID NO: 93987 - DNA, 50 bp, homo sapien
aattctgggaaatgattaagcaaatkaaattacatgtacatatgaaacta

SEQ ID NO: 93988 - DNA, 50 bp, homo sapien
cactactcattttatctccagtatcrcaaataatttaagctctgattttt

SEQ ID NO: 93989 - DNA, 50 bp, homo sapien
tttgccacacttttactaaactcacragatcttccctatgcttagccatt

SEQ ID NO: 93990 - DNA, 50 bp, homo sapien
gacttagcaatctaaaaatgccaatraggagatagcaaattaaaactgtt

SEQ ID NO: 93991 - DNA, 50 bp, homo sapien
tcacaaatctattatgaggtttaaaygagtcagtgtatataagattacct

SEQ ID NO: 93992 - DNA, 50 bp, homo sapien
aaaagttcttgacattttcctcataraacaaactctgcagccaaatttct

SEQ ID NO: 93993 - DNA, 50 bp, homo sapien
aggaagaaaatgttctcagtactccygaaattggccttggagctgctgtt

SEQ ID NO: 93994 - DNA, 50 bp, homo sapien
ctagtagttggagatgtctgaagaaytaggacaaaactaattacgattat

SEQ ID NO: 93995 - DNA, 50 bp, homo sapien
gagatttctgatgtgaaaaatgccartaagagcagaaaagagtatttcca

SEQ ID NO: 93996 - DNA, 50 bp, homo sapien
acagtaatcacagaagaattcatcawgagaaaatatacattagtacactg

SEQ ID NO: 93997 - DNA, 50 bp, homo sapien
tgtgagtcacaagatggacttttccygagaggctgtagaacaggggtgag

SEQ ID NO: 93998 - DNA, 50 bp, homo sapien
agccagactgttcaagtgaggctcaraagtgccaaatagcactgctctga

SEQ ID NO: 93999 - DNA, 50 bp, homo sapien
atacctgacagtaaggatatactagracttctgcaatatgggggaatgaa

SEQ ID NO: 94000 - DNA, 50 bp, homo sapien
tctacaataatacacaacgcactagmagtgtttaagagagtatttcatat

SEQ ID NO: 94001 - DNA, 50 bp, homo sapien
atagcaactactggtagttactgccyaaacaccattctatttcttgcctc

SEQ ID NO: 94002 - DNA, 50 bp, homo sapien
tgaataaaggaaaggtcatgtagtasgaaatatgaaaagcaaatgtacat

SEQ ID NO: 94003 - DNA, 50 bp, homo sapien
tctcaatgaaatgagagtaaggataraaatgttagtactaaaaggcaaaa

SEQ ID NO: 94004 - DNA, 50 bp, homo sapien
aattcaccttagaatgcttccattcractgtagtgaccatgaatttagaa

SEQ ID NO: 94005 - DNA, 50 bp, homo sapien
tattacagtaacatttcttccctggrtttcaatttggtaggcctaattac

SEQ ID NO: 94006 - DNA, 50 bp, homo sapien
cagcttttgaaaatctggatatattraacagggtaagatctggaaaatca

SEQ ID NO: 94007 - DNA, 50 bp, homo sapien
gccctggtgtgtaagatctttctatracctcacatagatggttaaaaagt

SEQ ID NO: 94008 - DNA, 50 bp, homo sapien
tgaattttcataaatgtcaatttccrtttttctactatgcattccattgg

SEQ ID NO: 94009 - DNA, 50 bp, homo sapien
ggaaaaagggactgccaaaagccacrgtcaggtggatagaggttaaagtc

SEQ ID NO: 94010 - DNA, 50 bp, homo sapien
cctgtccaagtaactcacaactttckatctccagggtgcagttctgctca

SEQ ID NO: 94011 - DNA, 50 bp, homo sapien
gcaactgttaaattaataaacaacayaagtaagtagtcaagtaaaacagt

SEQ ID NO: 94012 - DNA, 50 bp, homo sapien
gtcttttcaaaactaggtgtttaaawaaagagacatatatgatattgctg

SEQ ID NO: 94013 - DNA, 50 bp, homo sapien
agctccccaatgctgtcaatccctarcatgtctaatagccatcaaagctg

SEQ ID NO: 94014 - DNA, 50 bp, homo sapien
gaatgataatacaagtagaacagaamgcattccatccctgaactactaaa

SEQ ID NO: 94015 - DNA, 50 bp, homo sapien
tgttcatttcctgtaattttatcacygacggctagctttctatcatattt

SEQ ID NO: 94016 - DNA, 50 bp, homo sapien
cagaacgcattccatccctgaactaytaaaattgttgagatgaataaata

SEQ ID NO: 94017 - DNA, 50 bp, homo sapien
gttctacccttttttgcaggtatggyaatgcaaatagtccattattggct

SEQ ID NO: 94018 - DNA, 50 bp, homo sapien
ttcaacttagaatttcatgagtgaayattatgtgcagctacacactgcaa

SEQ ID NO: 94019 - DNA, 50 bp, homo sapien
aggggaagcacaaatcctgtgaacaytgtgagatataatgtatgttgtaa

SEQ ID NO: 94020 - DNA, 50 bp, homo sapien
atggtacaggtaagaccatggttatsaacagcccagtgcatttttctcta

SEQ ID NO: 94021 - DNA, 50 bp, homo sapien
aagagataagctatctaggataagargagaacttgctggaaatagccaga

SEQ ID NO: 94022 - DNA, 50 bp, homo sapien
gattcataaccccaagattcagagaygataggcctcaacatgtagaatcc

SEQ ID NO: 94023 - DNA, 50 bp, homo sapien
ttgatcttattaatgttattgtaagkataatcccaaacaggattctgcaa

SEQ ID NO: 94024 - DNA, 50 bp, homo sapien
ttgaccttgaactacctacatactcwgaggaggatctaaaagagcactcg

SEQ ID NO: 94025 - DNA, 50 bp, homo sapien
tttttctaggcgaaataagatggcartaatgagaaaaattgagataggaa

SEQ ID NO: 94026 - DNA, 50 bp, homo sapien
tcttagaaaccatatattagctgtargaagagctatcatctgaacattat

SEQ ID NO: 94027 - DNA, 50 bp, homo sapien
tgtcaaaacgatgactgggggcgtgwactgcaggtcttggcagtgccacg

SEQ ID NO: 94028 - DNA, 50 bp, homo sapien
ttactttggctactgaagcatgaaaygaaaaaacaaataagttttgtaaa

SEQ ID NO: 94029 - DNA, 50 bp, homo sapien
ttctgagcacattacaagccattgargaaagctagctagtgctaacctta

SEQ ID NO: 94030 - DNA, 50 bp, homo sapien
ggctggcatacagggtgaaataaaartgccactccactcataccaggcaa

SEQ ID NO: 94031 - DNA, 32 bp, homo sapien
tgttcatctgttcaaascattttcctaattaa

SEQ ID NO: 94032 - DNA, 50 bp, homo sapien
aaaacttcaaaactctgataaacaakaactaaataacatgttcatggata

SEQ ID NO: 94033 - DNA, 50 bp, homo sapien
agttttgtgtaaattactgaaggaayggaatttgatcaggattagtggca

SEQ ID NO: 94034 - DNA, 50 bp, homo sapien
gaatgcttctattaactgggagaaaytaatggacagaatagtaaggcatt

SEQ ID NO: 94035 - DNA, 50 bp, homo sapien
atatttaaaatatgatacttaatctkaatccacaatacattttttgtatt

SEQ ID NO: 94036 - DNA, 50 bp, homo sapien
gtatgatctccaacccaatgattcarctttctcacttgttccctaacaaa

SEQ ID NO: 94037 - DNA, 50 bp, homo sapien
ctagccatcacaagaaaacctgaagwcttgaagattcacttacctcccca

SEQ ID NO: 94038 - DNA, 50 bp, homo sapien
aaaagcattaactactggggaatccyttacatttcagtgacaggttgtta

SEQ ID NO: 94039 - DNA, 50 bp, homo sapien
attttactttatctgcttctatcacracctgcagagggtgcaagaaggtt

SEQ ID NO: 94040 - DNA, 50 bp, homo sapien
attgatgttttaactcataatagctragcaaatgatgtccaagcaaagag

SEQ ID NO: 94041 - DNA, 50 bp, homo sapien
tttactattgccactgtatgtgtgargtatttttctactggtttcaactg

SEQ ID NO: 94042 - DNA, 50 bp, homo sapien
tcatggagtctaagtccacatattcyaagtcacaaattagtgatgttacc

SEQ ID NO: 94043 - DNA, 50 bp, homo sapien
gcaagggaattgctgcttcaaacgckaagtattatgtctgtaaattagaa

SEQ ID NO: 94044 - DNA, 50 bp, homo sapien
ctctcgtgtcagcgtcctacctgcasaaggttaaggcagcattaacaggt

SEQ ID NO: 94045 - DNA, 50 bp, homo sapien
ggtaacatgcttaattggcctctcaktataagttgcaccctcagatattg

SEQ ID NO: 94046 - DNA, 50 bp, homo sapien
ttgcttgagtctgagcctattaataygaatgagagttagaaataaaagag

SEQ ID NO: 94047 - DNA, 50 bp, homo sapien
gtaattaatattaaatgctctatacwacatttaattatgataaaaagtgt

SEQ ID NO: 94048 - DNA, 50 bp, homo sapien
cacaagtaattgagactagaaaaaawtaatagcccaactaacttaaattc

SEQ ID NO: 94049 - DNA, 50 bp, homo sapien
ataaaaaatgttgctatgggattatwaaaatagactggagagatttcagg

SEQ ID NO: 94050 - DNA, 50 bp, homo sapien
aattttcctttacaaatgtgcagcaytaattttacttttaatgtcttgca

SEQ ID NO: 94051 - DNA, 50 bp, homo sapien
aaaaagaaaagctaattcaaaaccayggatgtaattactaagattaaaag

SEQ ID NO: 94052 - DNA, 50 bp, homo sapien
tgactttccattgattttctgaaaamccatattcttcacttaatcaacac

SEQ ID NO: 94053 - DNA, 50 bp, homo sapien
ctccacagtaagtgagtttattttcyacggtggctgagtttggtgctatt

SEQ ID NO: 94054 - DNA, 50 bp, homo sapien
caagaggatagaactaggaccagaawgagagataagtgaacacaacggac

SEQ ID NO: 94055 - DNA, 50 bp, homo sapien
aagtttcatctagaaacaagcataawgaccaagtaacatgaccagtgggc

SEQ ID NO: 94056 - DNA, 50 bp, homo sapien
aggaatcttgcctagaggtgtcaaayattaataactttaagcactgaaaa

SEQ ID NO: 94057 - DNA, 50 bp, homo sapien
gatcttttgagcacaggatgctttaygcttcagcttattctcactctgca

SEQ ID NO: 94058 - DNA, 50 bp, homo sapien
cttcctctgtgaccatggagtatacragagtcaaaagttggtatcaggag

SEQ ID NO: 94059 - DNA, 50 bp, homo sapien
ccatgtaattagaaggaagactaaargcttgcaggaattccacagagcca

SEQ ID NO: 94060 - DNA, 50 bp, homo sapien
tatttcactgaagccaaacatacttstaggcattttattgaagaatttgg

SEQ ID NO: 94061 - DNA, 50 bp, homo sapien
aaattacatctttatatattttaggwccatcaacatattttcataaatat

SEQ ID NO: 94062 - DNA, 50 bp, homo sapien
gattttgtacccatgccttctgagayaaagtgttagaaaatagggtgccc

SEQ ID NO: 94063 - DNA, 50 bp, homo sapien
catttattgattaatttttgcctcaygtagttttagtctcaccatataag

SEQ ID NO: 94064 - DNA, 50 bp, homo sapien
tactaaaaatcattgaatacacttargtagctgaattatatggtatgtga

SEQ ID NO: 94065 - DNA, 50 bp, homo sapien
cactcctagatggattaacataaaasctgacactgaaggcctattgactt

SEQ ID NO: 94066 - DNA, 50 bp, homo sapien
aattatggctataaatacagtattaratgttctatgatcagaactctaga

SEQ ID NO: 94067 - DNA, 50 bp, homo sapien
ataaaatgttctaaaatttgttataygcacaattctatgaatatactaaa

SEQ ID NO: 94068 - DNA, 50 bp, homo sapien
taagttgtttaaattgaagaagaaakaatgttgaatacctcaaatatctt

SEQ ID NO: 94069 - DNA, 50 bp, homo sapien
attcaatgaaagttcacactatgacygtaaaccaaacttttgacctacat

SEQ ID NO: 94070 - DNA, 50 bp, homo sapien
aagggattatgaagaaaatgccttgraaaagttgaaagtaatctatttat

SEQ ID NO: 94071 - DNA, 50 bp, homo sapien
ttctcaagatcctcagataaattgcrgaaacattcatggataagaagcac

SEQ ID NO: 94072 - DNA, 50 bp, homo sapien
ttgtattcaaactcagttgggcaagwacaataattcaagtttcctcattg

SEQ ID NO: 94073 - DNA, 50 bp, homo sapien
ctaatgaacaaagcctaacttaaacmatcaaaatatagaactggagactg

SEQ ID NO: 94074 - DNA, 50 bp, homo sapien
gaagtatctggagttgtgattgagayaaatggtgtagaaagagccctgaa

SEQ ID NO: 94075 - DNA, 50 bp, homo sapien
tttaggcacagagctgagggtttaaygactgttctctcatttagtcatca

SEQ ID NO: 94076 - DNA, 50 bp, homo sapien
tgaatgatgataggttttaccatgakgtattaatgtctgaatatggtgtt

SEQ ID NO: 94077 - DNA, 50 bp, homo sapien
attaatactagaaatctaggcataaraataatttcacatgttaatattta

SEQ ID NO: 94078 - DNA, 50 bp, homo sapien
tttgttactatttctaatgctactaycataatattacaatgctggaatgc

SEQ ID NO: 94079 - DNA, 50 bp, homo sapien
gactatgaaagtaagcataaagttgmatgttgatgtccatgagtgaacaa

SEQ ID NO: 94080 - DNA, 50 bp, homo sapien
agtcaagaaagaaaagaaagatgtaygttgctatcaagttttaattgaag

SEQ ID NO: 94081 - DNA, 50 bp, homo sapien
gctaggtagtaagcccaaattgaagrcatgtggcccttgtattccaaggc

SEQ ID NO: 94082 - DNA, 50 bp, homo sapien
cactgtcctcttcattcaagtggcckcgggtctataaactgacttacagt

SEQ ID NO: 94083 - DNA, 50 bp, homo sapien
caaaaaattgatggaaatataggaaracaactaaggtctacttggtgtat

SEQ ID NO: 94084 - DNA, 50 bp, homo sapien
actttcactgcttaatcaccataaartcctatgtggccacacatggttag

SEQ ID NO: 94085 - DNA, 50 bp, homo sapien
tgtagctggtttgtatgcagcattcwctaagaagttgaaatccttgaggc

SEQ ID NO: 94086 - DNA, 50 bp, homo sapien
cttttcaaactccctgttttacctcrccgggcctcaaggatttcaacttc

SEQ ID NO: 94087 - DNA, 50 bp, homo sapien
acttgagcttaactagatttccataygatagacaacacagcagtgacaga

SEQ ID NO: 94088 - DNA, 50 bp, homo sapien
tttgtgggaatttaacttgtgttaawtccgagatgtttaggagcaagatt

SEQ ID NO: 94089 - DNA, 50 bp, homo sapien
ttttctttgttcacgtagttttacasaatgaacgtaacattatgttttac

SEQ ID NO: 94090 - DNA, 50 bp, homo sapien
atgattttaatgtcagagatcttgtrtatttggacaatggggatggaaat

SEQ ID NO: 94091 - DNA, 50 bp, homo sapien
ataataggctcattggtcaatatgcrtagcaagtcaacattcagagacac

SEQ ID NO: 94092 - DNA, 50 bp, homo sapien
acatgcactattgtaaccataatagkctcattggtcaatatgcatagcaa

SEQ ID NO: 94093 - DNA, 50 bp, homo sapien
gctaaaaaagtgagaggtttggaaastttaagagcataatgggtagaagt

SEQ ID NO: 94094 - DNA, 50 bp, homo sapien
cctctccaaaatgcacttgagtgaayggaaaaacaacaccttgactgttt

SEQ ID NO: 94095 - DNA, 50 bp, homo sapien
ttaatagctcctaacatgatgataaratggtttagtggtcaaatgatctg

SEQ ID NO: 94096 - DNA, 50 bp, homo sapien
taaaaatttgaaaaaatattgaagaygaggctttatcaaatgaagagtca

SEQ ID NO: 94097 - DNA, 50 bp, homo sapien
aatatctggaagaacacgtcaggaaytgctaaaaatggccacttttgggt

SEQ ID NO: 94098 - DNA, 50 bp, homo sapien
ctagccctttacgatatttgttgaastatttatccttaaagtacatttat

SEQ ID NO: 94099 - DNA, 50 bp, homo sapien
taagagggcttgagaaaaatctatamcttttatgccattctgccaagtaa

SEQ ID NO: 94100 - DNA, 50 bp, homo sapien
aaaactcactctccagaatgatgaartaataaagaatggtatttgaagcc

SEQ ID NO: 94101 - DNA, 50 bp, homo sapien
caacaaattacatgaaaatgttgacmgatggcactgatattattacataa

SEQ ID NO: 94102 - DNA, 50 bp, homo sapien
gatccattattccttatcctaaacarcatcttcttttctattctttgcat

SEQ ID NO: 94103 - DNA, 50 bp, homo sapien
agaacattgatctatagattctcaaraacatgctattgctagatggtgtt

SEQ ID NO: 94104 - DNA, 50 bp, homo sapien
cttagcgtgattttcttaatttctcygactttatcagctttccatctctt

SEQ ID NO: 94105 - DNA, 50 bp, homo sapien
accacaaacatattttctgtaaacargataattctccctcaaaggaaact

SEQ ID NO: 94106 - DNA, 50 bp, homo sapien
tagttgtttgaactgaatgaaaaacrgtagaagagaatttaccagtccca

SEQ ID NO: 94107 - DNA, 50 bp, homo sapien
tgctggagattttctttctacaaccmatttcatttctgaggaaagagatg

SEQ ID NO: 94108 - DNA, 50 bp, homo sapien
ctgaatttgtcaacgtggcaaattargctatcacagtttctgtctcctcc

SEQ ID NO: 94109 - DNA, 50 bp, homo sapien
ttaaaattataataattgggttacayattaattcatgttgtattattaaa

SEQ ID NO: 94110 - DNA, 50 bp, homo sapien
ggtcaagcatagctaattttccaaarcgctatagtaggaacagttatttt

SEQ ID NO: 94111 - DNA, 50 bp, homo sapien
aaaattgaaactggactcctttcttrttataccacatgcaaaagtcaact

SEQ ID NO: 94112 - DNA, 50 bp, homo sapien
gaacagtgttttgtaattctcatagyagagctctttgactcccaggttag

SEQ ID NO: 94113 - DNA, 50 bp, homo sapien
ttctgttctgcattttacttttgccmaatccaagttgtacttctttatga

SEQ ID NO: 94114 - DNA, 50 bp, homo sapien
acaaggggactttaaccaatacaccyaatctgataatgtccgaattttaa

SEQ ID NO: 94115 - DNA, 50 bp, homo sapien
cactttagaaaatagcaccatttaayaatttcacaaaaggcagcaggtgc

SEQ ID NO: 94116 - DNA, 50 bp, homo sapien
gtttcttttctttctacagagaatcyacctcataatatacaggccaaaca

SEQ ID NO: 94117 - DNA, 50 bp, homo sapien
tttagattaaattgtgctcaaacatrttcataaagcagaacaaacagctg

SEQ ID NO: 94118 - DNA, 50 bp, homo sapien
aaagtgctatgtaatgtgataaagartataacatcaggagttttgtttca

SEQ ID NO: 94119 - DNA, 50 bp, homo sapien
taccctctccacaattggaaccccaratcggcaaacatagcaaaggacca

SEQ ID NO: 94120 - DNA, 50 bp, homo sapien
gatatgaagctcacttatttttaccyagaacaagcataaactgcacttgc

SEQ ID NO: 94121 - DNA, 50 bp, homo sapien
tgatataacacagaattagcacttasagagaaaaggggtgacttttagtg

SEQ ID NO: 94122 - DNA, 50 bp, homo sapien
atggcaaatcctagcatttttcagargtcaatttagatgttactgctttt

SEQ ID NO: 94123 - DNA, 50 bp, homo sapien
tgcactcctctttggcccaacaaagkttcagaaatgtcatccaagaccca

SEQ ID NO: 94124 - DNA, 50 bp, homo sapien
aaaaaaaaattctaggagcttgtctmaaataaccaaagctgaccttcaag

SEQ ID NO: 94125 - DNA, 50 bp, homo sapien
gaatgggaaattaaacaatgagcgaratgccataataagggagtacagtc

SEQ ID NO: 94126 - DNA, 50 bp, homo sapien
tgaccttacgactttcaaaaacatarggttgtcactggtcatgtagcatt

SEQ ID NO: 94127 - DNA, 50 bp, homo sapien
caaaagtaaagtagctaatagcaaayggagttaatttccttatctatact

SEQ ID NO: 94128 - DNA, 50 bp, homo sapien
aaggtatattactagtaagtgaacartggagttaaaattatgtcctcaat

SEQ ID NO: 94129 - DNA, 50 bp, homo sapien
caatgactccagtcagaactcttaartaatgattgtaccctaattgaaat

SEQ ID NO: 94130 - DNA, 50 bp, homo sapien
gtcttagggatgtttatcttctgaayctgatgtttagtttttatagctat

SEQ ID NO: 94131 - DNA, 50 bp, homo sapien
gggggatggccttgtatgagctgacratagaaattacatgataccacttt

SEQ ID NO: 94132 - DNA, 50 bp, homo sapien
acaggtgaagagttaattgagtgtayataattaactgtagaactgttgga

SEQ ID NO: 94133 - DNA, 50 bp, homo sapien
tacatatcagatgataaggaaagaayagtagattattggaggtccctgct

SEQ ID NO: 94134 - DNA, 50 bp, homo sapien
atggagccatggaacatgcattgtartaagtaccatccacagtgtctggt

SEQ ID NO: 94135 - DNA, 50 bp, homo sapien
ggcagattagatatgatataattcargatacagattaattaagaaacata

SEQ ID NO: 94136 - DNA, 50 bp, homo sapien
atgctcagtgctttaaaaattcaaaygtctcagaaccaggtctgatggtc

SEQ ID NO: 94137 - DNA, 50 bp, homo sapien
aaagcaatattctacaaggtaccaargattgatgagttttctaaccaata

SEQ ID NO: 94138 - DNA, 50 bp, homo sapien
atattcgtgatatttcccagaaagcmgcatagtgggtaaaatcttccatt

SEQ ID NO: 94139 - DNA, 50 bp, homo sapien
gctttttaagtcacaggaagaaaacyagacttagagaaggacaatccttt

SEQ ID NO: 94140 - DNA, 50 bp, homo sapien
ccagaacgagaagcaaaacagtagcrataaatttttcagaagtaaggaca

SEQ ID NO: 94141 - DNA, 50 bp, homo sapien
caaagtggaaaagattacctgcaacmatacagttcttctatatcagttaa

SEQ ID NO: 94142 - DNA, 50 bp, homo sapien
tcaccagaaatacactgagctcttaygatgtctaagagattctggtgggt

SEQ ID NO: 94143 - DNA, 50 bp, homo sapien
aattctgtttaattgagaagtgttgyaaatttgataacgatgttaactct

SEQ ID NO: 94144 - DNA, 50 bp, homo sapien
ctcagagacttctaggtcattttaaraatctcagtatccaaacttaaaac

SEQ ID NO: 94145 - DNA, 50 bp, homo sapien
aatgtagggagattacaaggtgctaygagaacatgtatgaaagttactta

SEQ ID NO: 94146 - DNA, 50 bp, homo sapien
ggtttaagagaaaatgtatttcttarctataaagtcatgcttaaaagact

SEQ ID NO: 94147 - DNA, 50 bp, homo sapien
ctgatgataaaacctctcctttataygctgagtacaagcctacaaaatgc

SEQ ID NO: 94148 - DNA, 50 bp, homo sapien
caccacagagctggtcttggcactawgtaaataaacagacaaagacattt

SEQ ID NO: 94149 - DNA, 50 bp, homo sapien
aagttattatatctttaagaaatatyatatgacaatgtgccaaaccaaag

SEQ ID NO: 94150 - DNA, 50 bp, homo sapien
aagatgttttagggataaaatagaartaccagggacattatgtttatttt

SEQ ID NO: 94151 - DNA, 50 bp, homo sapien
tgttagtaatgaaaaactccataacrgaaatgaagaatatcttctttgga

SEQ ID NO: 94152 - DNA, 50 bp, homo sapien
ctcttcctgttatttggcattcgtcyctgttatttcagtgtcttataaaa

SEQ ID NO: 94153 - DNA, 50 bp, homo sapien
aaccaagacatgttaagtctgcaaaytgtatgtactaatttttatgcttc

SEQ ID NO: 94154 - DNA, 50 bp, homo sapien
cagactttggtaatagtcctgtaatmaactcttctcatgcaacagtgtag

SEQ ID NO: 94155 - DNA, 50 bp, homo sapien
taatttaataaacatttcccagtgartacatatacagtttagaaagaaat

SEQ ID NO: 94156 - DNA, 50 bp, homo sapien
tgtgtaccatatatgaattaccaaasattagctacagcagtcaaacacaa

SEQ ID NO: 94157 - DNA, 50 bp, homo sapien
gtcttctaatttattcctatcagaarcctactttatttcctagtttgttt

SEQ ID NO: 94158 - DNA, 50 bp, homo sapien
tgttatcagaggagtagattgactayaaaagtgagttttttttctgattt

SEQ ID NO: 94159 - DNA, 50 bp, homo sapien
gaataatatagagattttcttctccrctacatttccaaaacctagaaaag

SEQ ID NO: 94160 - DNA, 50 bp, homo sapien
tggaatgaggaaaatatttgtaaacygtgagctgcggtatcagtgtgtct

SEQ ID NO: 94161 - DNA, 50 bp, homo sapien
ttttcattgcctactagtgagagaarcccaatagcttgctagtttgcaat

SEQ ID NO: 94162 - DNA, 50 bp, homo sapien
cacataggtaatacgtagcatctcaygttttattatgtaagataatttta

SEQ ID NO: 94163 - DNA, 50 bp, homo sapien
cgtatcttgggtagaactagttataygttttggtaataaatatcattttc

SEQ ID NO: 94164 - DNA, 50 bp, homo sapien
cttcttcctgcttatttatcacaacraaactaaatattggaacgtcaatt

SEQ ID NO: 94165 - DNA, 50 bp, homo sapien
attttactctgtccctgaaaactcawcttaataaaatcctaaaatgccta

SEQ ID NO: 94166 - DNA, 50 bp, homo sapien
ttactcccatgatgatggaaccatgsaaagtactaaaccaagaacgtgaa

SEQ ID NO: 94167 - DNA, 50 bp, homo sapien
tctgggagtgggaagagtgagtgaargtcttgaaattatgagaaaaataa

SEQ ID NO: 94168 - DNA, 50 bp, homo sapien
agcagaggtgtaaaggcatgtttgamtatgatgaatgtagagcttttgta

SEQ ID NO: 94169 - DNA, 50 bp, homo sapien
agaaaggagagcctacattagaattrgtctacaccagaacttgttgggat

SEQ ID NO: 94170 - DNA, 50 bp, homo sapien
ctttcacattttgccttctttaacarcaactcagtcaaactactttgtct

SEQ ID NO: 94171 - DNA, 50 bp, homo sapien
ctggtgaactgtttgttacacatgaratagtaccagatgctttataagaa

SEQ ID NO: 94172 - DNA, 32 bp, homo sapien
aacattttctcagatayaggacatataaacac

SEQ ID NO: 94173 - DNA, 50 bp, homo sapien
cagattctttttgtaaaaaggaaaargctatagttatgactttcctctgg

SEQ ID NO: 94174 - DNA, 50 bp, homo sapien
ttgaacacattccaaatcaagagagmaccaatggcatatcagggtagtaa

SEQ ID NO: 94175 - DNA, 50 bp, homo sapien
ccaccctgctattcggctttaagaartacagaatcaaataagacaggaag

SEQ ID NO: 94176 - DNA, 50 bp, homo sapien
gacactagtcttggcccactctatasaagtaagatcttgctaggcttgta

SEQ ID NO: 94177 - DNA, 50 bp, homo sapien
tatattttgtctattataaccagtgrcccttctaagcattcagtcatcac

SEQ ID NO: 94178 - DNA, 50 bp, homo sapien
ccagaaacaaggatgacctctcagcragaaactgtgtgactgtaatcact

SEQ ID NO: 94179 - DNA, 50 bp, homo sapien
gactagacagaaggtcatatgaatayaattgtggagcctacatctcacaa

SEQ ID NO: 94180 - DNA, 50 bp, homo sapien
agtagattgaaaataaatctttctayggatgaatctaaagcgtttctaga

SEQ ID NO: 94181 - DNA, 50 bp, homo sapien
tttatccatgtaatttatggcaagaygaatagcacagtaaccttggctga

SEQ ID NO: 94182 - DNA, 50 bp, homo sapien
ggcatacatttctacaatatgaccaratctcagtatttactttcaaatat

SEQ ID NO: 94183 - DNA, 50 bp, homo sapien
aatggattaagaagtctattgcaagsctaaaaattatctgaattaaccga

SEQ ID NO: 94184 - DNA, 50 bp, homo sapien
tctcccttgtctttatgaaatgaacmggccatcttttatattctggagtc

SEQ ID NO: 94185 - DNA, 50 bp, homo sapien
agaatacagtaatcaaaaaagcatgrtattagtacaaagacagacaaata

SEQ ID NO: 94186 - DNA, 50 bp, homo sapien
taagtaatgcttgaatttaattttaygagccaatatctaatagaataaaa

SEQ ID NO: 94187 - DNA, 50 bp, homo sapien
atatatctatgtaccaattgaataamataagtcaagtaaaaaagccatca

SEQ ID NO: 94188 - DNA, 50 bp, homo sapien
acttatccacatggaatgttagaacrccctgcattacatggaaagcctat

SEQ ID NO: 94189 - DNA, 50 bp, homo sapien
tgccacctctctatcttggtggttcrcgtttgtcagtctatccacactga

SEQ ID NO: 94190 - DNA, 50 bp, homo sapien
cctgtacctattgaaattaaaggaamtgagtgtaggatggtagcctacag

SEQ ID NO: 94191 - DNA, 50 bp, homo sapien
aataatttctaaagagatcaaataayggtctgttgaaacataaggatgta

SEQ ID NO: 94192 - DNA, 50 bp, homo sapien
cctgatagcatgctttctattttgayattgatgataatattatataaaca

SEQ ID NO: 94193 - DNA, 50 bp, homo sapien
gtaaatgaaaaagaatttggtaaggrattgaatgtctgggtaagaacttg

SEQ ID NO: 94194 - DNA, 50 bp, homo sapien
atacgctttaaataacatgctgactytaaccaattgaatgtgactacctg

SEQ ID NO: 94195 - DNA, 50 bp, homo sapien
aatatcatcatctttgtacaagctaygggaaagtaagattttatattttt

SEQ ID NO: 94196 - DNA, 50 bp, homo sapien
aatgtgtttgtttgttttttgcatawagttgctaaattggtgtttttgcc

SEQ ID NO: 94197 - DNA, 50 bp, homo sapien
ttagtggaactgtttatagcctgtcyactaatcaattgcagaggaaaaca

SEQ ID NO: 94198 - DNA, 50 bp, homo sapien
tttaaagaatggtcaagacagcataygtgtatagatattttgcagggtat

SEQ ID NO: 94199 - DNA, 50 bp, homo sapien
ttctttggcaaaatgtttattcagawgccatgttatatacaacagaaaag

SEQ ID NO: 94200 - DNA, 50 bp, homo sapien
aaacagcattgctgaattcaggccartcataatttaatcaccatgcatca

SEQ ID NO: 94201 - DNA, 50 bp, homo sapien
aactttgattgagggcagtaaattcmctgaaagaatcagattaactattt

SEQ ID NO: 94202 - DNA, 50 bp, homo sapien
agtcattttggcttctgccttactcyttctctttttggaatacaattttt

SEQ ID NO: 94203 - DNA, 50 bp, homo sapien
gaaacggaggaatcaaggatgtcatratgtcatgtggatgtaagcttttt

SEQ ID NO: 94204 - DNA, 50 bp, homo sapien
gagatagataaagtaaaactcatgarcagcaaagaacttgacaaggggac

SEQ ID NO: 94205 - DNA, 50 bp, homo sapien
ctaaagtgttgttatatatacagaawactgaaatgaacaagagttcagtg

SEQ ID NO: 94206 - DNA, 50 bp, homo sapien
gtcgcctgcacttgctgactataccragagaagtagactggatatgcacc

SEQ ID NO: 94207 - DNA, 50 bp, homo sapien
ttctgcctgatgtttttcacagttayagactagaattcaagcacattaaa

SEQ ID NO: 94208 - DNA, 50 bp, homo sapien
gatagtacttagagcctttagttaaytctcttcttcaacttcctcttcgg

SEQ ID NO: 94209 - DNA, 50 bp, homo sapien
ctgtgttttggccaaagttcagttakggtgctatagttgtttgcagattt

SEQ ID NO: 94210 - DNA, 50 bp, homo sapien
tcagttgtgaatcttttacaagaaawtaccactagatctcaaagaaccag

SEQ ID NO: 94211 - DNA, 50 bp, homo sapien
agtgtagagagaagagtcaaattagmcctattgagagaatgatggagagg

SEQ ID NO: 94212 - DNA, 50 bp, homo sapien
actagcatacagtactgtagacttaycaacaatgtacccttgggcagggt

SEQ ID NO: 94213 - DNA, 50 bp, homo sapien
gaaatgaataattcactattacatgraaaataatggtaaaaaaaatttag

SEQ ID NO: 94214 - DNA, 50 bp, homo sapien
tgcaggtttcccctccaaagcgtacyatgagatttttaagaacagccatg

SEQ ID NO: 94215 - DNA, 50 bp, homo sapien
tgaaatatcaatactttcacattaarccgctaatattaaaattgtttaaa

SEQ ID NO: 94216 - DNA, 50 bp, homo sapien
tttttggttttaccacttaacatgcyaatctccctgaacgtttaaaatgg

SEQ ID NO: 94217 - DNA, 50 bp, homo sapien
ggcatgttaagtggtaaaaccaaaartaacaccagctgactatgtttcta

SEQ ID NO: 94218 - DNA, 50 bp, homo sapien
attgtagcagtggaaaaataaactgyagcttagcttccagacaaaggcaa

SEQ ID NO: 94219 - DNA, 50 bp, homo sapien
tcttcttaaagccacagctatagtcwacaatggggcagaggaaagcttta

SEQ ID NO: 94220 - DNA, 50 bp, homo sapien
gctactcagggcctcagaaacctacyatcagtaatcacctttctaataag

SEQ ID NO: 94221 - DNA, 50 bp, homo sapien
ctttgtgataaatctttagaagcctyattggagatttcttgcagggaagg

SEQ ID NO: 94222 - DNA, 50 bp, homo sapien
tacttcacagactgttccaagccaayttcgcctgactcctctcctaacat

SEQ ID NO: 94223 - DNA, 50 bp, homo sapien
tcaggctttttatttattacattatkaggtctactcttcccttaaattag

SEQ ID NO: 94224 - DNA, 50 bp, homo sapien
gctcttcagtatgtatttaattagcraatcatatttttgtggtttcgcag

SEQ ID NO: 94225 - DNA, 50 bp, homo sapien
aaatttttgtcacaaaaatgtgttgyagactcatcttgtacttttcctga

SEQ ID NO: 94226 - DNA, 50 bp, homo sapien
ttctccctccagtcccattttttcascacatattaataccaatttatttt

SEQ ID NO: 94227 - DNA, 50 bp, homo sapien
catgattatgctagaaaacctgatayagttgttaaatggttgtactgaga

SEQ ID NO: 94228 - DNA, 50 bp, homo sapien
tattgttcaatgtagataaattcacscaatggaagaaatatgcatgaagt

SEQ ID NO: 94229 - DNA, 50 bp, homo sapien
cagaagatggggcacaaatagaccarccctattctcagtactgaatagac

SEQ ID NO: 94230 - DNA, 50 bp, homo sapien
tctaaaaattatttcactaagtataygtctatctaaacatcatgttgtga

SEQ ID NO: 94231 - DNA, 50 bp, homo sapien
gataatctctttgttcacacatacgratactttagaaacaatccggtcat

SEQ ID NO: 94232 - DNA, 50 bp, homo sapien
actatatctaggcctcctgaaaacayagggtaagtgaggcaccaaggcag

SEQ ID NO: 94233 - DNA, 50 bp, homo sapien
cagagacacgcactgaaagtatttamatctcctggcagtgtaggatccga

SEQ ID NO: 94234 - DNA, 50 bp, homo sapien
taaaagtttctagcatgtatacttaygagttttcttgtggaaataattat

SEQ ID NO: 94235 - DNA, 50 bp, homo sapien
actgaaggaataggagagacaatgaygggttaaaaatcaagatcaaattc

SEQ ID NO: 94236 - DNA, 50 bp, homo sapien
gtagcagagaacaatcagttgatatyaaaagcattatttttatctattaa

SEQ ID NO: 94237 - DNA, 50 bp, homo sapien
ttgacctctattttccttttaaatamtagcatttcttagccttcactcct

SEQ ID NO: 94238 - DNA, 50 bp, homo sapien
cccattcatttatttggtatgcatakagttagtttaccttccaggatttg

SEQ ID NO: 94239 - DNA, 50 bp, homo sapien
gtacagataagaaaactcaggatgakaaagcttcagtaactcggttaaag

SEQ ID NO: 94240 - DNA, 50 bp, homo sapien
tctcatactttcctgctcttctctayctcaattttccagtccaaggaaga

SEQ ID NO: 94241 - DNA, 50 bp, homo sapien
gaaagtaaatgtttcaaagagaaagyaatagtattaagtgttgcagagag

SEQ ID NO: 94242 - DNA, 50 bp, homo sapien
taaaaaactgggaaaaatgagattaragtaagaagaatccagaaagatga

SEQ ID NO: 94243 - DNA, 50 bp, homo sapien
tagaaaattaaattttagaagcataytagacactcattgaaaaatatcaa

SEQ ID NO: 94244 - DNA, 50 bp, homo sapien
ctcagcatccttatccttctcaaaayctaagcagctttcaaatttgacct

SEQ ID NO: 94245 - DNA, 50 bp, homo sapien
aatctctgaatctactcctgtcagaragcaccaaaaccaccaatttttaa

SEQ ID NO: 94246 - DNA, 50 bp, homo sapien
actgtccagaaacaaatttgagaccwaaagaattttgaagaaatatagac

SEQ ID NO: 94247 - DNA, 50 bp, homo sapien
agaataaatgtgtatttatttatacyactgagtttgcagtaatctattac

SEQ ID NO: 94248 - DNA, 50 bp, homo sapien
gacatggtacgttaacattcctgtayagttatcatgatttgcactcatca

SEQ ID NO: 94249 - DNA, 50 bp, homo sapien
tccttgtcccttatcaccgggtatgraatacttaataattgacactttgc

SEQ ID NO: 94250 - DNA, 50 bp, homo sapien
gagtaaatttttatattcaaattgargtgtagtaacaaattatagtaaga

SEQ ID NO: 94251 - DNA, 50 bp, homo sapien
tttttttctggataaatacttcaaartaaacgttctcagatggtaattgt

SEQ ID NO: 94252 - DNA, 50 bp, homo sapien
ttattggataagatgtactttaaacyactgaaatgtacttgtgagaatga

SEQ ID NO: 94253 - DNA, 50 bp, homo sapien
catggtgtggcaggcaaataaaaatraggagttactcagcaggctgtagg

SEQ ID NO: 94254 - DNA, 50 bp, homo sapien
gtcaattctcatttattcaagggacsatagtgtttggaatagagccaaca

SEQ ID NO: 94255 - DNA, 50 bp, homo sapien
aacatatgattctcttcaaaaacaartagcagtcaataaagtaggaattt

SEQ ID NO: 94256 - DNA, 50 bp, homo sapien
atgggtaatcttgtattttccctggyaatcttaatggtcctttaggtcag

SEQ ID NO: 94257 - DNA, 50 bp, homo sapien
actacagtatttgattttccattacwaccttataagattactagtaccat

SEQ ID NO: 94258 - DNA, 50 bp, homo sapien
ccctagcaatttgtctcaaatttcaygcataggatcaaaagaaaatgttt

SEQ ID NO: 94259 - DNA, 50 bp, homo sapien
gttttccatattaatatgatgattayactagtttgcattcatttttaaaa

SEQ ID NO: 94260 - DNA, 50 bp, homo sapien
tctaggataagataggaaaacttcartaataggcagtttatgtcagcaca

SEQ ID NO: 94261 - DNA, 50 bp, homo sapien
ttaaaagtcaaggaaatatggtcaamgatcaaaaggggagtcttaaaagg

SEQ ID NO: 94262 - DNA, 50 bp, homo sapien
tcctgaagttaagttgtgaagattaycagtggattgctcaaaataatgac

SEQ ID NO: 94263 - DNA, 50 bp, homo sapien
atctgggagaggcttatggacgagaygacttgtttgttgagtcttgaagt

SEQ ID NO: 94264 - DNA, 50 bp, homo sapien
tttaaaaaggcataaagtcttggaamatttcatgtagggaacatcaattt

SEQ ID NO: 94265 - DNA, 50 bp, homo sapien
ataaggttttataaaagatcaattasgaagccattgtagaaatcgaattt

SEQ ID NO: 94266 - DNA, 50 bp, homo sapien
ctgttgaatatctgagttacaggtaraaactgaaatggaagaagatgatg

SEQ ID NO: 94267 - DNA, 50 bp, homo sapien
gggcgtataacatagggaccttgttsaaatgttattgttattgttgttgt

SEQ ID NO: 94268 - DNA, 50 bp, homo sapien
ggctcacagatgtgaaataatttgaytagtctcatatgtctgtaaatgat

SEQ ID NO: 94269 - DNA, 50 bp, homo sapien
aagggattgttgaaggtttaacacartgggactagtagtgccataaaatc

SEQ ID NO: 94270 - DNA, 50 bp, homo sapien
aaatctctattgaagtacttttcaayatagacattaaaattgctgcagta

SEQ ID NO: 94271 - DNA, 50 bp, homo sapien
aaattaagaatatctgttcatcagcrtattctgtaaagatagcaaaaaga

SEQ ID NO: 94272 - DNA, 32 bp, homo sapien
ataaatatggaaaaaarttaaattggatttct

SEQ ID NO: 94273 - DNA, 50 bp, homo sapien
ttaactactctgttcatcttgtcacytttttatttagatatgcatcaatc

SEQ ID NO: 94274 - DNA, 50 bp, homo sapien
cagaaagtagggactgatctcatttrtctccacattctttgtacttggtg

SEQ ID NO: 94275 - DNA, 50 bp, homo sapien
agaaatagactgtcatatctgataargaagagagaagtaaaaaatatgag

SEQ ID NO: 94276 - DNA, 50 bp, homo sapien
tataaagggaggctcataaaagccasgaaaaataagtaatataaacaacc

SEQ ID NO: 94277 - DNA, 50 bp, homo sapien
atatgaaaatatatgtgaaatacccraacttggaatgcatttttacacac

SEQ ID NO: 94278 - DNA, 50 bp, homo sapien
aacagaactgaacttaccgatacatyatgtacaggaggaagaatatgatc

SEQ ID NO: 94279 - DNA, 50 bp, homo sapien
ttgaaattttcttttcagaaatggcrataaagtttgtgtgttaactacgt

SEQ ID NO: 94280 - DNA, 50 bp, homo sapien
aaatccagtgcagattgaatccaccraagacacctcactagcagtcctct

SEQ ID NO: 94281 - DNA, 50 bp, homo sapien
gttggtgtaagaatttgataaataargtggtaaaattattacactttact

SEQ ID NO: 94282 - DNA, 50 bp, homo sapien
ctgttgctttatagctacgtattaayatagagagcaagggggaaaataat

SEQ ID NO: 94283 - DNA, 50 bp, homo sapien
taagtgcagaatgttaccctgtgaastatgaccaaatttattgctgcagt

SEQ ID NO: 94284 - DNA, 50 bp, homo sapien
acctagtgaataccagtagatatgayattagggactgaaatcaaggtgga

SEQ ID NO: 94285 - DNA, 50 bp, homo sapien
agcatacacggtcttttaagcaagcrcccgttttcacttctttgccttct

SEQ ID NO: 94286 - DNA, 50 bp, homo sapien
agataaaacttaacctcattctgtamactatggaattgaataaaacatat

SEQ ID NO: 94287 - DNA, 50 bp, homo sapien
gaaacaaaatctggatgttgacaaartctaattttcctgtgtgtatacat

SEQ ID NO: 94288 - DNA, 50 bp, homo sapien
tacagtgacctatctatcttgactcsaatatgtgaaattatagttaatga

SEQ ID NO: 94289 - DNA, 50 bp, homo sapien
agttaatgtatgtttgtaaacagtargctctctccctcttgtattttata

SEQ ID NO: 94290 - DNA, 50 bp, homo sapien
gcttttcttttttattttatttatcygacatttttcttttttggtttgga

SEQ ID NO: 94291 - DNA, 50 bp, homo sapien
gatcaagtggcaataaattagtaaawgtcatgcaaacaaaagcaaatgat

SEQ ID NO: 94292 - DNA, 50 bp, homo sapien
ggatatcctacattttagttacaggrataattagtgactttcctcattta

SEQ ID NO: 94293 - DNA, 50 bp, homo sapien
tgcttatcacaagattggcagcctasagcaatttagcagtgccagacgta

SEQ ID NO: 94294 - DNA, 50 bp, homo sapien
cctcgaagccctgttgcccaagtatsaagatctctgctgaagttttacgt

SEQ ID NO: 94295 - DNA, 50 bp, homo sapien
attctaacacaaggctaccacttcayactacttttagttggcacttttgt

SEQ ID NO: 94296 - DNA, 50 bp, homo sapien
agatctataattatttactgtttcayctatcaaagcataacttgtatcca

SEQ ID NO: 94297 - DNA, 50 bp, homo sapien
aaaactttttctgtaaagggtcagasagtaaacaatttcagctttatagg

SEQ ID NO: 94298 - DNA, 50 bp, homo sapien
ttttatttcaatagaaattctataamattcagactaacaatcagtgattc

SEQ ID NO: 94299 - DNA, 50 bp, homo sapien
taaatggccactgtaaaagtcaaaartttaccatcctggctaacacagtg

SEQ ID NO: 94300 - DNA, 50 bp, homo sapien
ctaaccaatctagatacagaatataygtaaaaattagtgtgtagaatata

SEQ ID NO: 94301 - DNA, 50 bp, homo sapien
ttcatcatactgtattttgcagatayaatgaaattctcattactatcgtg

SEQ ID NO: 94302 - DNA, 50 bp, homo sapien
aactttgtgattataattggtaaaargacgtattgatttgtatggatttg

SEQ ID NO: 94303 - DNA, 50 bp, homo sapien
gtctatcatataacacagggaaaaaygttatcatatctcaaatttgtgac

SEQ ID NO: 94304 - DNA, 50 bp, homo sapien
tgagagtgtgggtgtttgaataaaaygaactcaggttgtagtcctgttcc

SEQ ID NO: 94305 - DNA, 50 bp, homo sapien
ccagaccctagaatgatatatccacraacagtttggaccacccaactgga

SEQ ID NO: 94306 - DNA, 50 bp, homo sapien
gacataaccctcaagtgccttaagayagtttgaattaggactctaccact

SEQ ID NO: 94307 - DNA, 50 bp, homo sapien
gtgacccctctctatgagttcctccraaatattgttgacattaagccaat

SEQ ID NO: 94308 - DNA, 50 bp, homo sapien
tgttgttaaatccaggcacatagcasgaagcatcacccttaagtgttaat

SEQ ID NO: 94309 - DNA, 50 bp, homo sapien
acaaaggtgattgtataataaaatgmaatagtgctagtaaagcattccca

SEQ ID NO: 94310 - DNA, 50 bp, homo sapien
gcaaagaaaaagattaggttaatacycaaactttcaaattcaaaaataga

SEQ ID NO: 94311 - DNA, 50 bp, homo sapien
gagaggagggagagaaaacaactgayggataccaggcttaatacctgggt

SEQ ID NO: 94312 - DNA, 50 bp, homo sapien
atcttgaaattttaattaacactaarcctgatatgtaaatggctaacaaa

SEQ ID NO: 94313 - DNA, 50 bp, homo sapien
gcttgctattgtgatcatggagagartagataacagcaatattgtaggaa

SEQ ID NO: 94314 - DNA, 50 bp, homo sapien
atagtgtctacaataattgtagtatraaataatgcttgttgaaatggtta

SEQ ID NO: 94315 - DNA, 50 bp, homo sapien
catgctactctgagctactacaaatratgggaatattaatactcctccag

SEQ ID NO: 94316 - DNA, 50 bp, homo sapien
acaatggaataccaaaatgttgtgaraaagagtttgctaggcaagggata

SEQ ID NO: 94317 - DNA, 50 bp, homo sapien
tatcaatcattgagtaacaaattacrataaaactcagcagcttaaaagaa

SEQ ID NO: 94318 - DNA, 50 bp, homo sapien
cacaggtggagtgatgggatccgaaytataagaccagaatctggtgctca

SEQ ID NO: 94319 - DNA, 50 bp, homo sapien
tgtaacttgtgcagctcattgcttcyactccctgtcttcatcactctgtt

SEQ ID NO: 94320 - DNA, 50 bp, homo sapien
cactatgaaatgtgaaaatggaactsaaaataaaataatttacccaagat

SEQ ID NO: 94321 - DNA, 50 bp, homo sapien
taaagctttctatcagactcccaatsagcaatgtttatgagttgtatgtg

SEQ ID NO: 94322 - DNA, 50 bp, homo sapien
aacataaataaagataagttcatcayaaaggatagataggttgctggggt

SEQ ID NO: 94323 - DNA, 50 bp, homo sapien
gtgacaaacgtgttaactttcagacrgtaaattcaaaatagccatttcta

SEQ ID NO: 94324 - DNA, 50 bp, homo sapien
tcatggaaattaaagcttgcatcaargcaaatgtcaaactactacaatgt

SEQ ID NO: 94325 - DNA, 50 bp, homo sapien
gacatagggaccaagggctaataaartgtgcaaatccagagtgcttctgt

SEQ ID NO: 94326 - DNA, 50 bp, homo sapien
aaaggccaccatatcggccagatttratccaaataaactgaaaacaaatt

SEQ ID NO: 94327 - DNA, 50 bp, homo sapien
gaatactggtttaccttgtaagatcyatccttcctatgttcaatgggcaa

SEQ ID NO: 94328 - DNA, 50 bp, homo sapien
taatttcagtcttttgggtcatggtkttttagtctttgagaatccattta

SEQ ID NO: 94329 - DNA, 50 bp, homo sapien
tcactctaagatagatagatagatayaaccatggagtcctatttgtaaaa

SEQ ID NO: 94330 - DNA, 50 bp, homo sapien
caattaatgcaatgtagttgactaayaataaagatgttagctgatgatgg

SEQ ID NO: 94331 - DNA, 50 bp, homo sapien
atttaatttggataagtatttaggartattatcctgagttgatgtatttt

SEQ ID NO: 94332 - DNA, 50 bp, homo sapien
ttgtgactaaaactttccacaattasaatctatgttttcaacattcaata

SEQ ID NO: 94333 - DNA, 50 bp, homo sapien
atgatgattgttacatttgtaacatsacttaggttgaatttagaagctgt

SEQ ID NO: 94334 - DNA, 50 bp, homo sapien
atacaattttattttcactccaaaasaaacctgcaggctgcaaaattatt

SEQ ID NO: 94335 - DNA, 50 bp, homo sapien
tcaaaagaaatattaaagtgagaaaytgatgggataaaacagttatccag

SEQ ID NO: 94336 - DNA, 50 bp, homo sapien
atatctaataatacagagcactatcwctaacctcaacagttgacatttta

SEQ ID NO: 94337 - DNA, 50 bp, homo sapien
attgctgttaatacttagatgaaaakaattggattgataaagcaatattt

SEQ ID NO: 94338 - DNA, 50 bp, homo sapien
ccagtaatggcaatgaagtactgggmcattcaaactcctgcgatataaac

SEQ ID NO: 94339 - DNA, 50 bp, homo sapien
aagagaaggtagacagagatatcaaygtagaaagtttattcaaaggaata

SEQ ID NO: 94340 - DNA, 50 bp, homo sapien
agtgcagtaaccagggcactacctaycatcattagcaccattttcagatt

SEQ ID NO: 94341 - DNA, 50 bp, homo sapien
ttagcataaaattcccattataagakgaatatgaacatgattaggtagtt

SEQ ID NO: 94342 - DNA, 50 bp, homo sapien
tatattaatctgttggattagcaaamtgttatcctctatgatactctttt

SEQ ID NO: 94343 - DNA, 50 bp, homo sapien
aactacttgattaaaagatttcatargcttccatatgtagcttctaaaac

SEQ ID NO: 94344 - DNA, 50 bp, homo sapien
caaaccattattattaaagaagaaarctctgactctagtattgttgcctc

SEQ ID NO: 94345 - DNA, 50 bp, homo sapien
tttttcagcttgggactactctggcraaggaaaataatgtggataatatg

SEQ ID NO: 94346 - DNA, 50 bp, homo sapien
tctttgagagtccattattacttagragcaatttttcatatatatgtata

SEQ ID NO: 94347 - DNA, 50 bp, homo sapien
aatgatccccacagttggcaagagasgaatcaaaataacaacatggcttt

SEQ ID NO: 94348 - DNA, 50 bp, homo sapien
ctccagcagctgataggttgcaagcygaaatatcctttggcaatacctag

SEQ ID NO: 94349 - DNA, 50 bp, homo sapien
tagataacagtgtttcattggttaayatcatgacatatatttaagaaagc

SEQ ID NO: 94350 - DNA, 50 bp, homo sapien
atagcatgatacattatgttatgaartgagaaaaacctatcccactgacc

SEQ ID NO: 94351 - DNA, 50 bp, homo sapien
aataaagatatagatcataaaagtayattatttggaagaaggtcagtggg

SEQ ID NO: 94352 - DNA, 50 bp, homo sapien
aggctgagaaactcaatgagagacastagggtatagaaggtaaaatattc

SEQ ID NO: 94353 - DNA, 50 bp, homo sapien
gttgaaatacattacttccatttaartagtctgtttattgtggcttatta

SEQ ID NO: 94354 - DNA, 50 bp, homo sapien
agcctacattctgtactgctgatcaytgaaagccttgcattctgatttct

SEQ ID NO: 94355 - DNA, 50 bp, homo sapien
gcattctgatttctaagtctctcatkacattgttatatccttctgactag

SEQ ID NO: 94356 - DNA, 50 bp, homo sapien
gccttttgaatcattgtagagggtawcacaagatcggtgaattttacagt

SEQ ID NO: 94357 - DNA, 50 bp, homo sapien
aagacctatgtcactaaatattgtaracagtcattagcttggccttttga

SEQ ID NO: 94358 - DNA, 50 bp, homo sapien
aaatgattaaatttatcactttgtargaatcaaatcagtccttagatggt

SEQ ID NO: 94359 - DNA, 50 bp, homo sapien
tctttctgatttttccaccttaaaaktttcatgctgatagatgtgattca

SEQ ID NO: 94360 - DNA, 50 bp, homo sapien
aacttggtaaaggggatagagtaaaygtataatggaatcactgcatttat

SEQ ID NO: 94361 - DNA, 50 bp, homo sapien
gtttaagtctcttatagatgatgaawgttagattttagccagatgcatag

SEQ ID NO: 94362 - DNA, 50 bp, homo sapien
aggtgtgagtatagaaaatcagaaawttgagaaggtaataaagtttcctt

SEQ ID NO: 94363 - DNA, 50 bp, homo sapien
taatggtgaccctggtcctgcctaamaaaacttcaaagcaagcatcaaaa

SEQ ID NO: 94364 - DNA, 50 bp, homo sapien
agtgatataatctgactaacatttaraagaaacactatagctgcctttga

SEQ ID NO: 94365 - DNA, 50 bp, homo sapien
caacaacattgtctatgtagatttarcaattcaagaagaataaagtcaat

SEQ ID NO: 94366 - DNA, 50 bp, homo sapien
gttacagaaaattaattcaaccatasgtattaacaccatagtaatttgga

SEQ ID NO: 94367 - DNA, 50 bp, homo sapien
cctactaaatacttggaaaaatatayacgttaaattagcatggcttcaga

SEQ ID NO: 94368 - DNA, 50 bp, homo sapien
ttcattttaccaacacttccctatcrctaaagatatcactctttatcact

SEQ ID NO: 94369 - DNA, 50 bp, homo sapien
tgtggctttttacctatgagagtgakaggagtccccattgtcttttgttt

SEQ ID NO: 94370 - DNA, 50 bp, homo sapien
gactcctgggtaaataataaaattasggcagaaattaggaagttctctga

SEQ ID NO: 94371 - DNA, 50 bp, homo sapien
ttcagagaaacttatatatttaaagytgtgtgccaggttgttataaatct

SEQ ID NO: 94372 - DNA, 50 bp, homo sapien
actaaaagatgattctttcactgtgraatttgatgatacttctttcaaat

SEQ ID NO: 94373 - DNA, 50 bp, homo sapien
aaaaaaaatgctcattatgctctcayacttgtttaaaaattgtcttttta

SEQ ID NO: 94374 - DNA, 50 bp, homo sapien
aggtcagaagagttagaaagagcaaytgaatatgttggtgccattaatgg

SEQ ID NO: 94375 - DNA, 50 bp, homo sapien
ctgctgagaaccaacatgctccttcytgattccttaaatgaaaatccaga

SEQ ID NO: 94376 - DNA, 50 bp, homo sapien
aatgctgcttaatggtgtgttaaaaygctgcaatgaagaataacttgctg

SEQ ID NO: 94377 - DNA, 50 bp, homo sapien
aaatattaagcaggacaagggggacraagagtgatggtagggatggagta

SEQ ID NO: 94378 - DNA, 50 bp, homo sapien
ttatagtagcccaaaatagatttacygccagaatcagttagatttgctac

SEQ ID NO: 94379 - DNA, 50 bp, homo sapien
aaaacacagaaatcaaacaactgaaracataagcaccagaagcaaaggct

SEQ ID NO: 94380 - DNA, 50 bp, homo sapien
tattgaattctaaatgatttcccgawctttcttagggctcactaatacaa

SEQ ID NO: 94381 - DNA, 50 bp, homo sapien
gaaattatttcagatatcatagaaasaagcacacagttgagatagataat

SEQ ID NO: 94382 - DNA, 50 bp, homo sapien
catcttccatgagtgaatcttcatargctgctacccctagagatcatgtg

SEQ ID NO: 94383 - DNA, 50 bp, homo sapien
aaataaaactcttatcaaactcataytaaatttgctataaacagagcaga

SEQ ID NO: 94384 - DNA, 50 bp, homo sapien
cctttcaatttcaactcatagagacmaataacctcatctatttagtgata

SEQ ID NO: 94385 - DNA, 50 bp, homo sapien
caaaacccagagtttaactatttctrtttagccaaccataaaacttacgt

SEQ ID NO: 94386 - DNA, 50 bp, homo sapien
gattcaggcagttttctttaaatcaytgagataagattaaacgttgagtt

SEQ ID NO: 94387 - DNA, 50 bp, homo sapien
cccctctagaccaatcgaaaccaaarttcttggagaggatccctggcatc

SEQ ID NO: 94388 - DNA, 50 bp, homo sapien
ttagtgtaggtaatagagagattgtwaatattgttccaagacaaaactgt

SEQ ID NO: 94389 - DNA, 50 bp, homo sapien
gggtctgggcaaaggagtacatagaygcaatttctccatcccagaatcat

SEQ ID NO: 94390 - DNA, 50 bp, homo sapien
tttaatccataaggagactggacaakaatatggttctgagaagggtgcta

SEQ ID NO: 94391 - DNA, 50 bp, homo sapien
tatattttacttctgttttactggargaaggaattatattctcaatgtta

SEQ ID NO: 94392 - DNA, 50 bp, homo sapien
tagctggtctatctcatacttatctyggtctgagtcagtatcagacttcc

SEQ ID NO: 94393 - DNA, 50 bp, homo sapien
gtgatgacatgaataaacctgaagartattatgtgaagtgaaacaagcct

SEQ ID NO: 94394 - DNA, 50 bp, homo sapien
tctatataaaacaatcagaaaattaygttgagagaaactatttcaaacat

SEQ ID NO: 94395 - DNA, 50 bp, homo sapien
ttatgtagtacacctatctaacaaartctattgatatcatatgcaatctt

SEQ ID NO: 94396 - DNA, 50 bp, homo sapien
agtatccaccttaacatttctgttaygtggacaacattaagaggcaattt

SEQ ID NO: 94397 - DNA, 50 bp, homo sapien
cttccttgtgaattcctgtaattccraattcccaaaatgaactcatattg

SEQ ID NO: 94398 - DNA, 50 bp, homo sapien
catgcttctaagtagattactagaakttactttatcgaattacagcaatg

SEQ ID NO: 94399 - DNA, 50 bp, homo sapien
ttgttacagtcaaagggtttattaargcatgtaccagagggccttgaggg

SEQ ID NO: 94400 - DNA, 50 bp, homo sapien
gtaaatacaaagaagtgaattaaacrgagaagactagaaaacatagttga

SEQ ID NO: 94401 - DNA, 50 bp, homo sapien
actcatcaagctgacttgtcagaaaraagactgactatatattgaacctt

SEQ ID NO: 94402 - DNA, 50 bp, homo sapien
caggccctagtgcctgctcagtatamcatcattttgactgtgcacactct

SEQ ID NO: 94403 - DNA, 50 bp, homo sapien
aatagaggttgaaatactgcattaartcaactctttagatagtcatcttt

SEQ ID NO: 94404 - DNA, 50 bp, homo sapien
ccaaacctcatttgagcatgaactcrccatcataaagattatctctataa

SEQ ID NO: 94405 - DNA, 50 bp, homo sapien
gtagtgtttctcagaacctttaggaygacaaaggcatgaattgtgaaacc

SEQ ID NO: 94406 - DNA, 50 bp, homo sapien
tgtctttatagcagcatgtttcaaarttctttgggtatatacccagtaat

SEQ ID NO: 94407 - DNA, 50 bp, homo sapien
aaggggaaaaagtaataataatagasagttgtacttgattgtttccatgg

SEQ ID NO: 94408 - DNA, 50 bp, homo sapien
atgatccagacacagtcccagcctakgtttacagtcaaatgcagaagata

SEQ ID NO: 94409 - DNA, 50 bp, homo sapien
atttcagtgaagcatagaatgagtgrttaaaaccaggaaaccataatgac

SEQ ID NO: 94410 - DNA, 50 bp, homo sapien
attgtttttgtaattgttttttcaakattcaagttaagcatacaggtatt

SEQ ID NO: 94411 - DNA, 50 bp, homo sapien
ttgcttagtttgtgtctgataaggargatgactttatatggatcataaaa

SEQ ID NO: 94412 - DNA, 50 bp, homo sapien
aggcatatacccaatagcaaataaaygaaaattgatgcaatgctacaaaa

SEQ ID NO: 94413 - DNA, 50 bp, homo sapien
ggtagagtcagggagaaggctatccraaatctgactgaaaaggaaggagc

SEQ ID NO: 94414 - DNA, 50 bp, homo sapien
agcattttcatctataagtttcttcragtagaatgtctatatgccccctt

SEQ ID NO: 94415 - DNA, 50 bp, homo sapien
attttggcagagcatatttttctgamcaatgagagttacttatgtgttca

SEQ ID NO: 94416 - DNA, 50 bp, homo sapien
taaaatggtgccatttcgatgagcgsagcagtgcttgataaatgttagcc

SEQ ID NO: 94417 - DNA, 50 bp, homo sapien
ttatatctggacctatgtacaacatyatgtgtaatctatagtatcattta

SEQ ID NO: 94418 - DNA, 50 bp, homo sapien
gactttattctctttgtgcaagtaarcatgtgcctatgagtatatgagaa

SEQ ID NO: 94419 - DNA, 50 bp, homo sapien
aatttatataataggagcttagggayttagaatgctttagctttaaacaa

SEQ ID NO: 94420 - DNA, 50 bp, homo sapien
agcctcataattttattggccttacrcattttaataattttacttcaatt

SEQ ID NO: 94421 - DNA, 50 bp, homo sapien
tgggttatttattacagtgataaacygctgaacattgtgtgaaaaacgta

SEQ ID NO: 94422 - DNA, 50 bp, homo sapien
ccctcaaacctcacaaaaacccaggractatttgggatgctcctttacat

SEQ ID NO: 94423 - DNA, 50 bp, homo sapien
agagtcagagaaagatatttgcctayaattaacaaaagataggtttaaaa

SEQ ID NO: 94424 - DNA, 50 bp, homo sapien
ataacagttcatatttgtatatttayaatgtactctggagcacagtttta

SEQ ID NO: 94425 - DNA, 50 bp, homo sapien
gtacaataaagtttctttatttagaytaatgcttaagactgttgttaaga

SEQ ID NO: 94426 - DNA, 50 bp, homo sapien
gataaggcataacagaaattatcaaygtgtaccttttaattaaacaatga

SEQ ID NO: 94427 - DNA, 50 bp, homo sapien
tgacaacatatcagaaaaatatagarggaaactgaaggaagtcccaatga

SEQ ID NO: 94428 - DNA, 50 bp, homo sapien
ggctgatgttatatgatccattagartcctgtggccatcactcacacagg

SEQ ID NO: 94429 - DNA, 50 bp, homo sapien
caagccaggactgacattcatatttyttaaactagcctgacacaatttgc

SEQ ID NO: 94430 - DNA, 50 bp, homo sapien
gtatatggaggtctttctggatctaygctattgtctgtatcttaagttct

SEQ ID NO: 94431 - DNA, 50 bp, homo sapien
aaaggtgagggaaatacgttacacakatacaagttcccaggacccaagca

SEQ ID NO: 94432 - DNA, 50 bp, homo sapien
tctatagtgtggcttgccttggataycttaaaatggcttctctgaaagaa

SEQ ID NO: 94433 - DNA, 50 bp, homo sapien
attcttttgagactgaacacctctayaatttttctcgatagtgcaatgga

SEQ ID NO: 94434 - DNA, 50 bp, homo sapien
cagctgtaagttcaagaatatcactragatgtttacaaatcaaagaacaa

SEQ ID NO: 94435 - DNA, 50 bp, homo sapien
aactctggtttcttttatcttattgytccagcactcggtagagtcctcta

SEQ ID NO: 94436 - DNA, 50 bp, homo sapien
aaaagactaatatccacaatctacaragtgctgaaacaaatcagcaagac

SEQ ID NO: 94437 - DNA, 50 bp, homo sapien
ttattttaaaaaattgtggtgaaaaygacattaaatttactatcttgacc

SEQ ID NO: 94438 - DNA, 50 bp, homo sapien
gcagcttctcttcttgccagatatayatagtgaaagcactcctttaaaat

SEQ ID NO: 94439 - DNA, 50 bp, homo sapien
aatgataattcgtatcgactacggcwaatatatttcaagcatttttagag

SEQ ID NO: 94440 - DNA, 50 bp, homo sapien
attaatgtgtaaggttttaattctaycatgaaggtgtaagctggttgctt

SEQ ID NO: 94441 - DNA, 50 bp, homo sapien
ttcactgctgttgcttcaaccagtayctataggctgatgaattccaaagt

SEQ ID NO: 94442 - DNA, 50 bp, homo sapien
ttccttcaagaaatattaacaattaraacacaagtaatcacataattgtt

SEQ ID NO: 94443 - DNA, 50 bp, homo sapien
acagaacactaagagcctagaatggkatccattatatgttatacctcaaa

SEQ ID NO: 94444 - DNA, 50 bp, homo sapien
acaattgaatcataagcatctgtaayagaggagtcagaatctgactgtgc

SEQ ID NO: 94445 - DNA, 50 bp, homo sapien
gatatggatatacgatcttgcattaytaaattaaaaaaatagccataagc

SEQ ID NO: 94446 - DNA, 50 bp, homo sapien
ctaatcacttagagtccataaatacygcataggatattaaggtttgcttc

SEQ ID NO: 94447 - DNA, 50 bp, homo sapien
aacttaaaatacagacagttcctaayttaagatggttggagttaacaatt

SEQ ID NO: 94448 - DNA, 50 bp, homo sapien
tgctagcgtggccaacaatagacacrggtaacgatagacaaatttaccat

SEQ ID NO: 94449 - DNA, 50 bp, homo sapien
aaggagagagtaaactaatactgaaygtaagtgagtcaaatgatacatgt

SEQ ID NO: 94450 - DNA, 50 bp, homo sapien
ctagtggagcctccatagcataaccrcctctgaaaacttccacttcttgg

SEQ ID NO: 94451 - DNA, 50 bp, homo sapien
gattaaggattaacctccatgctgartcaaagttacctcacactcagttt

SEQ ID NO: 94452 - DNA, 50 bp, homo sapien
tcagatgctctagccccatgctttasacaagattcctgcagtcttccctg

SEQ ID NO: 94453 - DNA, 50 bp, homo sapien
gatggaggccgagattggagagattsatctacaagtcaaggaatacaaag

SEQ ID NO: 94454 - DNA, 50 bp, homo sapien
cagatctcctgagagcttaggggacrgatcaataaccaaatgtttataac

SEQ ID NO: 94455 - DNA, 50 bp, homo sapien
ggaagtgctacgtatagaatccggaraacagagcctttgcagactaactg

SEQ ID NO: 94456 - DNA, 50 bp, homo sapien
taaatattggacagaggtaactgtgkccaagattcaagaaggttaaagaa

SEQ ID NO: 94457 - DNA, 50 bp, homo sapien
gaatattcatgttttgaagtacaaartacatagtgataatggtggtgatg

SEQ ID NO: 94458 - DNA, 50 bp, homo sapien
tgtccaaataacattactttatgaaygcaagatgcagtactttctgtgcg

SEQ ID NO: 94459 - DNA, 50 bp, homo sapien
gcctatgttaaattgcctttcatgckatcatctcatacagttacctggat

SEQ ID NO: 94460 - DNA, 50 bp, homo sapien
ctaacattctatcatttctgcagttmttaaaagttatgttcttcaaagtg

SEQ ID NO: 94461 - DNA, 50 bp, homo sapien
ggggtctgtgcagggtacatccaggraagtcttatttattttgggtatgg

SEQ ID NO: 94462 - DNA, 50 bp, homo sapien
cttaatgatcatgagaagactactgmattagaacatagactctctggatt

SEQ ID NO: 94463 - DNA, 50 bp, homo sapien
tgtttctcaaaacaaaatcaaaattsaactatcatatgatcaagcaatac

SEQ ID NO: 94464 - DNA, 50 bp, homo sapien
gttttgtttccctaaacacttaaaaktccctcacagtagctgcttaaaat

SEQ ID NO: 94465 - DNA, 50 bp, homo sapien
gcagcctgttagttgaagataggacrgatcactttggttaacttttagct

SEQ ID NO: 94466 - DNA, 50 bp, homo sapien
ctgggcgattaagacagggaataaakaaacactgatagaaagtagttacc

SEQ ID NO: 94467 - DNA, 50 bp, homo sapien
aattatagtgactgtgaatatacaargtttctgaaagtactgtgaagttg

SEQ ID NO: 94468 - DNA, 50 bp, homo sapien
gatattataaccatgttattgcaaaygttgtatatgtgaatttctgaata

SEQ ID NO: 94469 - DNA, 50 bp, homo sapien
ttccttagtctcataatgatgtaacrgaagagtcaccaatgtttgagata

SEQ ID NO: 94470 - DNA, 50 bp, homo sapien
attgaagctaaagagacaaacacaaktgagtggtgaaagtggtggttgca

SEQ ID NO: 94471 - DNA, 50 bp, homo sapien
gtcagatgctcagaatacaggaaaaygatgaaggagacaatgactccacc

SEQ ID NO: 94472 - DNA, 50 bp, homo sapien
attcttttcatacatgcatattcaayctcccaatgtttggagatgggtgc

SEQ ID NO: 94473 - DNA, 50 bp, homo sapien
tgtatgtgaggtattattattattcrctaaaccaaggaagacaaacaaag

SEQ ID NO: 94474 - DNA, 50 bp, homo sapien
ttaaaaactcaatacaaaactaagayggtctccagatacaaggatgtaat

SEQ ID NO: 94475 - DNA, 50 bp, homo sapien
gagtcacatgaattataggtttcaaytcagcaagtctttggaaaagctgg

SEQ ID NO: 94476 - DNA, 50 bp, homo sapien
ggggtgagggtaataagctccttaartgattcctgatcccagctgcactg

SEQ ID NO: 94477 - DNA, 50 bp, homo sapien
attttaatgctgatctgagagggtaratgagggaagcatagtgggcctat

SEQ ID NO: 94478 - DNA, 50 bp, homo sapien
tcagtttatggagcttctgagctaawtgaccaatagattttttttttttt

SEQ ID NO: 94479 - DNA, 50 bp, homo sapien
cttagtactcaagttaggactcccartggattaccctgtgtaaggcccta

SEQ ID NO: 94480 - DNA, 50 bp, homo sapien
agtaagcctccctgagcagagagcamaagggaatactcaaggagaagcac

SEQ ID NO: 94481 - DNA, 50 bp, homo sapien
acactgtttttcttttatttgttaayggcgttcatgatacccatggttat

SEQ ID NO: 94482 - DNA, 50 bp, homo sapien
tacataaacatacataaatgtctagsagaattgatgttgaattaatagag

SEQ ID NO: 94483 - DNA, 50 bp, homo sapien
cagaatatcagagtcttcaaaaggayaaaattataagcactgaatttgac

SEQ ID NO: 94484 - DNA, 50 bp, homo sapien
agaaataacctaaacttttacaatgrtggcagaattggtcattttgaaga

SEQ ID NO: 94485 - DNA, 50 bp, homo sapien
tgaatgctgcagtgagtaatttctaygcatattgttctgaaccatagttt

SEQ ID NO: 94486 - DNA, 50 bp, homo sapien
tgagcccaggattaggggaagaatawgtgagttcaagggctgagctgggt

SEQ ID NO: 94487 - DNA, 50 bp, homo sapien
atggatcttccttggaaccagtctgrataggaggatacaggagaagacat

SEQ ID NO: 94488 - DNA, 50 bp, homo sapien
gatgggtgggtttggggcatcgtgamtctccctagtgatcagggagaagc

SEQ ID NO: 94489 - DNA, 50 bp, homo sapien
aagacaaacattatcagagaaaatartatgcctcaaagacccagctgaat

SEQ ID NO: 94490 - DNA, 50 bp, homo sapien
acagagagaagcagacctagttatcyaattcttaaaatctttaaaagcca

SEQ ID NO: 94491 - DNA, 50 bp, homo sapien
taaaattcctggattgggttagatgkagattcaagtcccatctactccta

SEQ ID NO: 94492 - DNA, 50 bp, homo sapien
agtagaaagactacataggtgctaaraatgaggaaggagcccaagtggtg

SEQ ID NO: 94493 - DNA, 50 bp, homo sapien
ctgctgtacagcaagattcatgcaaragtctacattttctgctttcaagt

SEQ ID NO: 94494 - DNA, 50 bp, homo sapien
atgaatctacaatcgtcataaaacargtaggtgtggaaaaaagccacccc

SEQ ID NO: 94495 - DNA, 50 bp, homo sapien
agttacctggaaacacaaacgaaaaygaatgagaggaagatgaagaatag

SEQ ID NO: 94496 - DNA, 50 bp, homo sapien
aggggtttccatttcttggtaatgargaccactgcagtgtgttgggggtg

SEQ ID NO: 94497 - DNA, 50 bp, homo sapien
taataagagaactctgccacttagartcaagaaaatatgagaatacacct

SEQ ID NO: 94498 - DNA, 50 bp, homo sapien
tgagtcaattatattgctattcatcmacttgtgtaagtgcctgaagcaca

SEQ ID NO: 94499 - DNA, 50 bp, homo sapien
ggtactttttctccctcaaataaatragctaaataatgaagctcattcat

SEQ ID NO: 94500 - DNA, 50 bp, homo sapien
tttgcaacccagtttggaagtcacakaatgtcatttctattgtactctgt

SEQ ID NO: 94501 - DNA, 50 bp, homo sapien
aaatatattagtttcaaaatcaataygttatggttcataaatgaattgga

SEQ ID NO: 94502 - DNA, 50 bp, homo sapien
aaattcccagcagtcattttgaaaarcgacacagcacaggaagattttgt

SEQ ID NO: 94503 - DNA, 50 bp, homo sapien
gcattacacttgtagccaaatacaayatagacagtgataatttctttgaa

SEQ ID NO: 94504 - DNA, 50 bp, homo sapien
agcactatagacacattgggattaartcgcttagctctccagatctattc

SEQ ID NO: 94505 - DNA, 50 bp, homo sapien
ctccttttattcccactggcttgtaragaagagaagattgtggtcctcag

SEQ ID NO: 94506 - DNA, 50 bp, homo sapien
atttattctgtctgttcccttaatcsatctacaccctgctaacctcctga

SEQ ID NO: 94507 - DNA, 50 bp, homo sapien
gacccctccattttgacagctacagmaacatgaaattcacttgtccagtt

SEQ ID NO: 94508 - DNA, 50 bp, homo sapien
gcagaatgaaaagctacatattagarcatcatagaataacttgaaattca

SEQ ID NO: 94509 - DNA, 50 bp, homo sapien
cttgtgccctcttacatacagatgcmaagatggaattaggtgtacaagag

SEQ ID NO: 94510 - DNA, 50 bp, homo sapien
cttgcaactaatgtaaactacctcaraataagagtcaactaagagtaccc

SEQ ID NO: 94511 - DNA, 50 bp, homo sapien
tcccctgcatgttcctgcaaacagastcaagttagaatggtatttagttg

SEQ ID NO: 94512 - DNA, 50 bp, homo sapien
cttcaaaattgtgtttctagcaactyactttaacttatgaacccttcatt

SEQ ID NO: 94513 - DNA, 50 bp, homo sapien
gttgagtagaccactacggtatggaygtaccatagtttagtcattcttcc

SEQ ID NO: 94514 - DNA, 50 bp, homo sapien
ggccattggtactcaaatgttagcastagttctgtgaaatgtcacaatac

SEQ ID NO: 94515 - DNA, 50 bp, homo sapien
ttccaataatcttggcgaattgttayactgtaaactcagaaaattaacat

SEQ ID NO: 94516 - DNA, 50 bp, homo sapien
ttagacacattcatcctgcaaacackgagtattctgttcattattctagt

SEQ ID NO: 94517 - DNA, 50 bp, homo sapien
aagggctgaaattcatgattgaaagmctggaaatatttttgtgctttcca

SEQ ID NO: 94518 - DNA, 50 bp, homo sapien
aaaatgaaaccagtctcatccatatyattgtcactgatacaagtgcattt

SEQ ID NO: 94519 - DNA, 50 bp, homo sapien
tagagaggagcaaggtagtggttaaygaaataatacaaatttcaccataa

SEQ ID NO: 94520 - DNA, 50 bp, homo sapien
acaagattacctgagaatgtcattamcaattttatcgtttcaattcagaa

SEQ ID NO: 94521 - DNA, 50 bp, homo sapien
gaggtaagttattttatctcttttcrctttaagtcatataaatgcagagt

SEQ ID NO: 94522 - DNA, 50 bp, homo sapien
ttatacttttattcaaattttagcawctttaatatatagtactgtgccct

SEQ ID NO: 94523 - DNA, 50 bp, homo sapien
tctgactcttccaactccataaatamattctgaaaagacatgaaagaagg

SEQ ID NO: 94524 - DNA, 50 bp, homo sapien
cacgtacatcgaaaatttatcaaccwacatcctaaaatattttcaaagta

SEQ ID NO: 94525 - DNA, 50 bp, homo sapien
aaattggctcaaataacatcaacacycgtaatgccaatggccaaactcta

SEQ ID NO: 94526 - DNA, 50 bp, homo sapien
gactggagcatttagttgtagtaagragtctaacgatgacatagttccag

SEQ ID NO: 94527 - DNA, 32 bp, homo sapien
tagagcaagaacaattmgtggcatgagcccat

SEQ ID NO: 94528 - DNA, 50 bp, homo sapien
gttatgaacattcacatgcagaagaytcactattgtttttcattcacaag

SEQ ID NO: 94529 - DNA, 50 bp, homo sapien
tttctgccaactagcacgctctctgratgtagtagtaggcactaaataca

SEQ ID NO: 94530 - DNA, 50 bp, homo sapien
ccattagaattgcccaaagctgaagyagactgattgttccctgtctttgg

SEQ ID NO: 94531 - DNA, 50 bp, homo sapien
tttaaaaaggtgagtgatatataagycagtaggagtagtactatgagaaa

SEQ ID NO: 94532 - DNA, 50 bp, homo sapien
ttaatgtagaacctgatgacactgartaggaccatgatttatttctaagt

SEQ ID NO: 94533 - DNA, 50 bp, homo sapien
ttcagtggtgtctgaaagaacactakatcaattcaggtgaactacattct

SEQ ID NO: 94534 - DNA, 50 bp, homo sapien
caaatgtcacttcttcgctctatagragttcacccaatcctccttataac

SEQ ID NO: 94535 - DNA, 50 bp, homo sapien
atgagcagaaaatttacatggaaaamtatggttataaggttataatggtt

SEQ ID NO: 94536 - DNA, 50 bp, homo sapien
acaagaggaagggaaaggatgcaaaygataacactacagaaatccaccaa

SEQ ID NO: 94537 - DNA, 50 bp, homo sapien
tccatcagaaagtcgttatttctccrctgtcagagatcctgtcctgaata

SEQ ID NO: 94538 - DNA, 50 bp, homo sapien
gcctgatctaagagaacccctatgayagattaaccattataaattcctag

SEQ ID NO: 94539 - DNA, 50 bp, homo sapien
gagaaaagctactccttattccaggraagttaaaaatcaactcagaagta

SEQ ID NO: 94540 - DNA, 50 bp, homo sapien
agaagctgttaacagaatgtatctayctttaagggaaagagtataatgtg

SEQ ID NO: 94541 - DNA, 50 bp, homo sapien
atagaacagctattgtgtaccatgcragccttagtaaatgtacatagata

SEQ ID NO: 94542 - DNA, 50 bp, homo sapien
tatcctaagaatatttaagagaagtwtgcaagaattcagaacatttggat

SEQ ID NO: 94543 - DNA, 50 bp, homo sapien
catttgaataaataggtctgatctcrctagcaagattaaatggttcacca

SEQ ID NO: 94544 - DNA, 50 bp, homo sapien
gggggaccaatgatacccaaatattsatttcatggacataagcctgaaat

SEQ ID NO: 94545 - DNA, 50 bp, homo sapien
tatttgttcttctgggtggtacaacraatgatgaaaccaaagcaaaatct

SEQ ID NO: 94546 - DNA, 50 bp, homo sapien
tgctgtgtgcctcctctaagtggaawccacaagcctcccacccaactcac

SEQ ID NO: 94547 - DNA, 50 bp, homo sapien
cccctccccaggctgagtaagtcacraagttagttcatgactcttcccta

SEQ ID NO: 94548 - DNA, 50 bp, homo sapien
aattagagaggtaatctgttaataayggaggattgccatttgacagctgg

SEQ ID NO: 94549 - DNA, 50 bp, homo sapien
ttttttaatcaatccatgtgaaccaytgcgggattttgagagtcactctt

SEQ ID NO: 94550 - DNA, 50 bp, homo sapien
ttttttgcatattagaacaacatcartgaaatattttacctgaatgatct

SEQ ID NO: 94551 - DNA, 50 bp, homo sapien
gatttatacaatgagaatgttatcartagtgagctgctcagagtgttctg

SEQ ID NO: 94552 - DNA, 50 bp, homo sapien
tgcagtaatctgatgctctgaagccragtttcttaataatgaatgtatga

SEQ ID NO: 94553 - DNA, 50 bp, homo sapien
gtggttgggatacaaatcttgaatarccatctattgtggccaccatagtc

SEQ ID NO: 94554 - DNA, 50 bp, homo sapien
gtgatttcagccagaggaggactaaygccttccatttaatagtataattc

SEQ ID NO: 94555 - DNA, 50 bp, homo sapien
accaactcttacctaccctctgtcartaacttactaattagaatccctgt

SEQ ID NO: 94556 - DNA, 50 bp, homo sapien
gaattgattgaggggctgtgactttygctgattcaagttagaccatttac

SEQ ID NO: 94557 - DNA, 50 bp, homo sapien
taacaaaaagtgtggtcagtgacccrgaatcatgaagctttgtccaatct

SEQ ID NO: 94558 - DNA, 50 bp, homo sapien
atcccaggagaaataattaaagtcaygctgattcgggtaacatatgggac

SEQ ID NO: 94559 - DNA, 50 bp, homo sapien
ttatacatatttctacaacaaatatkaaagcacattacaggctaaaagca

SEQ ID NO: 94560 - DNA, 50 bp, homo sapien
atctttgggaaagagaagggatgccragagttatagacagaggtgcaatt

SEQ ID NO: 94561 - DNA, 50 bp, homo sapien
gggggaacgctgtattttctcacacmagactctgtaacctggcattcaca

SEQ ID NO: 94562 - DNA, 50 bp, homo sapien
cactgatttaatcatttatagtgaayatatgttgagccactactaagttc

SEQ ID NO: 94563 - DNA, 50 bp, homo sapien
aaaaaataagcaatataaagatacarcaaaatctggcaagatcatatgta

SEQ ID NO: 94564 - DNA, 50 bp, homo sapien
caatcaaggactatgaggctaaggcratttcctggagagcacacgtgttg

SEQ ID NO: 94565 - DNA, 50 bp, homo sapien
ggtcattttattgttttgttttgaastcaagtggcagacatagacactgg

SEQ ID NO: 94566 - DNA, 50 bp, homo sapien
tacttgaacccaacttatgcttaaakattgaaacatttaccaaatatctt

SEQ ID NO: 94567 - DNA, 50 bp, homo sapien
gcagtaaaataaaacatatcatccakagaccagaatatttagtcgtctgg

SEQ ID NO: 94568 - DNA, 50 bp, homo sapien
tgtctactcttggagcccatcaaaartaatcttcaagtctgttatagtat

SEQ ID NO: 94569 - DNA, 50 bp, homo sapien
gtgagaggagaagtttctctcataargaaacctccaggcctgtttgaatt

SEQ ID NO: 94570 - DNA, 50 bp, homo sapien
atggaaagcaggtacacaaataagamtcacaatacagtgtgctaggttcc

SEQ ID NO: 94571 - DNA, 50 bp, homo sapien
cagtggtcccacctttaaggatctcsaaggttattacagaacaccctaac

SEQ ID NO: 94572 - DNA, 50 bp, homo sapien
tgaaaggtgttctggtttaacaaaartgtaatgatttagtttatacaatg

SEQ ID NO: 94573 - DNA, 50 bp, homo sapien
gttaatgtgagtacaaatttctttcrcttctgcttcaattcccctttaaa

SEQ ID NO: 94574 - DNA, 50 bp, homo sapien
gtcactgagaagcttttatgactgaycaaatattactcttcaatgcaggc

SEQ ID NO: 94575 - DNA, 50 bp, homo sapien
cctgttttcacattctagttaaacaygctgggaaattgtttttgtaactc

SEQ ID NO: 94576 - DNA, 50 bp, homo sapien
aaagcaaaatggcaaaccaatctgarctagaacctcacatatagagtttt

SEQ ID NO: 94577 - DNA, 50 bp, homo sapien
acttgaaggcttattttgcttcacartaaaataacagctctattattatt

SEQ ID NO: 94578 - DNA, 50 bp, homo sapien
ctctttgtacctgttaaagcctatcraaacatcattacaatctgggtttc

SEQ ID NO: 94579 - DNA, 50 bp, homo sapien
gctaagcttagtggttaaaatagagrataagacattatgaatttatgaag

SEQ ID NO: 94580 - DNA, 50 bp, homo sapien
ggcaagagagaaaaagattagataayggctggtcagtaagcagtcagaac

SEQ ID NO: 94581 - DNA, 50 bp, homo sapien
tagaaggttttgagcaaaggaatgayatgatacaacttacattataaaag

SEQ ID NO: 94582 - DNA, 50 bp, homo sapien
aagcttgtttcttaaacctttgttayatactttaggctttattcattttt

SEQ ID NO: 94583 - DNA, 50 bp, homo sapien
ttctgaattttctttttagtgccaamagagatatggtttttttaaatata

SEQ ID NO: 94584 - DNA, 50 bp, homo sapien
taaggccacaatgcaacctattttasagtattcttaagtatttcactgat

SEQ ID NO: 94585 - DNA, 50 bp, homo sapien
ctcagatcctttaaatgttaggtcargtgaagggtaaggaggcagagcaa

SEQ ID NO: 94586 - DNA, 50 bp, homo sapien
taagaataaaataagatactaggaarttaaacagatttggaaggcggatg

SEQ ID NO: 94587 - DNA, 50 bp, homo sapien
gcaacacagcaagtcttcacagggakaaatcacgtaactcaatattcttt

SEQ ID NO: 94588 - DNA, 50 bp, homo sapien
tatggtctatttgtgagctcacttaygatgtattatgcttagacaacagt

SEQ ID NO: 94589 - DNA, 50 bp, homo sapien
tagttcgtgttgtaagcttcactgascattaagaaattaacaacttatgg

SEQ ID NO: 94590 - DNA, 50 bp, homo sapien
atatcactgtaaccatagcacatgartaagcaagatttagtcagattatt

SEQ ID NO: 94591 - DNA, 50 bp, homo sapien
aggctttttttccttcagcacttcasaaggtggtatgtcatgtcactctt

SEQ ID NO: 94592 - DNA, 50 bp, homo sapien
tacgtacttttgatacaaaagccaartcatactaagataaaacttggatg

SEQ ID NO: 94593 - DNA, 50 bp, homo sapien
gttgaggggaagtatctttctgggcrctattatatacaatacttcaaagt

SEQ ID NO: 94594 - DNA, 50 bp, homo sapien
acagactgctactgggagaagaggcyatctagggctttcataaagaggac

SEQ ID NO: 94595 - DNA, 50 bp, homo sapien
ggatttgggaaatgtgcgttaaaaaygttctgtgtgaggcagagaagtca

SEQ ID NO: 94596 - DNA, 50 bp, homo sapien
aaaatatctagagacattggaggacmactatctataaaattaaggcatag

SEQ ID NO: 94597 - DNA, 50 bp, homo sapien
ctatgctgtacagtaaaaatcaaacrgtagagaatgacgatggcaatgca

SEQ ID NO: 94598 - DNA, 50 bp, homo sapien
taatggtcttctttgttgattttaaygctttcaatttaggagtgctgttc

SEQ ID NO: 94599 - DNA, 50 bp, homo sapien
tgaattaatggaaaagaaggaaagamtattccagctacttggaaattaat

SEQ ID NO: 94600 - DNA, 50 bp, homo sapien
aaactaatgatggatgaacagcttcratgcattaatcactgcattaatta

SEQ ID NO: 94601 - DNA, 50 bp, homo sapien
tgagcctgtaatctcatttctttgcrcccaattgttggctcctggactaa

SEQ ID NO: 94602 - DNA, 50 bp, homo sapien
acgattttatagaaactataaattastaaaatggactgtacaataatgag

SEQ ID NO: 94603 - DNA, 50 bp, homo sapien
gtctggtgactacatgccttgatgayactcgttttgtatagtatgttgca

SEQ ID NO: 94604 - DNA, 50 bp, homo sapien
acttctaatagacttccttgaaccaratagctagaatgatcctgttaaag

SEQ ID NO: 94605 - DNA, 50 bp, homo sapien
attagtacagtcactaatctctctaytaacaccttaaatatctctttgat

SEQ ID NO: 94606 - DNA, 50 bp, homo sapien
atgtttgaaaatgtatatgacttgcraattcacaatatctcaatctcaat

SEQ ID NO: 94607 - DNA, 50 bp, homo sapien
ctaaagtaccaaaggttttatcctcyattgctttcatactatcaatgcaa

SEQ ID NO: 94608 - DNA, 50 bp, homo sapien
acaccttgataagtccttgacaagayagttcaaaaatttcttgaaggtca

SEQ ID NO: 94609 - DNA, 50 bp, homo sapien
ttaatgtattaggacatcagaaaaakactagaccaggtgtcaggagacct

SEQ ID NO: 94610 - DNA, 50 bp, homo sapien
ctcagctgcattctgtgccttgaaaytggcattgttcatagttagagaac

SEQ ID NO: 94611 - DNA, 50 bp, homo sapien
gttttggaactacggtaagatttggyatgaggctccaactttgacatgtg

SEQ ID NO: 94612 - DNA, 50 bp, homo sapien
agactgtcacaaacttcttacactaygttgacgtacctggagaacagggg

SEQ ID NO: 94613 - DNA, 50 bp, homo sapien
tcctgcagagatagaactgtatcaakaattcaggattccgactaatgccc

SEQ ID NO: 94614 - DNA, 50 bp, homo sapien
cttttaggactcctgtctctcacacrtataattttttaaaacttgctcac

SEQ ID NO: 94615 - DNA, 50 bp, homo sapien
aagcacagatttcctgtcaagccctkactgaacctcccttctagaaataa

SEQ ID NO: 94616 - DNA, 50 bp, homo sapien
gatgtgtcctgcttgctcttttgagscatgataaaggaacattgtaacag

SEQ ID NO: 94617 - DNA, 50 bp, homo sapien
ggagaaaacaaaaagccattttacargacaatttgaaggatcacagtctg

SEQ ID NO: 94618 - DNA, 32 bp, homo sapien
gtctcaggaggactcayaatgatagaatagcg

SEQ ID NO: 94619 - DNA, 50 bp, homo sapien
acagcctgataggtcttcaagacacrgtcatcatcaatgaatatgtgcca

SEQ ID NO: 94620 - DNA, 50 bp, homo sapien
agcaatcagaggaattggtgagtgayattttacaattcctttcttaatgt

SEQ ID NO: 94621 - DNA, 50 bp, homo sapien
caaatatgctcctgacattcttaaaytatttcctttagatctgacactct

SEQ ID NO: 94622 - DNA, 50 bp, homo sapien
ttcttttgtatcattccttatttcakccagtcacttgccagtattctcaa

SEQ ID NO: 94623 - DNA, 50 bp, homo sapien
atttgcataaattagtcatgggcccsccaattcaatgaaagaggaaaaga

SEQ ID NO: 94624 - DNA, 50 bp, homo sapien
ccaacaaaccacatagaaccaggaasccaatcttcaaaaagacatttaca

SEQ ID NO: 94625 - DNA, 50 bp, homo sapien
gatggtgacccatcaagataagacayagtgaactcagtatggggatacat

SEQ ID NO: 94626 - DNA, 50 bp, homo sapien
acttattttaagtagaattcccaagmctaaaatgtcaaatatgaagaagc

SEQ ID NO: 94627 - DNA, 50 bp, homo sapien
ataatgagagagggaatgtaggtaawccaatgaaagtgttagtgagcagg

SEQ ID NO: 94628 - DNA, 50 bp, homo sapien
ttacaagagtctctacagtgaaaacyctacagctgagatagatttgtgtt

SEQ ID NO: 94629 - DNA, 50 bp, homo sapien
ttttttgggagaccgaacaacaagayggaaacacataatcataaattcct

SEQ ID NO: 94630 - DNA, 50 bp, homo sapien
cactagagcaaagtgaccaatggacraaaactaaggttgggtactcagag

SEQ ID NO: 94631 - DNA, 50 bp, homo sapien
tcagaaaagtaagtgttaacccaggractcaagtacctaactgaatttaa

SEQ ID NO: 94632 - DNA, 50 bp, homo sapien
ctctgcttactttcatctaccaaaartgtttcttataaagcctacaaggg

SEQ ID NO: 94633 - DNA, 50 bp, homo sapien
tgtgaagaaatctgtttttcagatargaataatgaatgtgctaattgtaa

SEQ ID NO: 94634 - DNA, 50 bp, homo sapien
ctcccatatagttaccagttctaccmattggacaacacagatctagatat

SEQ ID NO: 94635 - DNA, 50 bp, homo sapien
aagaaaatgtttcatgaagaaagagyatatagcactgtcagtagcttaag

SEQ ID NO: 94636 - DNA, 50 bp, homo sapien
gctatttccaatttgaaatggaatarctgagattgtaaataattttttta

SEQ ID NO: 94637 - DNA, 50 bp, homo sapien
taaatagcccaaggattcgggcatamcagattaaatatattttgtgatga

SEQ ID NO: 94638 - DNA, 50 bp, homo sapien
tattgtcacatgcacgagtaacttcyattagagagcagcttaggaacctg

SEQ ID NO: 94639 - DNA, 50 bp, homo sapien
agagccaacttcttttcaggatttayctatttttagaacacaaaaggcac

SEQ ID NO: 94640 - DNA, 50 bp, homo sapien
tttacctattgatcctctgacgaaaygcaatggtaagctgtgctaagtaa

SEQ ID NO: 94641 - DNA, 50 bp, homo sapien
tgctcttatcataaaaacatctataygaacaacaaaaatataaacaaaga

SEQ ID NO: 94642 - DNA, 50 bp, homo sapien
gcttattctccttcctagaaagaackgaattgatttgcactagcctgatt

SEQ ID NO: 94643 - DNA, 50 bp, homo sapien
caactttcagggtgggtcaaaactcyaccaagtgctactagcccaaatct

SEQ ID NO: 94644 - DNA, 50 bp, homo sapien
cacctacacatctatgcaacaagtargaagtttctaggactcactagaga

SEQ ID NO: 94645 - DNA, 50 bp, homo sapien
aactaatattttaagaaaacttcagsaagcgatagtatacagtcatcccc

SEQ ID NO: 94646 - DNA, 50 bp, homo sapien
cactgcacaggttttggttcagttcyaattccctgagaggtttttatcct

SEQ ID NO: 94647 - DNA, 50 bp, homo sapien
aaactggaactgagggattgcaaaargattctaaacagagatatagagat

SEQ ID NO: 94648 - DNA, 50 bp, homo sapien
gtaactgaccataacaggatttgcamctgacaggcttggctggtacccta

SEQ ID NO: 94649 - DNA, 50 bp, homo sapien
aggattatgttgtactacgtaactaygacatggtactcgagtctgaggtg

SEQ ID NO: 94650 - DNA, 50 bp, homo sapien
tgtgtctttcacctgtccagtccaarcagacaaatgtcttgaaagccaaa

SEQ ID NO: 94651 - DNA, 50 bp, homo sapien
ctgccctcaactcatggtttctgcaytgaaaaacgtgaaattgagattgt

SEQ ID NO: 94652 - DNA, 50 bp, homo sapien
agacataaattgtgctgctaataccratatgtgcagctggcatttctatt

SEQ ID NO: 94653 - DNA, 50 bp, homo sapien
ggtttatccaaaaagacagatatcarctgcaacttctattcacccttcaa

SEQ ID NO: 94654 - DNA, 50 bp, homo sapien
tcattgatatataaagcatgctactrctaatcaattagttttatgtatta

SEQ ID NO: 94655 - DNA, 50 bp, homo sapien
aacaattgagattatagatggtctcyaatttatgaaggttcaacttagat

SEQ ID NO: 94656 - DNA, 50 bp, homo sapien
ttttcctgaaactataagtttgagayatattagaagaagaatgtgggcaa

SEQ ID NO: 94657 - DNA, 50 bp, homo sapien
tcatttctttaaatgcatgacataartacgtttttttctgttctattgat

SEQ ID NO: 94658 - DNA, 50 bp, homo sapien
catgcctgtggagtgtttcagtctaygttccaagaagcaacagtgaacac

SEQ ID NO: 94659 - DNA, 50 bp, homo sapien
ttcttccagggagctttgattcccaygcctagtaaatgatctccccgaca

SEQ ID NO: 94660 - DNA, 50 bp, homo sapien
aatgaccattttaacaatatttaagygtacaattcagcagcattatatat

SEQ ID NO: 94661 - DNA, 50 bp, homo sapien
catccattcataccacgaacaggtgwtaggtcctttctctttggttccta

SEQ ID NO: 94662 - DNA, 50 bp, homo sapien
ctttatcttcttaaggcttctgagtrccttagcctttcttagtggctaca

SEQ ID NO: 94663 - DNA, 50 bp, homo sapien
atactcagatgctgttaataacttcmagggtgaattgtttcctcattccc

SEQ ID NO: 94664 - DNA, 50 bp, homo sapien
tttatttaacattagttagcacccaytctttttttcagatatagaaccta

SEQ ID NO: 94665 - DNA, 50 bp, homo sapien
gtagtctagatcattgtgataatgargcccataacttgaaaaagtttgat

SEQ ID NO: 94666 - DNA, 50 bp, homo sapien
ttaagtaaaacagacataatagtaaygatagcagctacttcatagagtct

SEQ ID NO: 94667 - DNA, 50 bp, homo sapien
tatgaccaaaataaatatagaatgawgaacatactgcagtaataatagac

SEQ ID NO: 94668 - DNA, 50 bp, homo sapien
gtggtgttttagctcgtgcatcacargatgactaaactcctgagtcacca

SEQ ID NO: 94669 - DNA, 50 bp, homo sapien
aactgaggtatagtttgaaaaatccrgatacaagttttagatactttgac

SEQ ID NO: 94670 - DNA, 50 bp, homo sapien
tggcagaaatgtgcacatatttgaayctggcatgtgtcatttgtaaaagt

SEQ ID NO: 94671 - DNA, 50 bp, homo sapien
actaaaaacctgagacttctgcttgwatcatttagttctagcaatccatg

SEQ ID NO: 94672 - DNA, 50 bp, homo sapien
aagtaaaaataaatctgatgtattaycaagccaaaaatttatttacttac

SEQ ID NO: 94673 - DNA, 50 bp, homo sapien
ggacagtaaggagagggcttgtcackgctagatctatgccactaccttct

SEQ ID NO: 94674 - DNA, 50 bp, homo sapien
ttttgtttgtttgtttgtttagcaartacattccttatatacatttattt

SEQ ID NO: 94675 - DNA, 50 bp, homo sapien
ggatttatttatgggggtctccttckccactgaagatcattctagaggga

SEQ ID NO: 94676 - DNA, 50 bp, homo sapien
taagtttatatttcactatttttcgyatttcttggacttattccttcaaa

SEQ ID NO: 94677 - DNA, 50 bp, homo sapien
atatcattcttatctttgacatgctyagcacaaatagcacacttttgaag

SEQ ID NO: 94678 - DNA, 50 bp, homo sapien
gaagtataggcattcctaatggtcaygaaagttaaaaacaagaaggtctc

SEQ ID NO: 94679 - DNA, 50 bp, homo sapien
ttagtataattaattgttgaaaataygtataattgttgaaaatatgctgt

SEQ ID NO: 94680 - DNA, 50 bp, homo sapien
aaaaccaaatgaatcaaaggatataraagtaatttgtaaactgtagatca

SEQ ID NO: 94681 - DNA, 50 bp, homo sapien
acttgcttttttccactcattgttayatttttgagctcacccatattgat

SEQ ID NO: 94682 - DNA, 50 bp, homo sapien
ttttgcatcttcttgtctaattaaamtaccaacagagaatgccagttatc

SEQ ID NO: 94683 - DNA, 50 bp, homo sapien
ggtctctaccactctctgaagataarcaataggcatttatttattcattc

SEQ ID NO: 94684 - DNA, 50 bp, homo sapien
aacacacatacacatatatgcatacrcattcgtagagggaagtttttcaa

SEQ ID NO: 94685 - DNA, 50 bp, homo sapien
agccagtaaataaaggctgcacttaycaaaaatattatctgctcagcagc

SEQ ID NO: 94686 - DNA, 50 bp, homo sapien
taaggtggagaggctctttctggcayagtgtccaaagtgataaagaaaaa

SEQ ID NO: 94687 - DNA, 50 bp, homo sapien
cctgaaaggctgccagttttgagtcsagaacaggagaaggcactgcaata

SEQ ID NO: 94688 - DNA, 50 bp, homo sapien
tgaccacctaaagcaatcaacaaacyagtattcatggtctactttgcgtt

SEQ ID NO: 94689 - DNA, 50 bp, homo sapien
ggcgaaagtcaggaagagcccacagstttcaaatttataagtgatgaata

SEQ ID NO: 94690 - DNA, 50 bp, homo sapien
tgagactagatggattagtgacagtraccctaaaaagaaagagttcaggc

SEQ ID NO: 94691 - DNA, 50 bp, homo sapien
ttgaaggtagctacctaacccgctcraccctttcagtctttctactggat

SEQ ID NO: 94692 - DNA, 50 bp, homo sapien
aggtttcaaacctagaggattcttayataatgctgagtgatttgtggata

SEQ ID NO: 94693 - DNA, 50 bp, homo sapien
cattttttacatgaaattgagaaaaytgatttaaattaaaactctttaaa

SEQ ID NO: 94694 - DNA, 50 bp, homo sapien
gaggcgaaagtaattaagaagggaaycgattaggtgagaatctccaatgg

SEQ ID NO: 94695 - DNA, 50 bp, homo sapien
tgaaatgcatttatctttggtgcaarttattttattgtctcttctcatac

SEQ ID NO: 94696 - DNA, 50 bp, homo sapien
gtgcaagttattttattgtctcttcycatacctcttatccatttttttgc

SEQ ID NO: 94697 - DNA, 50 bp, homo sapien
tagccattgtgggattctagcctctygtctttcattaaacctctaaagtt

SEQ ID NO: 94698 - DNA, 50 bp, homo sapien
atcagtttcctattacttctgtaacmaattgccagaaacttagaggctta

SEQ ID NO: 94699 - DNA, 50 bp, homo sapien
ctgctgtctgatactatttaatttarggaatcaaatgttccaagttataa

SEQ ID NO: 94700 - DNA, 50 bp, homo sapien
tgtcacaaccacacattaaggtaggyactatcatattagccctactctgt

SEQ ID NO: 94701 - DNA, 50 bp, homo sapien
tcttcagggcagaatcagtccaagargcatacatagtgtggaagttgtta

SEQ ID NO: 94702 - DNA, 50 bp, homo sapien
gattaaatagtttatctgactcataygactgcagtttctttcggcctcat

SEQ ID NO: 94703 - DNA, 50 bp, homo sapien
tatgagtcagataaactatttaatcyacgctttgtctgaaaggacataaa

SEQ ID NO: 94704 - DNA, 50 bp, homo sapien
aatcttagcaagatcctaactgtacrggaatgaaacaagtatatagaatc

SEQ ID NO: 94705 - DNA, 50 bp, homo sapien
ataatgttaattattaaatgttctcyataagaggatctgaaggcactgtg

SEQ ID NO: 94706 - DNA, 50 bp, homo sapien
tgggctgctggaaaggtggtacaatrtaacaagaaccactaagaatttgt

SEQ ID NO: 94707 - DNA, 50 bp, homo sapien
tacttcaatgtactctcatattttgmacttctggagaaaatatgtctgcc

SEQ ID NO: 94708 - DNA, 50 bp, homo sapien
ttcattaaggtttgggaattcaatgwcacagctgtatgaggtaccattga

SEQ ID NO: 94709 - DNA, 50 bp, homo sapien
tgataccgacatacactcaactgatyagattttaatttagcaagcatcat

SEQ ID NO: 94710 - DNA, 50 bp, homo sapien
atttttgtggatttcacttgtcttcmatttagaaagctctatatttccat

SEQ ID NO: 94711 - DNA, 50 bp, homo sapien
tgtaacagcttaaaacactgcattayatacacattattatagaaattcct

SEQ ID NO: 94712 - DNA, 50 bp, homo sapien
gagagatgaagactaacaagaaaagragactaagtggctttgccccaaaa

SEQ ID NO: 94713 - DNA, 50 bp, homo sapien
agtcagtaaagttaaaaaaaatgcartacttcctgaaattgagcaatcac

SEQ ID NO: 94714 - DNA, 50 bp, homo sapien
aaacaaagtgactatcttactattaygaaaggatactattgaagattttt

SEQ ID NO: 94715 - DNA, 50 bp, homo sapien
cagcgaactaactggcatgataaaarctgtataaatgagaagttacatgt

SEQ ID NO: 94716 - DNA, 50 bp, homo sapien
acagggcaaattctgggctcaacaayagtaagtaggcttgtcacttctat

SEQ ID NO: 94717 - DNA, 50 bp, homo sapien
ttacatatgaagccagtactcaaaawaaaaaatcaaagtccataatcttt

SEQ ID NO: 94718 - DNA, 50 bp, homo sapien
tgctgtcttcttccacaggtatggcracaatttctttcacaagctactca

SEQ ID NO: 94719 - DNA, 50 bp, homo sapien
actttatctctcatattacattttaycttacacaccttttagatcctgtt

SEQ ID NO: 94720 - DNA, 50 bp, homo sapien
ccaaagaccctagtatattttcctarcttctagtcaggaccccaggagtg

SEQ ID NO: 94721 - DNA, 50 bp, homo sapien
caccagcaaatgattttaaattgtcraagtgattcaacagtatcatccaa

SEQ ID NO: 94722 - DNA, 50 bp, homo sapien
ggaaataaatataagcatcatagagwatagaagcttaatatgaggcacca

SEQ ID NO: 94723 - DNA, 50 bp, homo sapien
tgaagtacagatcacagacgaaacaygcataaatggtggaaacaatgggt

SEQ ID NO: 94724 - DNA, 50 bp, homo sapien
gtgttacaaggaggagggaatactcrcctgactatttacccattgtttcc

SEQ ID NO: 94725 - DNA, 50 bp, homo sapien
aagaaacactttaaactctgaaggaractttttaagtaatatagacacaa

SEQ ID NO: 94726 - DNA, 50 bp, homo sapien
cttcagagtttaaagtgtttcttcawaagattgccaggttcagcctgggc

SEQ ID NO: 94727 - DNA, 50 bp, homo sapien
aagcccacatttttgctgttagggaygtagaattatgtgattctatactt

SEQ ID NO: 94728 - DNA, 50 bp, homo sapien
catttacccaataaacggtcctataragcatatcaaatagtttgctaatt

SEQ ID NO: 94729 - DNA, 50 bp, homo sapien
cagcagaattgttttgaatgcatttyggccatgaggttaaagctctccac

SEQ ID NO: 94730 - DNA, 50 bp, homo sapien
ctatgagtcttaagaactgttctacraggaccttaaagataatattaaaa

SEQ ID NO: 94731 - DNA, 50 bp, homo sapien
ccactgtccactgtcttctcaatgaygctatttctactacagtccttcct

SEQ ID NO: 94732 - DNA, 50 bp, homo sapien
gagctcatagcgatagaatttgaccyacattgctaaaatgccaagtttgt

SEQ ID NO: 94733 - DNA, 50 bp, homo sapien
ttctaaatctgccaatcctacaaaamagacaatttgatgagagaaaaagg

SEQ ID NO: 94734 - DNA, 50 bp, homo sapien
aatttagaaaaggatgctcagttaasctgaatgtcaaataaacaatgaat

SEQ ID NO: 94735 - DNA, 50 bp, homo sapien
gcacagtcattttgtggaaacttaayagacagactcgaaaattccaagga

SEQ ID NO: 94736 - DNA, 50 bp, homo sapien
tatcccagccaaactctctacattaygcaacaacaagaactacaaagaaa

SEQ ID NO: 94737 - DNA, 50 bp, homo sapien
taggaatcccggtctctataaggatmaacgaaattttgaagacttgctat

SEQ ID NO: 94738 - DNA, 50 bp, homo sapien
aggaaaagctggtatttggagaaatrattgtaactattaaatatattcta

SEQ ID NO: 94739 - DNA, 50 bp, homo sapien
gtgaatgttgaatgtgaaagttgaawcctaccaaatctctcctttgtcca

SEQ ID NO: 94740 - DNA, 50 bp, homo sapien
ctttccacagagtcaggcaactataytattatgccaaatagtgtggattc

SEQ ID NO: 94741 - DNA, 50 bp, homo sapien
aggtaagtattagggagtgaggatgsaaaaatagaaaatgtccagaacag

SEQ ID NO: 94742 - DNA, 50 bp, homo sapien
agtagagtgagcccttaatctaatayaacatggatctttataagaaaagg

SEQ ID NO: 94743 - DNA, 50 bp, homo sapien
aaccttcattaacccagttaccatarctaagtattcacctctcaaataac

SEQ ID NO: 94744 - DNA, 50 bp, homo sapien
catattctgttggtcaatcaatcacmaggagatctcagattcataaggag

SEQ ID NO: 94745 - DNA, 50 bp, homo sapien
aaccttcatagttttttgctgtttgwtttatatgaaagtggttttcctgt

SEQ ID NO: 94746 - DNA, 50 bp, homo sapien
ttgggtcctcatgtttttttgtctcrtggttacattatggctgccatagc

SEQ ID NO: 94747 - DNA, 50 bp, homo sapien
tcaaaagatgggaaattgtaaccaartgttgaaatatgataattaactcc

SEQ ID NO: 94748 - DNA, 50 bp, homo sapien
tctcatgaatagaaatttatgtagamgcaaacaaaatacttttacccact

SEQ ID NO: 94749 - DNA, 50 bp, homo sapien
agtatttccacttaaatttgacaacrgcactgatggattcttaaattgaa

SEQ ID NO: 94750 - DNA, 50 bp, homo sapien
ccaagcattttatagatcaggacaaygtaagtaacttatgaaatgagtta

SEQ ID NO: 94751 - DNA, 50 bp, homo sapien
cattgacacagggatatacatttctkaaaactctatagagcacaataaaa

SEQ ID NO: 94752 - DNA, 50 bp, homo sapien
caggatattgacccatcgattcccastatgtaaagtcctttctaagacag

SEQ ID NO: 94753 - DNA, 50 bp, homo sapien
ttgcctatcaagtcttctgttttcaygctcttatgtcctctctcttctcg

SEQ ID NO: 94754 - DNA, 50 bp, homo sapien
atataattataccccccaacttttcratgagtccttagcagatggacaga

SEQ ID NO: 94755 - DNA, 50 bp, homo sapien
gtcatccagctgactcgtttcataaytgtccttcccacggctgtcccaat

SEQ ID NO: 94756 - DNA, 50 bp, homo sapien
ctgggatgaagtaagctcaatcatgmagttaaagtgttgctttgaaccaa

SEQ ID NO: 94757 - DNA, 50 bp, homo sapien
gctacgtagactcctgcttaccgcaygattattttgaggaataagtaaag

SEQ ID NO: 94758 - DNA, 50 bp, homo sapien
attattttgttattcgttttcataaygtaaaataagtgatcttttcaata

SEQ ID NO: 94759 - DNA, 50 bp, homo sapien
gctgccaacaggtagatgaaacctasttctagttcgtgttctttgtggtg

SEQ ID NO: 94760 - DNA, 50 bp, homo sapien
tggaagtaagagctacctcttcttgyaaaggacctatttaagcaggaatt

SEQ ID NO: 94761 - DNA, 50 bp, homo sapien
tatatgtaatacaaaaatattttcaygcacatattaatttctatacacta

SEQ ID NO: 94762 - DNA, 50 bp, homo sapien
tttgaggatgcttgcttctcaggcartagccccttcaacacactcttgct

SEQ ID NO: 94763 - DNA, 50 bp, homo sapien
gaaatgcaaaatgattagaagggtcrataaacactttgaaaaagaacaaa

SEQ ID NO: 94764 - DNA, 50 bp, homo sapien
ctgactcctttgtcacaaatcaattwaccattaatgtaacagtttatttc

SEQ ID NO: 94765 - DNA, 50 bp, homo sapien
gaattaaatttttatagaaataagaygtatcattaaagatgtttctttag

SEQ ID NO: 94766 - DNA, 50 bp, homo sapien
ataatcatttatattccaaaacagaytccgaataaaataacaaaatcata

SEQ ID NO: 94767 - DNA, 50 bp, homo sapien
ttgtctgaaaaatggaaaacttaatsagagacagaaattgaaaataaaag

SEQ ID NO: 94768 - DNA, 50 bp, homo sapien
ataaaaaatcaaaagtcaatagtcamctgatactcagtcttgatttagct

SEQ ID NO: 94769 - DNA, 50 bp, homo sapien
tccatttattttaatctgaaaataastgatccaggatttcaaaaagtaga

SEQ ID NO: 94770 - DNA, 50 bp, homo sapien
ttccttctgtctgagtaagaggtcartcatgtaccccattctctgaaaat

SEQ ID NO: 94771 - DNA, 50 bp, homo sapien
agtctagctggactattcactatgasaagaccttaaaatgttttttagtc

SEQ ID NO: 94772 - DNA, 50 bp, homo sapien
agcttctggacagttgaagaggtaayatgaatccaaggttctttttgtat

SEQ ID NO: 94773 - DNA, 50 bp, homo sapien
tactttgcctttgtctaaaagaggaygatggactaaaaaacattttaagg

SEQ ID NO: 94774 - DNA, 50 bp, homo sapien
ctctaacatcatacaaccagttgackaaacttttggacatggcaataaat

SEQ ID NO: 94775 - DNA, 50 bp, homo sapien
ggctgttcagtattcttttgccagarcataccacaattattaatccgttc

SEQ ID NO: 94776 - DNA, 50 bp, homo sapien
cagagcataccacaattattaatccrttcaactgttggtatactttttag

SEQ ID NO: 94777 - DNA, 50 bp, homo sapien
ctacgatgattattcttgtacttttyttttggtggccacaagcacacttt

SEQ ID NO: 94778 - DNA, 50 bp, homo sapien
taagaaattaaaggtcactcttcaawatttctttggacacatttatccac

SEQ ID NO: 94779 - DNA, 50 bp, homo sapien
tgtttagatttctttaatcttatccrtgaccttttttgccccccagcctt

SEQ ID NO: 94780 - DNA, 50 bp, homo sapien
acagtgaatgtatatgctggttagaraaagagagaaggggaaggtgttca

SEQ ID NO: 94781 - DNA, 50 bp, homo sapien
atctgtcattatatctccagccaaastgcctgaagtatctccacacagtg

SEQ ID NO: 94782 - DNA, 50 bp, homo sapien
caattcattggaatgcaaatcacaayattatccaatcctgcctccatatg

SEQ ID NO: 94783 - DNA, 50 bp, homo sapien
atcttcatctaaaaaagtctactaaraattcagtgaatatgcaggattta

SEQ ID NO: 94784 - DNA, 50 bp, homo sapien
tacccttgaaatgagtgaattatgawatgtaaaacatgattccttttatt

SEQ ID NO: 94785 - DNA, 50 bp, homo sapien
atttctatagaacaggcctccacatyatgaagttatgatctcaaagaaat

SEQ ID NO: 94786 - DNA, 50 bp, homo sapien
aacactaatgggtaaaagtttatcargaacagtacatttacatagttcca

SEQ ID NO: 94787 - DNA, 50 bp, homo sapien
tagaaaatagatcaaagtaaataaartggaacactgttgatggattatgg

SEQ ID NO: 94788 - DNA, 50 bp, homo sapien
agagttatgcctcttagaattactayaatctataacgtctgagctctgtt

SEQ ID NO: 94789 - DNA, 50 bp, homo sapien
cgaccttcatttgatgcatcattaartagagacataagatcaagtaagtg

SEQ ID NO: 94790 - DNA, 50 bp, homo sapien
ctactatatccaagctccttttactmtgtccaaagtcttttgctgggctc

SEQ ID NO: 94791 - DNA, 50 bp, homo sapien
ggctgtgttcaaaatcagttgctaakattcttccacagctataacagcct

SEQ ID NO: 94792 - DNA, 50 bp, homo sapien
gaaagagactcttcaggaggcatcarcttctaactcatctcaccaggaga

SEQ ID NO: 94793 - DNA, 50 bp, homo sapien
gatgctaaatcttgttttgcattcartaaagtgtcaagtgattaaaaaca

SEQ ID NO: 94794 - DNA, 50 bp, homo sapien
gtttccagggtgctctggtttaattrtatcgcacaatgcctttggttcat

SEQ ID NO: 94795 - DNA, 50 bp, homo sapien
gcaatactcttatttctgtcttcccrgcatactcagaccagaccctggaa

SEQ ID NO: 94796 - DNA, 50 bp, homo sapien
gaaaccctgagaagaaacctgcccayggtaatcactcagtaaaggctagc

SEQ ID NO: 94797 - DNA, 50 bp, homo sapien
atgatgaataaacggatgaagggaamcaaggtataacataatcacatgag

SEQ ID NO: 94798 - DNA, 50 bp, homo sapien
tcaaattaacctaaattacacaatcrtcagataaaaattgtgcattcact

SEQ ID NO: 94799 - DNA, 50 bp, homo sapien
ccttgaagcatttgccaaaaatttasatgctaaagaactgtaaacccact

SEQ ID NO: 94800 - DNA, 50 bp, homo sapien
aaatttacatgctaaagaactgtaarcccactagagcctcctttgcacgc

SEQ ID NO: 94801 - DNA, 50 bp, homo sapien
ttttaaatttttacatgcaaatatcyagttttcccaacactattaaagaa

SEQ ID NO: 94802 - DNA, 50 bp, homo sapien
aataaccattctgttaagaaaagaarttaccagtaaagacacagtttcat

SEQ ID NO: 94803 - DNA, 50 bp, homo sapien
gtgagggtaaggaagtcctcagtaaygtttcccttttaatgaaaagcagc

SEQ ID NO: 94804 - DNA, 50 bp, homo sapien
ggcatacaagctaaggtcatacaaartatctttcatatgtaacttggcat

SEQ ID NO: 94805 - DNA, 50 bp, homo sapien
ttctttcatcattgcttatgcatcaytcatctaaaagggctgatctgatc

SEQ ID NO: 94806 - DNA, 50 bp, homo sapien
gagtgactttttttgtataccattaygttgctaactgacaagtcctatga

SEQ ID NO: 94807 - DNA, 50 bp, homo sapien
tccaattgatttgtcaaagaactacrtaagcttctgaaatagaaaaaaat

SEQ ID NO: 94808 - DNA, 50 bp, homo sapien
gtagtactgacaggtgggccccttayggactcagaaactgggaagacaat

SEQ ID NO: 94809 - DNA, 50 bp, homo sapien
cacaagaggtatgcctaaaagtgcaygatttccatcagagaaatggacag

SEQ ID NO: 94810 - DNA, 50 bp, homo sapien
gaggacaaacatttaaggcaataaascttcatcggtgctatgctagatca

SEQ ID NO: 94811 - DNA, 50 bp, homo sapien
ttacatactttagaatcttgatttgyaaactcatttgagtgaaaggaata

SEQ ID NO: 94812 - DNA, 50 bp, homo sapien
gactgggtcatccccagctgagttaratccacagaatattgattagcatt

SEQ ID NO: 94813 - DNA, 50 bp, homo sapien
tggatatgtcttcatattcacagatkatcagggacttagtgtaatggttt

SEQ ID NO: 94814 - DNA, 50 bp, homo sapien
tttactctttttttttccagaaaagrctggacttaacagattctagggtc

SEQ ID NO: 94815 - DNA, 50 bp, homo sapien
gtcacggcaataaagcctaggtcaaragaacagaaagctcaatggatatg

SEQ ID NO: 94816 - DNA, 50 bp, homo sapien
cttgagaacaagagtactttctgtawccccaggagagtcttatgcccata

SEQ ID NO: 94817 - DNA, 50 bp, homo sapien
tccagtttagacattttgttatttaycttgtccagtaatgtgaagtgaag

SEQ ID NO: 94818 - DNA, 50 bp, homo sapien
ctatgctggcattaatttgctccggyataagattatcttctcgagaaaaa

SEQ ID NO: 94819 - DNA, 50 bp, homo sapien
gaacatgagactaagtttgaacatgrcatgctctgcatttggcagctatt

SEQ ID NO: 94820 - DNA, 50 bp, homo sapien
agtattgaggatttaaaggaagaaawtattccaagtaaaagtaactgtat

SEQ ID NO: 94821 - DNA, 50 bp, homo sapien
gtattttacttgcaaagaatagacamctacttatcagcttaagaaaagag

SEQ ID NO: 94822 - DNA, 50 bp, homo sapien
ggaccatgcgctaggcagtagctacragagaattcctacatcagaggctc

SEQ ID NO: 94823 - DNA, 50 bp, homo sapien
tttttttttttaaatagagacctgcrctaagtaatataatacacgttgca

SEQ ID NO: 94824 - DNA, 50 bp, homo sapien
ttcagtcacctggaactaccaataaytcgtttcccaaagggtggaatgct

SEQ ID NO: 94825 - DNA, 50 bp, homo sapien
acacacaaatttttttaatccagaarctacataatgatcactttatattt

SEQ ID NO: 94826 - DNA, 50 bp, homo sapien
gtgcctcatgatgattgtatgactcrcattgggatttgggctctgggcta

SEQ ID NO: 94827 - DNA, 50 bp, homo sapien
cactgggagtgcttatagatgataawtgggaatctactcctatatgtcac

SEQ ID NO: 94828 - DNA, 50 bp, homo sapien
ttcctagaccaccttgaacgtcccayattctggatttgtgtattttctca

SEQ ID NO: 94829 - DNA, 50 bp, homo sapien
ggagattctagatttatttggtctarctgggaaataccctccttttgtaa

SEQ ID NO: 94830 - DNA, 50 bp, homo sapien
tgccactcgtgaagaaacctgctagraggaaaaatcagctatcaccgaaa

SEQ ID NO: 94831 - DNA, 50 bp, homo sapien
ctccatttctagccctagaaggagaygaacctgattattcccagccaatt

SEQ ID NO: 94832 - DNA, 50 bp, homo sapien
tgaattaagaggtaaaaatctttgtsaatacagcagactagcttttcagc

SEQ ID NO: 94833 - DNA, 50 bp, homo sapien
aaatagagaattgcataaaagaatawtttaaaacacctccaagacatcct

SEQ ID NO: 94834 - DNA, 50 bp, homo sapien
aggtcttcattctgtgatgatcaaayttatcctattgtatctcccattaa

SEQ ID NO: 94835 - DNA, 50 bp, homo sapien
tctagccctcaggaagctgatttgtwaaaataccaagggttggcctgaca

SEQ ID NO: 94836 - DNA, 50 bp, homo sapien
ttattctagcctttttaaatgtagayaactgtgaacacaagctgcaaagt

SEQ ID NO: 94837 - DNA, 50 bp, homo sapien
aagtatgagccagattttggagaccragtgaaggcaagtgggtcagaatc

SEQ ID NO: 94838 - DNA, 50 bp, homo sapien
gtactgatttcctcatccatgacatyaatagtttagcaatttcctgtaaa

SEQ ID NO: 94839 - DNA, 50 bp, homo sapien
gatgtcaaataatttaaacatcatcratataatttgctaattggaaatgg

SEQ ID NO: 94840 - DNA, 50 bp, homo sapien
acacctttgcctttgtaaacatatgycctgcagtaaacatatgtatgagg

SEQ ID NO: 94841 - DNA, 50 bp, homo sapien
attcaggaattgatggactttcagaygttttaatgtggtcactagagtaa

SEQ ID NO: 94842 - DNA, 50 bp, homo sapien
gtttgttgcaacaacaatgagaaacyaatatacagagaatgcatacattt

SEQ ID NO: 94843 - DNA, 50 bp, homo sapien
atgaagtctctattattgaaagaaayggatataagcaggtaaagctcaac

SEQ ID NO: 94844 - DNA, 50 bp, homo sapien
gattattcacaaaatattagccagaytaactctttattagtggagttagg

SEQ ID NO: 94845 - DNA, 50 bp, homo sapien
aagtacatcacaaatcacaaatgtaygacaagcctgcatgcgatgctttt

SEQ ID NO: 94846 - DNA, 50 bp, homo sapien
gagaccttcaggatggggatacagasctttaagagcagaggaaattgttg

SEQ ID NO: 94847 - DNA, 50 bp, homo sapien
caaggtaaagagacatacaaatgacrgatagtgctgtaagccaatcccat

SEQ ID NO: 94848 - DNA, 50 bp, homo sapien
agtttcctaatattttagcctcccgwaggatagccactttatggaataat

SEQ ID NO: 94849 - DNA, 50 bp, homo sapien
tcagccattttttaaaatacagaaaktctttgtgtagggtgtcgttattt

SEQ ID NO: 94850 - DNA, 50 bp, homo sapien
tggatgctggcttctgtgaggtagayggaatcataagcaggtgacccaca

SEQ ID NO: 94851 - DNA, 50 bp, homo sapien
agtatacattaagcaatgatcagacraatgaaaagctgtgtaatgaaacc

SEQ ID NO: 94852 - DNA, 50 bp, homo sapien
acatgtgagtagactgtctgaccaaytatgatgttagtttatttgagctg

SEQ ID NO: 94853 - DNA, 50 bp, homo sapien
tatcaattattattgtcaagtaataygtaactatcttcataacagtatca

SEQ ID NO: 94854 - DNA, 50 bp, homo sapien
atggctgccttagaacctgctgatayggattttctacattttgccacccc

SEQ ID NO: 94855 - DNA, 50 bp, homo sapien
acaaatacttgcaatcatcactaaaygtgctattgataggggcttttata

SEQ ID NO: 94856 - DNA, 50 bp, homo sapien
tgacctaagatcagtatacatagagycttgtaaaccttggtagagatttt

SEQ ID NO: 94857 - DNA, 50 bp, homo sapien
ctgtgctgctttctccacctgctacrgacacttattcctcaaatctcacg

SEQ ID NO: 94858 - DNA, 50 bp, homo sapien
gacaaatctggcaccatgaggctaartattttggttgtcttaatggttga

SEQ ID NO: 94859 - DNA, 50 bp, homo sapien
gaataatataaactaactgacaaaaygctaatctctatcatgatatatct

SEQ ID NO: 94860 - DNA, 50 bp, homo sapien
caaaagtatttatggtacagttttcragtgctgagtagatttgtctgtat

SEQ ID NO: 94861 - DNA, 50 bp, homo sapien
gtagttaggggtttaggtccacgaarccaatttattattcaaatcttaga

SEQ ID NO: 94862 - DNA, 50 bp, homo sapien
aaataattcatcaggcttatttttcygctcataatgttattattcagtga

SEQ ID NO: 94863 - DNA, 50 bp, homo sapien
gcaggccctccttgtctccggagaartaaggaagaaggtttgggaagggt

SEQ ID NO: 94864 - DNA, 50 bp, homo sapien
gtgaaagtgtcacacatccctgaccragtgctgtctcaccgtattttaga

SEQ ID NO: 94865 - DNA, 50 bp, homo sapien
ttatagttaaatcacatttttaacaytcaaaacactcattctactcaaca

SEQ ID NO: 94866 - DNA, 50 bp, homo sapien
gaagactgtctctccatgccaagtamaagactgtctctccatgctagagt

SEQ ID NO: 94867 - DNA, 50 bp, homo sapien
gatagtagtatgagtagcatcaaatkactcacataggtctcaggtgacat

SEQ ID NO: 94868 - DNA, 50 bp, homo sapien
taagctataaaacagaaataaagcayaattagtagaagaaggagacacaa

SEQ ID NO: 94869 - DNA, 50 bp, homo sapien
cactcatcaacaaatgacagtagaayttccttgttgaaagcctttcttac

SEQ ID NO: 94870 - DNA, 50 bp, homo sapien
tccagaactcaacgaacaatgtcaartaacaatgatgatagaagaatcag

SEQ ID NO: 94871 - DNA, 50 bp, homo sapien
acaggaaagaatatgatgttgttaaratgtagtacaaagtgggctgggtg

SEQ ID NO: 94872 - DNA, 50 bp, homo sapien
taatattttttgtttgcttaggaccrgagcaagaaggttggacttgggag

SEQ ID NO: 94873 - DNA, 50 bp, homo sapien
ggcttttaatttaccttcatcagaaytgtatacattgtatccataagtaa

SEQ ID NO: 94874 - DNA, 50 bp, homo sapien
agaaaaacaaacatgattcaagttcracagtgacactgatctttgcaatc

SEQ ID NO: 94875 - DNA, 50 bp, homo sapien
cttttgtaaattaacaaatgtggtaygttcaagagcaggatatatgagat

SEQ ID NO: 94876 - DNA, 50 bp, homo sapien
aaaactcaagctatatagatcactgmaaataatggcattccatatataac

SEQ ID NO: 94877 - DNA, 50 bp, homo sapien
tctctaaaatgggattcactaatctraaaaggcagtacaacatttctcct

SEQ ID NO: 94878 - DNA, 50 bp, homo sapien
gggaaagccttttattttttttcaawctgacatctgtgtatttcagaaag

SEQ ID NO: 94879 - DNA, 50 bp, homo sapien
acaactctatacgaaatctgtgataytaaggatgaacaacctaacaagtc

SEQ ID NO: 94880 - DNA, 50 bp, homo sapien
aggaaaaaactaattactaaatatgraatgaattgtgtgagctcatccca

SEQ ID NO: 94881 - DNA, 50 bp, homo sapien
tttaaataggaataattggaaatgcraagagttaagtgatctggttaaag

SEQ ID NO: 94882 - DNA, 50 bp, homo sapien
aaagtgatattgaagagatacacaaygattttaatatatgtaggaagtat

SEQ ID NO: 94883 - DNA, 50 bp, homo sapien
tctgaattaaactccagagagatacraaatccaaaaataatagcaggtcc

SEQ ID NO: 94884 - DNA, 50 bp, homo sapien
aaaagtgtgtgtcatttttgtgaaamgcagtatagcagaatggttaagag

SEQ ID NO: 94885 - DNA, 50 bp, homo sapien
ttttgttgtttactaggagaaagaaktgtaaagcatatagtttagtttgg

SEQ ID NO: 94886 - DNA, 50 bp, homo sapien
agtcctttagctgccatgttgtcacragaaggaaggaagtatgtatttag

SEQ ID NO: 94887 - DNA, 50 bp, homo sapien
tttccattaaggaaccaaatttatcmaggtggtagaattatttattttag

SEQ ID NO: 94888 - DNA, 50 bp, homo sapien
aggacttgtccttagtgtcagataartagtttggtggaaaaagactcttg

SEQ ID NO: 94889 - DNA, 50 bp, homo sapien
caagatgcctcatctattgaataagkcctttcgtatcctgaaatgataaa

SEQ ID NO: 94890 - DNA, 50 bp, homo sapien
gagcaaacaacacatgataggcacamcatctactaaatatttgattccga

SEQ ID NO: 94891 - DNA, 50 bp, homo sapien
ctgaagaaaaaggctgtaaaatcacyggaatgactgagaaatttctgatc

SEQ ID NO: 94892 - DNA, 50 bp, homo sapien
tccttttttgaccacatactctaaamtcatttcttcgtatgacaacgtta

SEQ ID NO: 94893 - DNA, 50 bp, homo sapien
ccttgtaaaaatatccttgaaaagayggtccataacaaaaacagcaagtt

SEQ ID NO: 94894 - DNA, 50 bp, homo sapien
tttgggacagagatcttggcataaastcagtacacttaaaggacggtatc

SEQ ID NO: 94895 - DNA, 50 bp, homo sapien
tggtttcttgtttgtatgatgaaaamtaactggtaaagctcatctccaga

SEQ ID NO: 94896 - DNA, 50 bp, homo sapien
aactaggcacaaacttgtcactttckagccatggcaaaatgtcttacagg

SEQ ID NO: 94897 - DNA, 50 bp, homo sapien
tccttcctcctctcaccattgatgaygttaagaagatgccaaaaggaggc

SEQ ID NO: 94898 - DNA, 50 bp, homo sapien
tatttgctgcctcagagacctattgyaagaattaaatgtgttggccaggc

SEQ ID NO: 94899 - DNA, 50 bp, homo sapien
cagcaaatagatgaaagcaatacaartacccatgaataaaataataagca

SEQ ID NO: 94900 - DNA, 50 bp, homo sapien
aatgatttatgtgatatatatgtgakgtaagtcttcatgtcttccatagg

SEQ ID NO: 94901 - DNA, 50 bp, homo sapien
caattatttgttttacagaaggactkaatgcagaatgcattgaaatctag

SEQ ID NO: 94902 - DNA, 32 bp, homo sapien
aaaaggtaatttaaaartatgtatcaaaatcc

SEQ ID NO: 94903 - DNA, 50 bp, homo sapien
taagaaaaagaaaaaaatcagtatgyctagcaataggagataaacttcta

SEQ ID NO: 94904 - DNA, 50 bp, homo sapien
tgattaatagagtaattcctataaasttctgtcatatcttacagaacctc

SEQ ID NO: 94905 - DNA, 50 bp, homo sapien
tacaaaagaactacatgggaaaataygcttttaaacatgttaaccttaca

SEQ ID NO: 94906 - DNA, 50 bp, homo sapien
aaagtacaagatgtgtaagagagaasaacaaaggatatacaccttatttt

SEQ ID NO: 94907 - DNA, 50 bp, homo sapien
agctatgtttatggatttaccatgargaatagataactaaagatacactt

SEQ ID NO: 94908 - DNA, 50 bp, homo sapien
cgaaaaatttagctttatttcatagyccagtgtaattttttgtttgcttg

SEQ ID NO: 94909 - DNA, 50 bp, homo sapien
aattcaactactgtttttattgtacyatgtggatgcattaagtagccatg

SEQ ID NO: 94910 - DNA, 50 bp, homo sapien
tggctaaagaaagattatccacacamtcatacgtagtcattaatacagaa

SEQ ID NO: 94911 - DNA, 50 bp, homo sapien
agaagcagggtagactcaggcaaaartttccaagaagttctttgggactc

SEQ ID NO: 94912 - DNA, 50 bp, homo sapien
aggtctttctccacatttcaccatargcgtgcatgcagttaagatctctt

SEQ ID NO: 94913 - DNA, 50 bp, homo sapien
ggaaacaaatgtaagagatgtaaaargaaatgaatagaagtgaggttatg

SEQ ID NO: 94914 - DNA, 50 bp, homo sapien
attcaacatcctttcatgatagaaakactaaaacaaactgagtatagagg

SEQ ID NO: 94915 - DNA, 50 bp, homo sapien
agaagtaatattagaattgagttaayacataataaacagtgctgcctgat

SEQ ID NO: 94916 - DNA, 50 bp, homo sapien
tacatcctattgagagaatgaaaatmaacaacatatgacgatgaaaaccc

SEQ ID NO: 94917 - DNA, 50 bp, homo sapien
ttctaatcctgagcataacttcccaraatggatctatggtgtctctcatg

SEQ ID NO: 94918 - DNA, 50 bp, homo sapien
acattaatgtcatacaggactacaamaaattagggttcagagttatagat

SEQ ID NO: 94919 - DNA, 50 bp, homo sapien
tggatataggatgcatcattattcasaatggtaaaaagagagaggagcaa

SEQ ID NO: 94920 - DNA, 50 bp, homo sapien
tgtactacattattctcaaatgtcartgaaccagttgggaaatacagtgt

SEQ ID NO: 94921 - DNA, 50 bp, homo sapien
gattagatatacattggatcagtaayatatagagaactgttttaatttac

SEQ ID NO: 94922 - DNA, 50 bp, homo sapien
ggaatttggatatttgtaaggacttkaaccaactattcaaaaaataaggc

SEQ ID NO: 94923 - DNA, 50 bp, homo sapien
tcttattctattttggtagcctcatratccatcaaaaccttgacttcaat

SEQ ID NO: 94924 - DNA, 50 bp, homo sapien
atattcaataaattatatgttaatayggataaagttcagtaattctcatc

SEQ ID NO: 94925 - DNA, 50 bp, homo sapien
gatgttttattgagctgaaatgaggyaatctgtctgcatcatgggtagga

SEQ ID NO: 94926 - DNA, 50 bp, homo sapien
gattttctaaatgaatactcctctamctatgcataacatgtgtcatttaa

SEQ ID NO: 94927 - DNA, 50 bp, homo sapien
tatatatttttattttgtgagttaaygaagattagatccttttgaatgat

SEQ ID NO: 94928 - DNA, 50 bp, homo sapien
tgggaacatgtattaagtactttttmgcagttaagtccactctctgtagg

SEQ ID NO: 94929 - DNA, 50 bp, homo sapien
ctttttccaaaaaaggttatcagaawttcattacaagtacagctttatta

SEQ ID NO: 94930 - DNA, 50 bp, homo sapien
catgggattagcacttaagattatgmagcctaaaaccaaggccttcctgg

SEQ ID NO: 94931 - DNA, 50 bp, homo sapien
atgtatcttttccatgtcacccacartgatggtgtattcagccacagatg

SEQ ID NO: 94932 - DNA, 50 bp, homo sapien
actcttcgtaaacagcaattacaatwactactgaacactttgcctgcagt

SEQ ID NO: 94933 - DNA, 50 bp, homo sapien
tgtcttggaaatgtttagatgtagasagagaaataaacaaagtcacaagg

SEQ ID NO: 94934 - DNA, 50 bp, homo sapien
aaaaaatgcattatcaactctcacartcttttcagaattacccttgttag

SEQ ID NO: 94935 - DNA, 50 bp, homo sapien
cttcactacattttatcttggagtamatttcagaattaggcatgtttatc

SEQ ID NO: 94936 - DNA, 50 bp, homo sapien
ggtatcatctgtctgttcaaaaacargtcaataaagtattacaccaagat

SEQ ID NO: 94937 - DNA, 50 bp, homo sapien
ataagaagcttttgtattggggaaawtttactgggttctctctagtctca

SEQ ID NO: 94938 - DNA, 50 bp, homo sapien
cacccatgggaggttttaaaacttakgctcagacatcatcacaaatctcc

SEQ ID NO: 94939 - DNA, 50 bp, homo sapien
ggtgcaaggctgagttgggaagtaastagttgagtagaggttaaagaaga

SEQ ID NO: 94940 - DNA, 50 bp, homo sapien
tattggatatggttagagtcacagayatgcttttgatagatgaaagagaa

SEQ ID NO: 94941 - DNA, 50 bp, homo sapien
actctttgtgctcatgactgtttaayattagcaagttcagttgtggaaaa

SEQ ID NO: 94942 - DNA, 50 bp, homo sapien
gccctaaaaacaaatgactaaaacamttgcatttaaatgactaaaaaact

SEQ ID NO: 94943 - DNA, 50 bp, homo sapien
tttagattttacaacaatgacctatwagagtaaacaatttcaacgaaaaa

SEQ ID NO: 94944 - DNA, 50 bp, homo sapien
cttaactcctaaaatgtaagctcggratagctcagatgttcttacagaaa

SEQ ID NO: 94945 - DNA, 50 bp, homo sapien
caccatcaagttaacatactaaaagracactttctgattcttgctccata

SEQ ID NO: 94946 - DNA, 50 bp, homo sapien
gaaattagatgaatgtaagaaatacygggaaaacaatgataaagaaggca

SEQ ID NO: 94947 - DNA, 50 bp, homo sapien
attaaatgtttttgtttgatatcgtraactgatttatcctttttctttag

SEQ ID NO: 94948 - DNA, 50 bp, homo sapien
gggaatgccagattgcaaaattgaarggattgtctgttgcccaagaaaaa

SEQ ID NO: 94949 - DNA, 50 bp, homo sapien
ctcaatgacattcaggtttgccatastggagcaagtagtgttaggccatc

SEQ ID NO: 94950 - DNA, 50 bp, homo sapien
aaataagatgagaccaattgaggagmagctgaaaataagatggagctaaa

SEQ ID NO: 94951 - DNA, 50 bp, homo sapien
ggtccaattttggtacatgaagttaygaaagataaaagagaacatgggca

SEQ ID NO: 94952 - DNA, 50 bp, homo sapien
aacacaatgacccagagtacttgacrgtgtcctcaataaaataacaatct

SEQ ID NO: 94953 - DNA, 50 bp, homo sapien
gtgagtcttcacttaacactgtaacrctgtaattctcctactgcattaag

SEQ ID NO: 94954 - DNA, 50 bp, homo sapien
agagacacactaattttaaatataastgctggctctttctagaaaccagg

SEQ ID NO: 94955 - DNA, 50 bp, homo sapien
gttctgagctataataggatcttcayggatatcaggagagaggtaaatat

SEQ ID NO: 94956 - DNA, 50 bp, homo sapien
cattcagtcttttgagtatcttgccrccttgttttcctgtcctcaggtca

SEQ ID NO: 94957 - DNA, 50 bp, homo sapien
tgttattgagtacaactctctttcaygtgttatctgctgatatgagcaaa

SEQ ID NO: 94958 - DNA, 50 bp, homo sapien
agtccatttgactttttgtcatctcratttacatttttttttgagacagg

SEQ ID NO: 94959 - DNA, 50 bp, homo sapien
aatataaaaaataaaatgacagggawctttattagtggtcaaactttaga

SEQ ID NO: 94960 - DNA, 50 bp, homo sapien
gaagttttaggcaaggttaaaagaaragcatgaattcaagacacaggaat

SEQ ID NO: 94961 - DNA, 50 bp, homo sapien
tccatatactgatacactgtcttcaygtagagttatttaattgaactatt

SEQ ID NO: 94962 - DNA, 50 bp, homo sapien
gctgaaataaccaattcattttaaaycagataatctaaatgtctattcgc

SEQ ID NO: 94963 - DNA, 50 bp, homo sapien
cttaattctgcaaaggattgactaaygtgctatcatttctgcaggtttct

SEQ ID NO: 94964 - DNA, 50 bp, homo sapien
aagggccatattgattgaagccttaraaaatatacagaaatttcaaggta

SEQ ID NO: 94965 - DNA, 50 bp, homo sapien
actcagttttattttataaccttcaygggaaaagcagattagacctgtca

SEQ ID NO: 94966 - DNA, 50 bp, homo sapien
aaactgactgcttttgcagcttctcrcatggatacccttcatgtccttca

SEQ ID NO: 94967 - DNA, 50 bp, homo sapien
aacttttctcatttcctgaaatccartctcgtagctttcagttataattg

SEQ ID NO: 94968 - DNA, 50 bp, homo sapien
tcaaataactttccaagactccacaytatccaacttagtgaaccttcatc

SEQ ID NO: 94969 - DNA, 50 bp, homo sapien
accccagcttcacccctaacacatcmaagctctcggtcccagcatgatga

SEQ ID NO: 94970 - DNA, 50 bp, homo sapien
gaattggaagaagtacaaagattcasatgataaaacaagcattaaatgaa

SEQ ID NO: 94971 - DNA, 50 bp, homo sapien
tctcttggtaaaccagtttattcaayggagtagatggagggaaaggtaat

SEQ ID NO: 94972 - DNA, 50 bp, homo sapien
gtattttatcacataaaaaagtcackaaagattttgctaggaaagtctga

SEQ ID NO: 94973 - DNA, 50 bp, homo sapien
tatcttttttcttctggtgtttttgkaatttcagagacaaaagagaatgt

SEQ ID NO: 94974 - DNA, 50 bp, homo sapien
tttagcttaattccctaatctttacrccatgcatacaccattcagaaatg

SEQ ID NO: 94975 - DNA, 50 bp, homo sapien
ttgtttaatttaaaatataatatcayctactttgcacattatgctctaaa

SEQ ID NO: 94976 - DNA, 50 bp, homo sapien
acttaactactagtctgcttaaaaasaaaatgagtaagtttgtatgcatg

SEQ ID NO: 94977 - DNA, 50 bp, homo sapien
ttataggatattttgttcaatgctawcttataggaatccaggtaaggctc

SEQ ID NO: 94978 - DNA, 50 bp, homo sapien
aaagccaaatacttctaatgaggccraaaggttttcagaagaaagatgag

SEQ ID NO: 94979 - DNA, 50 bp, homo sapien
tgaaactgagcttggattgtttgttyaaaatgttaagggtaacaggcttt

SEQ ID NO: 94980 - DNA, 50 bp, homo sapien
ttacatgtgttacattcacatattayagaacttgaaactcaatttgcttt

SEQ ID NO: 94981 - DNA, 50 bp, homo sapien
gcatttaaatcatcctatctgaagasaaagtgcgattctggaattttctg

SEQ ID NO: 94982 - DNA, 50 bp, homo sapien
atgcaatgagacctgaaacaaaatawatactggttaaacagaactctagg

SEQ ID NO: 94983 - DNA, 50 bp, homo sapien
gtgttttggtggaagagcagttataygagattcttataaaatctatgaat

SEQ ID NO: 94984 - DNA, 50 bp, homo sapien
ccatttatttattttgtccactttcmaatataggtgttaatgaatggtaa

SEQ ID NO: 94985 - DNA, 50 bp, homo sapien
ctgattggaaatatcatccaaattgytttggctctgcccctccacattca

SEQ ID NO: 94986 - DNA, 50 bp, homo sapien
actcatgcacatagtcacaaacaatsataattcagattctggatatgtcc

SEQ ID NO: 94987 - DNA, 50 bp, homo sapien
atgctctctgtgagcaatcacataamctcagatagccttagcccctacaa

SEQ ID NO: 94988 - DNA, 50 bp, homo sapien
caaaatattttgctttttatattacyctttctactactcacagtttaatg

SEQ ID NO: 94989 - DNA, 50 bp, homo sapien
accataatcaagtaggctttatccakgagatgtaaggttggttcaacata

SEQ ID NO: 94990 - DNA, 50 bp, homo sapien
catgcccttcacttacttattttacygctggttccaacagtcagccctat

SEQ ID NO: 94991 - DNA, 50 bp, homo sapien
caacagatattgttacataaagcaaraaaggtgacaaaattatataatta

SEQ ID NO: 94992 - DNA, 50 bp, homo sapien
caatatctgttgggaagtacttgtcmcgaaattgaatatttctcacccaa

SEQ ID NO: 94993 - DNA, 50 bp, homo sapien
ttggtagcttttataacactctgaartctcataagctattctttaacttc

SEQ ID NO: 94994 - DNA, 50 bp, homo sapien
ttttcaaacaagttcacgttaacttraaacatattaagcataatgcatgg

SEQ ID NO: 94995 - DNA, 50 bp, homo sapien
aagatacatagtcttggatgttaacyaagtaaagagaaatattcagaaga

SEQ ID NO: 94996 - DNA, 50 bp, homo sapien
tgatctaatttagtacctactgaaaytctatgtcccaatatgcccttact

SEQ ID NO: 94997 - DNA, 50 bp, homo sapien
tctcaattttggaggaaggggtgcayagtaactgattctcctccctcacc

SEQ ID NO: 94998 - DNA, 50 bp, homo sapien
ctttggtttcaccttcctatttggcmaagaaccaaattatcctggttgcc

SEQ ID NO: 94999 - DNA, 50 bp, homo sapien
atttttaattcttggatcctaaatarcgtggataccaagccacctctaga

SEQ ID NO: 95000 - DNA, 50 bp, homo sapien
cttactctacattattcccatttaartaaagcccaaccatggttaaactc

SEQ ID NO: 95001 - DNA, 50 bp, homo sapien
gccttatatcaccttatctattttaycaccttcatctcatattaacacaa

SEQ ID NO: 95002 - DNA, 50 bp, homo sapien
ggcattaaaagtagtcacttggttcmaacaagcattaaaaacacatgttt

SEQ ID NO: 95003 - DNA, 50 bp, homo sapien
gtaaagattaaacaatcttcttaatmaactttgcattaggaacaattaaa

SEQ ID NO: 95004 - DNA, 50 bp, homo sapien
acagctacaattttccaaatatacawcacttgtttcacatgtatctagaa

SEQ ID NO: 95005 - DNA, 50 bp, homo sapien
cattttgcctgtatttggaattatcycattgtttaagactattaactaaa

SEQ ID NO: 95006 - DNA, 50 bp, homo sapien
aagtctaagtaagttggataaattgkagagtctaacatccttattatttc

SEQ ID NO: 95007 - DNA, 50 bp, homo sapien
ctttgtgtataacttgaacctaagaygtcaattagctggatggtgtattt

SEQ ID NO: 95008 - DNA, 50 bp, homo sapien
tgcctattttgatgcagtcacactaygagtctaatatgaaaaataacttt

SEQ ID NO: 95009 - DNA, 50 bp, homo sapien
gcaaaagtgctgtatgtgtaatggtmatgtgctgtatgtacaataatgat

SEQ ID NO: 95010 - DNA, 50 bp, homo sapien
ccacatccttttggagctcttcctaygaaatttagctgtcctgaatttta

SEQ ID NO: 95011 - DNA, 50 bp, homo sapien
aatgggcaactaactgtttattccamagcgtttaaatggcttcttaaaat

SEQ ID NO: 95012 - DNA, 50 bp, homo sapien
gtaatggtcatgtgctgtatgtacartaatgataatgatttgtaacatga

SEQ ID NO: 95013 - DNA, 50 bp, homo sapien
cctgaattttaaatcctatgttatcraaagaataactctcttgtgctgcc

SEQ ID NO: 95014 - DNA, 50 bp, homo sapien
tttatctgaatgattagatgagtatmgtgtgaaggttaaactactgctac

SEQ ID NO: 95015 - DNA, 50 bp, homo sapien
agttgagcagccaccaaccacatttrggaagcgtcaccactttctagtca

SEQ ID NO: 95016 - DNA, 50 bp, homo sapien
actgctcctaagacaaactctttcaycttcgggacattaggtgactccag

SEQ ID NO: 95017 - DNA, 50 bp, homo sapien
atctgtcaccagtgctataggagacraagaaggaaatcaaaacatatgca

SEQ ID NO: 95018 - DNA, 50 bp, homo sapien
cctataggcaaagcactgtttgagayattaggccaagttagagaaatgag

SEQ ID NO: 95019 - DNA, 50 bp, homo sapien
ttgcctctgtcttaaacttagaacaratacgcaatctctttaacagtatg

SEQ ID NO: 95020 - DNA, 50 bp, homo sapien
tcaggacagaaattgtatggatttartgtaagtcttgggatctcacaagt

SEQ ID NO: 95021 - DNA, 50 bp, homo sapien
taatgaattatgaacaattctaaaargttggaattcaggagttcacacct

SEQ ID NO: 95022 - DNA, 50 bp, homo sapien
attagcctagaattggatccctcctsaagtcacagaggaatggttctggt

SEQ ID NO: 95023 - DNA, 50 bp, homo sapien
agtcagcttgtaaattctgcctgacmaaggactcatctttcagggcaatg

SEQ ID NO: 95024 - DNA, 50 bp, homo sapien
aaataaacataaaaataggtcaacaygaaggcaaagaaaattcaccagaa

SEQ ID NO: 95025 - DNA, 50 bp, homo sapien
taaagacaagtgtttttgaataacarcaggcctatcaaattgccaactgg

SEQ ID NO: 95026 - DNA, 50 bp, homo sapien
gcagctttttgcagcatttcctgtayctggcaaagaatttttgaaaaaaa

SEQ ID NO: 95027 - DNA, 50 bp, homo sapien
gagtgaataaattttctaaatgctgmatagctccccttgaagttctgctg

SEQ ID NO: 95028 - DNA, 50 bp, homo sapien
tacatgagaccatgtggtgataaatraggctgaagaaactaagataagaa

SEQ ID NO: 95029 - DNA, 50 bp, homo sapien
tgtatctgctaactttactacagtaytaccattttcgatattacttataa

SEQ ID NO: 95030 - DNA, 50 bp, homo sapien
ttctctggaggataaatgtactgaargaagttggttaccaggtgctctca

SEQ ID NO: 95031 - DNA, 50 bp, homo sapien
tcttatatcctactctcagcaatccyagtgaaataccagtctgttgtatc

SEQ ID NO: 95032 - DNA, 50 bp, homo sapien
taagatggttgaactgtcactgaccraaatggataatgtgtgggagaaca

SEQ ID NO: 95033 - DNA, 50 bp, homo sapien
cacttcctggccactcctcatcacarcttggtttctgctcccggtcactc

SEQ ID NO: 95034 - DNA, 50 bp, homo sapien
tgttttctctgttactccaaactaartgtgtattatattgaggtaaccat

SEQ ID NO: 95035 - DNA, 50 bp, homo sapien
tttattttcctcttggctgctctgaygctaacttccttgggttttctcct

SEQ ID NO: 95036 - DNA, 50 bp, homo sapien
ctcagtgaacagcataatgcaatgaygcagagcgactcaggccaaacaaa

SEQ ID NO: 95037 - DNA, 50 bp, homo sapien
cagaaaacctcgagggtgaaaaatcrctggccagctgtgaaagcagcacc

SEQ ID NO: 95038 - DNA, 50 bp, homo sapien
ccaatgaataagacttaattatgtcraaatgttacatgagaggaagaatc

SEQ ID NO: 95039 - DNA, 50 bp, homo sapien
agaatcataagaatttacataagaayctaagtggaatttacttatattgt

SEQ ID NO: 95040 - DNA, 50 bp, homo sapien
acataatggctgcactctcttgatayagtcacatccctatttgggcacgg

SEQ ID NO: 95041 - DNA, 50 bp, homo sapien
ttatgagcttcaatgttcttgacaargtatatcttgtttgtaaaaaatga

SEQ ID NO: 95042 - DNA, 50 bp, homo sapien
tcttgctgatgctaaagacaaattcrgaaattataacaatgatgaatgca

SEQ ID NO: 95043 - DNA, 50 bp, homo sapien
taaaacttttcttgattacctaacartggatctgtcattggaatactaat

SEQ ID NO: 95044 - DNA, 50 bp, homo sapien
tatgtaatagcatatatgactatgcragaactatttctatgggtataata

SEQ ID NO: 95045 - DNA, 50 bp, homo sapien
aacctggccttggaagattaaaaaaraatgatgtggtagtaatattttaa

SEQ ID NO: 95046 - DNA, 50 bp, homo sapien
agtaaaccttcacaatgaggcatcartaacaatgttttaacatttcctta

SEQ ID NO: 95047 - DNA, 50 bp, homo sapien
gatttcagttgcccatatttattgayggtattttctcaagataaagggag

SEQ ID NO: 95048 - DNA, 50 bp, homo sapien
aacaagaaggctctgccgctaagagsaagggcgttcaggaagaagtcgtg

SEQ ID NO: 95049 - DNA, 50 bp, homo sapien
aaagtagggtatggaatatataatakagtgaactccaataatgaatattt

SEQ ID NO: 95050 - DNA, 50 bp, homo sapien
aaaaatctgggaaatataatagtaasaagtttgacactgattccagaaaa

SEQ ID NO: 95051 - DNA, 50 bp, homo sapien
ctctgtgtatcttccattagtaaaastttatttggcagctgagaagcttt

SEQ ID NO: 95052 - DNA, 50 bp, homo sapien
aagttgccagaaaatgctatataaaycatgtgctttttacaaatggtaat

SEQ ID NO: 95053 - DNA, 50 bp, homo sapien
ccaggaggcccagttggtaaaggcargtggttaacattaggtaggtaaga

SEQ ID NO: 95054 - DNA, 50 bp, homo sapien
tacttgtattgaggggaaaagagtayagcagacaatttggagagtgaaaa

SEQ ID NO: 95055 - DNA, 50 bp, homo sapien
ggcatggaagttgtctgacttcctayctcgatcctgaagctttcttcagc

SEQ ID NO: 95056 - DNA, 50 bp, homo sapien
taacttgattccagaaaacgtcatgmattcaaaaagtggccttgcagttg

SEQ ID NO: 95057 - DNA, 50 bp, homo sapien
gctatggagacacttgcttcccatgyatgcttattaaatatataacccaa

SEQ ID NO: 95058 - DNA, 50 bp, homo sapien
tgttattttcattttaaacaaatcaygtggtcaagttattatgaacaata

SEQ ID NO: 95059 - DNA, 50 bp, homo sapien
gagcttttatttttctttacaattcrcaaaggtgttttactacagtgcac

SEQ ID NO: 95060 - DNA, 50 bp, homo sapien
ttcaatcaatgacatattgctctctyacacaattctgtgggagcatttaa

SEQ ID NO: 95061 - DNA, 50 bp, homo sapien
actgtttacatggttaatcttcaggmaaattgagtgggagaagtatttta

SEQ ID NO: 95062 - DNA, 50 bp, homo sapien
agccacagttaatggaaaaacaaccragtcctatttctgtgtttattttt

SEQ ID NO: 95063 - DNA, 32 bp, homo sapien
tcaatacattcaatgcrctgtattggatttct

SEQ ID NO: 95064 - DNA, 50 bp, homo sapien
aggagagctttgcccttgtcctcatkaacttttatgtcaatacattcaat

SEQ ID NO: 95065 - DNA, 50 bp, homo sapien
atgaatcaaggttatatttctcttgraagacgaaaacattacctatacca

SEQ ID NO: 95066 - DNA, 50 bp, homo sapien
tgatttgaaagcaggtgggctggtamctattgtgaactctactattgaca

SEQ ID NO: 95067 - DNA, 50 bp, homo sapien
atatatttaaaggaagaagggagtayggatggatgaacatcaaccatatt

SEQ ID NO: 95068 - DNA, 50 bp, homo sapien
aacatgcatgagttacagtttcagcrgaagaccttattcaacgaagaata

SEQ ID NO: 95069 - DNA, 50 bp, homo sapien
attgttaatttggccactctgtcatkcttgaaaagttttcttatcttgac

SEQ ID NO: 95070 - DNA, 50 bp, homo sapien
tatacaataataatgcatatttctcygacttcattcattcccttccctgt

SEQ ID NO: 95071 - DNA, 50 bp, homo sapien
agagtagcctcgtactaaatagcttrcatttcagagccagaatgcctggg

SEQ ID NO: 95072 - DNA, 50 bp, homo sapien
aaacagaccttgaggaagaatattamgaattgtaaagattttcaatgact

SEQ ID NO: 95073 - DNA, 50 bp, homo sapien
tggggccttgaactggatgtgagaartatgaaacagaaatttaagacatt

SEQ ID NO: 95074 - DNA, 50 bp, homo sapien
gactggtgtcacaactcatgcctccraaaaccatttgtcttttagagcat

SEQ ID NO: 95075 - DNA, 50 bp, homo sapien
tggtaagaacagattaaaccttagartgtgaacgcctaatagattcatct

SEQ ID NO: 95076 - DNA, 50 bp, homo sapien
ttcacaaaatcaaagtatctagcacygaccctatgaacaaatgagcatga

SEQ ID NO: 95077 - DNA, 50 bp, homo sapien
tagctcccaactggtatgatctgaaraatcagcggttactagggtaggag

SEQ ID NO: 95078 - DNA, 50 bp, homo sapien
gataagtcatggtccacatattctcygaaaacttagtggaagtattttag

SEQ ID NO: 95079 - DNA, 50 bp, homo sapien
gcctgatttccttgagtttctatcayctcttgctacggctgttgcttttt

SEQ ID NO: 95080 - DNA, 50 bp, homo sapien
aactgaacatctaggaggctgaaatyattataacatgggattagagctat

SEQ ID NO: 95081 - DNA, 50 bp, homo sapien
agcctttgggccagttttcaacactyaaacaggtcacattttttttgtgt

SEQ ID NO: 95082 - DNA, 50 bp, homo sapien
ggatttttcctttggtatgataagasatgacaaagatgcaagaggccttt

SEQ ID NO: 95083 - DNA, 50 bp, homo sapien
cattctttatgattgtgagatctgamtatgcaagttagaaatatgtaagg

SEQ ID NO: 95084 - DNA, 50 bp, homo sapien
aacttgttcatattatatttaatggwattggactaacagctgtaacttta

SEQ ID NO: 95085 - DNA, 50 bp, homo sapien
gcaattgtgtaatctgtttaataccratttctgctaggatataaggatta

SEQ ID NO: 95086 - DNA, 50 bp, homo sapien
gacacatcattatgtaagcacataargttttaatttgaacaagttaaccc

SEQ ID NO: 95087 - DNA, 50 bp, homo sapien
ccagtgaacaccatcaatgggatcartcaagaaccttatcaacattaagc

SEQ ID NO: 95088 - DNA, 50 bp, homo sapien
ttacaaaactggcaaaaaggaatccygaagaatcgaagtggagcatccag

SEQ ID NO: 95089 - DNA, 50 bp, homo sapien
tagaaattatctttccttcatgtccwacagtgctgaaaggtgaaaagaaa

SEQ ID NO: 95090 - DNA, 50 bp, homo sapien
cccaaaacttcaagcattttgtgaayttagtaacccgattcagcaagcaa

SEQ ID NO: 95091 - DNA, 50 bp, homo sapien
tgacatttttatgtactcacgataasaaggtgaatgaaaaatgtactttt

SEQ ID NO: 95092 - DNA, 50 bp, homo sapien
aagattctatgtctctgtgaaacaartaaaactgtggatggaatgcaatt

SEQ ID NO: 95093 - DNA, 50 bp, homo sapien
ttgtttcctgccaatgcctcctacasattgaacccagtggcaaccagagg

SEQ ID NO: 95094 - DNA, 50 bp, homo sapien
tcttttgtggaattcagaattaagcrtagtagatatgtaaactctcaaaa

SEQ ID NO: 95095 - DNA, 50 bp, homo sapien
tttaatagcatctaaagaacaacgtraacaaaataatcaaactttgagat

SEQ ID NO: 95096 - DNA, 50 bp, homo sapien
ttcttggcaaagtattaccttgtacrctttgaagatcgttgtctttcata

SEQ ID NO: 95097 - DNA, 50 bp, homo sapien
agtaataggtctttcacgtaacagasgttcacacattttttgagtcattg

SEQ ID NO: 95098 - DNA, 50 bp, homo sapien
gattcctcaacagaagctgcttttcrcttgattaactgtaacaaactctc

SEQ ID NO: 95099 - DNA, 50 bp, homo sapien
aactggtggtttaaacaacacaaatktactgtatttcaggtcaggtgtct

SEQ ID NO: 95100 - DNA, 50 bp, homo sapien
ttagatcatatgcgtattagttacayggctatatatcacaaaggtaacat

SEQ ID NO: 95101 - DNA, 50 bp, homo sapien
atagttaatgaagtcatcgttactawgcttcaatatttaatttcaaatta

SEQ ID NO: 95102 - DNA, 50 bp, homo sapien
ttgagaatgttccttatgagagtaartcaccctaactgttctagattgga

SEQ ID NO: 95103 - DNA, 50 bp, homo sapien
cttctaacttcagatcccttctatcmgagcatgggctgtgtttcaaggct

SEQ ID NO: 95104 - DNA, 50 bp, homo sapien
ctttttatttcttttagccaaatagyattccgctaataatcttagccttg

SEQ ID NO: 95105 - DNA, 50 bp, homo sapien
agggattagctccatgtacaaatgaygggcatacctcaagttattctatg

SEQ ID NO: 95106 - DNA, 50 bp, homo sapien
aacaagctaattgttagagattccartgaaggattatttcaccaagatat

SEQ ID NO: 95107 - DNA, 50 bp, homo sapien
tttggaggcttattactataattacrggtaatgaacaagatgctcagctt

SEQ ID NO: 95108 - DNA, 50 bp, homo sapien
tggaatatacatacagaaacacaaawtgagggtgacaaaagtgtcaaact

SEQ ID NO: 95109 - DNA, 50 bp, homo sapien
caagcttatgttaactgttcaccaarttctgtatttctataaaagcaaaa

SEQ ID NO: 95110 - DNA, 50 bp, homo sapien
ctgaaggcatttcctgtttcctttcsacttctttaagatttctatgacgt

SEQ ID NO: 95111 - DNA, 50 bp, homo sapien
tttgcacacatttctataaggaatascgtgatcataatggatagaatttt

SEQ ID NO: 95112 - DNA, 50 bp, homo sapien
ggttgtatgcttttacagtataaaakaagtttgccctccaatttggtaat

SEQ ID NO: 95113 - DNA, 50 bp, homo sapien
ataggaaaatatgaaattgtgtaggkaaatattaagaattagatcaaaag

SEQ ID NO: 95114 - DNA, 50 bp, homo sapien
ttaagaaaattaaatatgtatgtgakgtagaatcgtagaatgaggttgat

SEQ ID NO: 95115 - DNA, 50 bp, homo sapien
tgctgagtattccatattgagcatgyaccatagtttaagtagtttacagg

SEQ ID NO: 95116 - DNA, 50 bp, homo sapien
tgtaggagtctatctctgaacttaayctggctagtatatattatggcttc

SEQ ID NO: 95117 - DNA, 50 bp, homo sapien
agtctacatagagtttggatgaagcscagcaaattcctagctgtgggaag

SEQ ID NO: 95118 - DNA, 50 bp, homo sapien
actctaggaaccactctaggaaccartattacacttacatgaggacttgt

SEQ ID NO: 95119 - DNA, 50 bp, homo sapien
caaatcagcctaacaatatataaaamgggcaacacatcatgactaatgaa

SEQ ID NO: 95120 - DNA, 50 bp, homo sapien
tgtctacaagtcctattagggccaaraaaatactggaagtgaccaaaaag

SEQ ID NO: 95121 - DNA, 50 bp, homo sapien
ttttgaacaaaaaagaaacagaaagsaatggacttaatctgtttttctca

SEQ ID NO: 95122 - DNA, 50 bp, homo sapien
agcaactccgttcctgatttctaaamctaccctactttgttgatgccatt

SEQ ID NO: 95123 - DNA, 50 bp, homo sapien
aaacatagttgtatatcaaccaaatkagattgtctgaatatgttgatttt

SEQ ID NO: 95124 - DNA, 50 bp, homo sapien
aggggcagagggctgagaggagatasattcaagggccactttatttagtg

SEQ ID NO: 95125 - DNA, 50 bp, homo sapien
catgtccaaaatgctaaaatacaacratggcagtgaagacatcactacat

SEQ ID NO: 95126 - DNA, 50 bp, homo sapien
ctaaaaacaataaaaatactggatcmacattattagagataactgtatgt

SEQ ID NO: 95127 - DNA, 50 bp, homo sapien
ccttgctgtagagtataagattgccrgatatggaacatttaaagtattat

SEQ ID NO: 95128 - DNA, 50 bp, homo sapien
atgtactttaattatgaccatttaayagaccaatactgtctaccttaaaa

SEQ ID NO: 95129 - DNA, 50 bp, homo sapien
tatctagtacctgacattgaacatcsctgtatgccttgtgatagagtaat

SEQ ID NO: 95130 - DNA, 50 bp, homo sapien
gttttcttatattaagaaaccataawctggaaggtaaatagtggagacca

SEQ ID NO: 95131 - DNA, 50 bp, homo sapien
cttagctactgcttgaacatataaartaggaagtggggttgtttgggcaa

SEQ ID NO: 95132 - DNA, 50 bp, homo sapien
atgcaaccgagcatacatgtgacccraaggaagaagctgctgaccctcaa

SEQ ID NO: 95133 - DNA, 50 bp, homo sapien
tttgaaggacaaatagcagcttaccragaccaaaaggggctagggaaaga

SEQ ID NO: 95134 - DNA, 50 bp, homo sapien
atctgacatttccctacctgtataaytaatctagtgagtggtctacttag

SEQ ID NO: 95135 - DNA, 50 bp, homo sapien
cctctgcagattactggaaattaaawctaatctgagatgtggtggaaact

SEQ ID NO: 95136 - DNA, 50 bp, homo sapien
aaatacgtaaatctaaggcctcaaawtatggaattactaaatgaaaactt

SEQ ID NO: 95137 - DNA, 50 bp, homo sapien
aagacaaatcgtcttttttgccatgraatattagcctttgtgagcccttt

SEQ ID NO: 95138 - DNA, 50 bp, homo sapien
gatatcattgaacttgcttacaaccyatatttgaattctttatctgtcat

SEQ ID NO: 95139 - DNA, 50 bp, homo sapien
caaccaatttaatatacgggaaaccraactgagtttaagatagctgaaat

SEQ ID NO: 95140 - DNA, 50 bp, homo sapien
agcagggatatatgtaaagactgtakgtgaattactcctatgaagagtag

SEQ ID NO: 95141 - DNA, 50 bp, homo sapien
gggaaagagcattctaggcattcaartgtgtcctaaggagcagagggatg

SEQ ID NO: 95142 - DNA, 50 bp, homo sapien
cctcctaccctgtcagatcatctaarctgtttgacacaattaaatgacat

SEQ ID NO: 95143 - DNA, 50 bp, homo sapien
tttactgcaaagccagagaaaacctyaatagtgcctcctcctaccctgtc

SEQ ID NO: 95144 - DNA, 50 bp, homo sapien
agccataatgtacgacatagggtaayaactaaggctatatatttcagaag

SEQ ID NO: 95145 - DNA, 50 bp, homo sapien
actgtgtaggagggaatagtgggaasacaacagatcatctgaagaccctc

SEQ ID NO: 95146 - DNA, 50 bp, homo sapien
gccacaaaatacccaagttattagayatgcacaaggtaaatttaattgtc

SEQ ID NO: 95147 - DNA, 50 bp, homo sapien
gttatggtaacacattgttagctccmagaaacataatttttcagtggaaa

SEQ ID NO: 95148 - DNA, 50 bp, homo sapien
gatggattcccaaaactactcatcaygtcaagcagaaatcattcagtcac

SEQ ID NO: 95149 - DNA, 50 bp, homo sapien
atttattattgtctggcatagaatcragtttaggtaagagggtagccttc

SEQ ID NO: 95150 - DNA, 50 bp, homo sapien
caaaatgctgtattttatggtagatkaattacatttcaattttaaaaatt

SEQ ID NO: 95151 - DNA, 50 bp, homo sapien
cacctttggatcctcttatgagaatwaaaaaaggttcagattttaccata

SEQ ID NO: 95152 - DNA, 50 bp, homo sapien
gcttgtaccagtctctacttgtgaaytctgtatgattaagtgaacaagtc

SEQ ID NO: 95153 - DNA, 50 bp, homo sapien
agtaatgataggtacaattacacccrtctgtggaaaattgcccttggctt

SEQ ID NO: 95154 - DNA, 50 bp, homo sapien
tcttcttactcccttctagtcacacrgtgcttagggcttttgcactgaaa

SEQ ID NO: 95155 - DNA, 50 bp, homo sapien
acaggttctatttttgctctataaaytgatagctctttgttcatcaaaag

SEQ ID NO: 95156 - DNA, 50 bp, homo sapien
tgaaagcaaggtaattaatagagaasaaaggatgcaagtttggggaaata

SEQ ID NO: 95157 - DNA, 50 bp, homo sapien
aaaaacagaaaagtcacatcctaaargagatgcaaaggacccattgagag

SEQ ID NO: 95158 - DNA, 50 bp, homo sapien
taaagcaatactaaatgagatgttaycaaatagctaccccttctcatgaa

SEQ ID NO: 95159 - DNA, 50 bp, homo sapien
gcattcctaatattccatcagttackcaaattctaccaaacttttgcata

SEQ ID NO: 95160 - DNA, 50 bp, homo sapien
aaattctctaagaagcagacatataktagaatcaaatttcactacctaat

SEQ ID NO: 95161 - DNA, 50 bp, homo sapien
aagcactttgatattcctaagtagaragagattcagtaaaataaagtctg

SEQ ID NO: 95162 - DNA, 50 bp, homo sapien
atacactagaaagcataagaccagargccggaatgtcttatggaaccctc

SEQ ID NO: 95163 - DNA, 50 bp, homo sapien
atgagttatagtattcaccaaataartgttagcagagactcccaactctg

SEQ ID NO: 95164 - DNA, 50 bp, homo sapien
cagaatataaaatgttgtcacaaaartagcctgatatatcacagaggccc

SEQ ID NO: 95165 - DNA, 50 bp, homo sapien
aaagacagttgttttcctgactgacmcgttcttagtttataacatttaat

SEQ ID NO: 95166 - DNA, 50 bp, homo sapien
ggatggtgttttttttctcctcaacrattggaagtattattttaattgtg

SEQ ID NO: 95167 - DNA, 50 bp, homo sapien
ttaaaaaatccaccctcagttccttyttggaaatctttcagaaaaggcag

SEQ ID NO: 95168 - DNA, 50 bp, homo sapien
ttgatgattcctgaaccagttttacyatgatgcttatcaaatggtgattt

SEQ ID NO: 95169 - DNA, 50 bp, homo sapien
atttatatcttagaattaatactggraagttcctaaaacacaagaataca

SEQ ID NO: 95170 - DNA, 50 bp, homo sapien
tgaaatggatgctttgacccattacrgctaaagtaaaggctgagctccaa

SEQ ID NO: 95171 - DNA, 50 bp, homo sapien
cagaagttttgaaataaagttgaaaygtgtggtgtcattctacctggaac

SEQ ID NO: 95172 - DNA, 50 bp, homo sapien
tcagatttctgacacaatggtaacayctatcccttctgcctgtgactgcc

SEQ ID NO: 95173 - DNA, 50 bp, homo sapien
tgtgggaagattcttactataaaaasactgtatgcgggaagttttagggt

SEQ ID NO: 95174 - DNA, 50 bp, homo sapien
tgaaaggttataactgataccgatayatttatggctgcaacagactagtc

SEQ ID NO: 95175 - DNA, 50 bp, homo sapien
tctagagaaaatgaatgttgaacaargcatagaggaaatctgtgtaacat

SEQ ID NO: 95176 - DNA, 50 bp, homo sapien
atggtatctgttccctgaaatatgaygtaaaatagtttatcagttaaacc

SEQ ID NO: 95177 - DNA, 50 bp, homo sapien
caaagtctactactttaacacatackattacagaattttagaagtggcat

SEQ ID NO: 95178 - DNA, 50 bp, homo sapien
aaattaaacagttgcagtttaatcaraaatttacttaatagattacaata

SEQ ID NO: 95179 - DNA, 50 bp, homo sapien
ggtgtttataacattaagaagtttamaaggctgaataaaattgggaatgc

SEQ ID NO: 95180 - DNA, 50 bp, homo sapien
gtataatatgccaattagacaaacartggtgcaaagagaaccactataga

SEQ ID NO: 95181 - DNA, 50 bp, homo sapien
tttctattgcacaggacactattacyaggcaaatatatgaagcaagtgat

SEQ ID NO: 95182 - DNA, 50 bp, homo sapien
agttccctttactcaccatctcaatyacttacatgaaaggatttgttttg

SEQ ID NO: 95183 - DNA, 50 bp, homo sapien
agtaaaattcaaatggtctttttttycacaagaacatgagatggcccttt

SEQ ID NO: 95184 - DNA, 50 bp, homo sapien
taaaatgacatgttgtgggagtacayagaaaactgttatgtttgggtgtt

SEQ ID NO: 95185 - DNA, 50 bp, homo sapien
cttctgcttgactttagccaggaatkagtgttaggaaagaggggatgctc

SEQ ID NO: 95186 - DNA, 50 bp, homo sapien
tattttgtggacttgatgggctggcraaatgtatgtgcatagacatgaat

SEQ ID NO: 95187 - DNA, 50 bp, homo sapien
tataagtatggacataactctagtamcattctgagcaattttcttttgtt

SEQ ID NO: 95188 - DNA, 50 bp, homo sapien
ctgtgaaagagaacattggtggaaaygcccagcagagagcaccatatggc

SEQ ID NO: 95189 - DNA, 50 bp, homo sapien
aaaaagagaattaaattaagctttcyatgggtcatctaacatataattgc

SEQ ID NO: 95190 - DNA, 50 bp, homo sapien
agggcagacccataccagagtttaaygtggcaacaaagtgtggttagaca

SEQ ID NO: 95191 - DNA, 50 bp, homo sapien
gttctctttcacagctaaagctgccrgattagctgggataaagtaggggg

SEQ ID NO: 95192 - DNA, 50 bp, homo sapien
agtagaatgttgaatcatgaaagaaktaacaacaaattgcatgcacttca

SEQ ID NO: 95193 - DNA, 50 bp, homo sapien
tggtttcaatcttcataaaaaggaasagagttggtagagtaatgattagt

SEQ ID NO: 95194 - DNA, 50 bp, homo sapien
ggtggcatttgaactggaccttgaargataatcattttctagacagatga

SEQ ID NO: 95195 - DNA, 50 bp, homo sapien
atagttacagtcattgctcttttggkaaaccagttgataaggactgcttg

SEQ ID NO: 95196 - DNA, 50 bp, homo sapien
ggtcagtaaataaaaaaacagagaaygtgtgaagctttaagcttatgcca

SEQ ID NO: 95197 - DNA, 50 bp, homo sapien
ttactgggagggcttgataaaacacmgacttctacttcattgagtatctg

SEQ ID NO: 95198 - DNA, 50 bp, homo sapien
cagaaaaacagaggctgtctctactmtgtacatggagcgtgagaagtagg

SEQ ID NO: 95199 - DNA, 50 bp, homo sapien
attatatttggttacatgcattaaargataaataatttctcttttctcat

SEQ ID NO: 95200 - DNA, 50 bp, homo sapien
ttattttagatagattagatagagcratattatagagatgatagatgtca

SEQ ID NO: 95201 - DNA, 50 bp, homo sapien
aaccagggagaatcaagaattgtggraagtcctaccttggtccaaaatag

SEQ ID NO: 95202 - DNA, 50 bp, homo sapien
tctctatctctctgtcctgtatccaytaatcctaacagtgtttatgtgtg

SEQ ID NO: 95203 - DNA, 50 bp, homo sapien
aaatacatttaagattcatccatgcrgaatatttttttttcttttttctt

SEQ ID NO: 95204 - DNA, 50 bp, homo sapien
agtgggcagactccattccatgaaarcaatcaattttattttaaagatag

SEQ ID NO: 95205 - DNA, 50 bp, homo sapien
ttttcactgaattgctataaccaaayctatagttcctgttgtcctgctgt

SEQ ID NO: 95206 - DNA, 50 bp, homo sapien
aatacaggtttaatttagagtagaaragttagtgagatttgttgctttat

SEQ ID NO: 95207 - DNA, 50 bp, homo sapien
atccccttgattgtttctttctttgrtggtagagaatattggagctgaga

SEQ ID NO: 95208 - DNA, 50 bp, homo sapien
gggtataggcaggtagggacctacartctgataggagtctagagcctggg

SEQ ID NO: 95209 - DNA, 50 bp, homo sapien
tgtctctgttgtctttacttgtttgktctgcctgtaacatttgatacttc

SEQ ID NO: 95210 - DNA, 50 bp, homo sapien
ttgagtttttttattttccaaaaggyccatatgtggagggaaaattttaa

SEQ ID NO: 95211 - DNA, 50 bp, homo sapien
cctggcttttcagtctttgtaatgayggttagtaaataatctgaacaagg

SEQ ID NO: 95212 - DNA, 50 bp, homo sapien
ctctctgctaactttaatatcatacyagttttctatacatcagataatag

SEQ ID NO: 95213 - DNA, 50 bp, homo sapien
agttagcattaaagccaaagtagcartcatacatttggatatcatggaaa

SEQ ID NO: 95214 - DNA, 50 bp, homo sapien
ccatcatcctttactcctaaaatgayatatattatggaactgaggcatct

SEQ ID NO: 95215 - DNA, 50 bp, homo sapien
ttcactatgacttttcattgccttasctatattaaaacaaacaaacaaac

SEQ ID NO: 95216 - DNA, 50 bp, homo sapien
tctacatgagccgtctgaatcactaragcaagaatcaatcagtcagcaat

SEQ ID NO: 95217 - DNA, 50 bp, homo sapien
aaccaaaatgccactacagagtatamgtatcataagagaagacaaactga

SEQ ID NO: 95218 - DNA, 50 bp, homo sapien
tttatttatatgaaatgacaaaagayctcagaattaactttacaagaaga

SEQ ID NO: 95219 - DNA, 50 bp, homo sapien
gtgtctagttgaagtcctagaaagargtattacaactgcagatttctggc

SEQ ID NO: 95220 - DNA, 50 bp, homo sapien
cccgggataagaagctggaagcagtsaggaacataagctactctgggtct

SEQ ID NO: 95221 - DNA, 50 bp, homo sapien
ctctgtgacgtttagtgtgcactgayaggtaatatttaatctcaaaattt

SEQ ID NO: 95222 - DNA, 50 bp, homo sapien
cctctgtgctccagttcttttatcastgaaatggagtttctaatagtgtc

SEQ ID NO: 95223 - DNA, 50 bp, homo sapien
caaatcttattagatctttcttcaamatatatccagttatcaccacccca

SEQ ID NO: 95224 - DNA, 50 bp, homo sapien
ctataagaaagatgctcaactcctayaaataatatgcaacacaagaacat

SEQ ID NO: 95225 - DNA, 50 bp, homo sapien
cacatacacacacatatatatagacrcaactataacaatactcaagcaaa

SEQ ID NO: 95226 - DNA, 50 bp, homo sapien
caatctttttctaataaaatgtagtrgaaacatagtcacactcatttatt

SEQ ID NO: 95227 - DNA, 50 bp, homo sapien
tctttttcatgaaattgaatgttcartcactaacaaaggaatttctccaa

SEQ ID NO: 95228 - DNA, 50 bp, homo sapien
atgagatttaacttaaatgttgtgayagacaaagtaatggtctaccaaat

SEQ ID NO: 95229 - DNA, 50 bp, homo sapien
gtttatagatgaaaagggagatagaratgaatttgattataagaggtcag

SEQ ID NO: 95230 - DNA, 50 bp, homo sapien
tcaacattatgtgttgtaaaaattakgaaagatcactgatcattagagaa

SEQ ID NO: 95231 - DNA, 50 bp, homo sapien
ggactctttcagtgtgcctggtaaayatctacaagtgagatttgtgtagc

SEQ ID NO: 95232 - DNA, 50 bp, homo sapien
tcttctgagggtctgcagagaacaaygaacagagctagacaaatataatt

SEQ ID NO: 95233 - DNA, 50 bp, homo sapien
aaaatagcaaaatggaaggtttcaarttattatactcgagatgttacaat

SEQ ID NO: 95234 - DNA, 32 bp, homo sapien
atggacaggattttaaraattatatattccat

SEQ ID NO: 95235 - DNA, 50 bp, homo sapien
atgaggagagagaaaagaactgatayagggaattgcatgagaaaggccaa

SEQ ID NO: 95236 - DNA, 50 bp, homo sapien
gtgtggtaggattttgattaaaaacrccgagcatcaaaggagatcaggga

SEQ ID NO: 95237 - DNA, 50 bp, homo sapien
tctgggatggcaatgtgacataggasaggaccatgtgaaaagtctctggt

SEQ ID NO: 95238 - DNA, 50 bp, homo sapien
attacataacaaagacaatatttcasaataagtttactaggaaatggcta

SEQ ID NO: 95239 - DNA, 50 bp, homo sapien
tttatttgtttgttgtgccaactcckcaagaattgaaacaccaggagggc

SEQ ID NO: 95240 - DNA, 50 bp, homo sapien
tccggtttcacagttgtcaaaagtayctgaaattgacaaacattgtaaac

SEQ ID NO: 95241 - DNA, 50 bp, homo sapien
tagacactgacatactagaatttccraaacattctgatattacatagaaa

SEQ ID NO: 95242 - DNA, 50 bp, homo sapien
ccttagtagctgctctgttcctcaaygaaaagggatatagtgccctttgc

SEQ ID NO: 95243 - DNA, 50 bp, homo sapien
ctatgtctaaccagccacttattaamacttgacctttctagcgtagatac

SEQ ID NO: 95244 - DNA, 50 bp, homo sapien
aaaggagccttaggaaaatgacttasaggttttggaaatacattgcccga

SEQ ID NO: 95245 - DNA, 50 bp, homo sapien
tcatcttaatatcaactaaatcggakatggctgagactcaaggtatgatt

SEQ ID NO: 95246 - DNA, 50 bp, homo sapien
attgcccaaattttcttgcctttatyaaccaccagatgtcatgcacaaat

SEQ ID NO: 95247 - DNA, 50 bp, homo sapien
tagacttgttatagaatttagttgarcttctacttctcatgcataaaata

SEQ ID NO: 95248 - DNA, 50 bp, homo sapien
gaaagtaagatgatttctgaagatayagatgtagatgtagggaattaatg

SEQ ID NO: 95249 - DNA, 50 bp, homo sapien
agtgtccaaacgacactaaacaagamgaaagctgatacttagacacacca

SEQ ID NO: 95250 - DNA, 50 bp, homo sapien
gatctgaatttaattaaaactgcacraatgcctagatggaagtcaaataa

SEQ ID NO: 95251 - DNA, 50 bp, homo sapien
catcaagaggtagaagactaactcarcaggtggtacagcttaggttagag

SEQ ID NO: 95252 - DNA, 50 bp, homo sapien
acatactacgtaaatacataataaartacaatatactcatgagaatgtca

SEQ ID NO: 95253 - DNA, 50 bp, homo sapien
acacatgtcaaactggtcactagacraggaattaaggattcaacgatgaa

SEQ ID NO: 95254 - DNA, 50 bp, homo sapien
ggcctagaaacctttttacctagcaratttctgataaaaaatcttcattt

SEQ ID NO: 95255 - DNA, 50 bp, homo sapien
aggggagcagtcgctgaaacgagacwctaggctattggcacctagcacgt

SEQ ID NO: 95256 - DNA, 50 bp, homo sapien
tttattgtgaagagtacattatctawcaaggagttgtaataagtctagaa

SEQ ID NO: 95257 - DNA, 50 bp, homo sapien
ttggctttaatttactcttcctagaytccaaaggtgatatttagtttaat

SEQ ID NO: 95258 - DNA, 50 bp, homo sapien
taaggataaaaactagggtgctaccrggaaaacatcatcttagggtaaat

SEQ ID NO: 95259 - DNA, 50 bp, homo sapien
attggcagagcatagaaaaaagagayggccaccatataagccagttagaa

SEQ ID NO: 95260 - DNA, 50 bp, homo sapien
cagcgacactacaggagagagaccaygtgggtaataaaagagaagggaac

SEQ ID NO: 95261 - DNA, 50 bp, homo sapien
tttaggatttcaactataaatcacamagatacaagaaaatagcatgaaac

SEQ ID NO: 95262 - DNA, 50 bp, homo sapien
tcagaccttacccgaggcaagtaackattttcaaagctgttttttaaacc

SEQ ID NO: 95263 - DNA, 50 bp, homo sapien
accacagatgtttgaaaagtgatgayaagtagatgtgctgggttgctttt

SEQ ID NO: 95264 - DNA, 50 bp, homo sapien
ccttagtttttatatctcaacatatragtttgctttgtagttgatgtagc

SEQ ID NO: 95265 - DNA, 50 bp, homo sapien
ggagtgatgaatatcaagatttttayatgtggagctgaaataggaagtct

SEQ ID NO: 95266 - DNA, 50 bp, homo sapien
ttttgtgtaatgtattcaggccttaraccttgtgatttcactctgttttc

SEQ ID NO: 95267 - DNA, 50 bp, homo sapien
aggccatgaggatcttcaaagtcagrattaggataaatcacaaaatttat

SEQ ID NO: 95268 - DNA, 50 bp, homo sapien
gaaaatatctcatttctaatgtcaastatagaaactataatacagcaact

SEQ ID NO: 95269 - DNA, 50 bp, homo sapien
tgtattgggtgtatggattgtctacragatagatacaattctggctgaaa

SEQ ID NO: 95270 - DNA, 50 bp, homo sapien
gttgaaaaataaaactttatggctartcatttgtctccagctttttaggg

SEQ ID NO: 95271 - DNA, 50 bp, homo sapien
agctctttggacttaatctgaatgasagttgccctaaaaagctggagaca

SEQ ID NO: 95272 - DNA, 50 bp, homo sapien
ttgagatgttcacttagagatctcasctatgcttcagtccagcccattac

SEQ ID NO: 95273 - DNA, 50 bp, homo sapien
tataccctagtatctttattgttctyaatggtgtcatttatgtcctttta

SEQ ID NO: 95274 - DNA, 50 bp, homo sapien
ctttgccaaaaaatgctttagttatkaacgcttctgaaagaaactgtcat

SEQ ID NO: 95275 - DNA, 50 bp, homo sapien
ggcaggcttgctttagatgacacaaygactttctgggtacctgtagggaa

SEQ ID NO: 95276 - DNA, 50 bp, homo sapien
gatactaaaatattggaaagtggaaraagataattcacagtgtagacact

SEQ ID NO: 95277 - DNA, 50 bp, homo sapien
aaaggaactaattcataaggtgtgakaaattcaaagaaatgtcacttgtg

SEQ ID NO: 95278 - DNA, 50 bp, homo sapien
tttttagtgttttcaacaaggtatcrccaaaatttaaacaaagttgccct

SEQ ID NO: 95279 - DNA, 50 bp, homo sapien
ccctatttgaacctggatttactgcraaactacaccaaatccaaacactg

SEQ ID NO: 95280 - DNA, 50 bp, homo sapien
agatgtggggttttactactagtcayctgagacacacctcgtcacgtttc

SEQ ID NO: 95281 - DNA, 50 bp, homo sapien
agattctttttacttctcaaactatkactacgacctgccaggggaaaagc

SEQ ID NO: 95282 - DNA, 50 bp, homo sapien
ctgaaagagcatatagtggctaatayatgaggtgcattgagacaaccaag

SEQ ID NO: 95283 - DNA, 50 bp, homo sapien
tctatatctgtttgtaattgatgacrctgagtatacagcgattataataa

SEQ ID NO: 95284 - DNA, 50 bp, homo sapien
accgattacatgttcacttgactgasagatacaatcacctatattaggag

SEQ ID NO: 95285 - DNA, 50 bp, homo sapien
ttgatcttcagaataactctcattgmatattattatcccagtttcataga

SEQ ID NO: 95286 - DNA, 50 bp, homo sapien
catccctgacagatggtcattttaartaccttcagtgatggggaattact

SEQ ID NO: 95287 - DNA, 50 bp, homo sapien
gctaaagaaatatatgcgatgagtcrataaatacatatttattttcaaga

SEQ ID NO: 95288 - DNA, 50 bp, homo sapien
aaaaattgtgcctactatttaaagaycaagcagaataaaaagtacaaaat

SEQ ID NO: 95289 - DNA, 50 bp, homo sapien
tgtaatgatgttttttatcttttaaygctttcaagtatgtcataaaaaat

SEQ ID NO: 95290 - DNA, 50 bp, homo sapien
acaggaggcaagcagacacttagcaygatagttttgtgacagttattaac

SEQ ID NO: 95291 - DNA, 50 bp, homo sapien
gttgagaagaggactgcttgtgagayagaaattgcagcaagtggaaaaaa

SEQ ID NO: 95292 - DNA, 50 bp, homo sapien
cagtcaaaccacaaaaagtgctaagrattgcagtaatcatgaggaagaac

SEQ ID NO: 95293 - DNA, 50 bp, homo sapien
aaagtgatgtgctgtaagaggaagawccaagacaaaattcagtttccctg

SEQ ID NO: 95294 - DNA, 50 bp, homo sapien
taccttcagttgtaagtagatttaayggtgtcttacattgtttctcagct

SEQ ID NO: 95295 - DNA, 50 bp, homo sapien
aagcactcaatttggaggcaacaaarccaagccaatattgactgcacaaa

SEQ ID NO: 95296 - DNA, 50 bp, homo sapien
tgagaatcttctggaactcaggtgamctaacattgatttgggcaccttgg

SEQ ID NO: 95297 - DNA, 50 bp, homo sapien
catctaaaattaaactcatgactackcctactaatctgtttcttcttcag

SEQ ID NO: 95298 - DNA, 50 bp, homo sapien
agggtaggctgccccagtcactctckacttccttccaataactagtccaa

SEQ ID NO: 95299 - DNA, 50 bp, homo sapien
tgtaatacagtgaaataaaaccaaakttcttagagcatggaaaaatgtgc

SEQ ID NO: 95300 - DNA, 50 bp, homo sapien
ataaaccatttttaaatggcttaaakgtaacttgtaaataattcctgtag

SEQ ID NO: 95301 - DNA, 50 bp, homo sapien
ttaggacttgtttatcctttaatacycaacaatattaacaaaaatccaca

SEQ ID NO: 95302 - DNA, 50 bp, homo sapien
tatcaaagtttacaaagtgctattcragggagattaacctgacagtagta

SEQ ID NO: 95303 - DNA, 50 bp, homo sapien
agactaagaaaagagaagtaggaaayagataatgttgaagagaaagcaca

SEQ ID NO: 95304 - DNA, 50 bp, homo sapien
tgtagggggacctaatggactttgayaccatcttctcttgtatagattgc

SEQ ID NO: 95305 - DNA, 50 bp, homo sapien
tcatttatttcttattttcataaaascatatgaccaaatatatgcctgat

SEQ ID NO: 95306 - DNA, 50 bp, homo sapien
aattactctattattattgatacagraaaacagtaacttgatgggactgg

SEQ ID NO: 95307 - DNA, 50 bp, homo sapien
gatatggatactcaagtatataacarcaggaaagatgtgagtttaaaccc

SEQ ID NO: 95308 - DNA, 50 bp, homo sapien
aaaataatgttttcagttacttaaasatcagataaaacacacaaaaaatt

SEQ ID NO: 95309 - DNA, 50 bp, homo sapien
tagtcaggctcttttgcactgtgaawcttttacaataggttaccacagtt

SEQ ID NO: 95310 - DNA, 50 bp, homo sapien
cgactaacactgacatagtgaagaasacatcctcgttctcaacaattcta

SEQ ID NO: 95311 - DNA, 50 bp, homo sapien
ttaataggtatgtgtgacatagaaayacaaaactattggaggggagatgg

SEQ ID NO: 95312 - DNA, 50 bp, homo sapien
tgtaaatcaaatgatagtttaatacraggcaagagctgcaaagacatctg

SEQ ID NO: 95313 - DNA, 50 bp, homo sapien
aaagatcgttcttaggatgatagcasagcaaatggaaacaaagattcaat

SEQ ID NO: 95314 - DNA, 50 bp, homo sapien
tataaaatagtttcaagtatgagacrgtccataataagaatcaagggagc

SEQ ID NO: 95315 - DNA, 50 bp, homo sapien
ttcttgctgagaattaaacttttacracagtatcaaagcactccttatac

SEQ ID NO: 95316 - DNA, 50 bp, homo sapien
taagtctttgccaaagggactgatayactttccgttcaaaatgtttcttc

SEQ ID NO: 95317 - DNA, 50 bp, homo sapien
gcaaataacattcacctgattctgtraaactcataataagaaataatgaa

SEQ ID NO: 95318 - DNA, 50 bp, homo sapien
gaagttttttcacgaaattatagaasaaagtttacacacaatggatctct

SEQ ID NO: 95319 - DNA, 50 bp, homo sapien
ttgttgcctacattcataaatgctayattttagttagaagttagtgaaaa

SEQ ID NO: 95320 - DNA, 50 bp, homo sapien
aggagaaactttggttatagaatgaygactgctgtaatttaaacaatgaa

SEQ ID NO: 95321 - DNA, 50 bp, homo sapien
tatgttagtgaaactagacatgttamagaggcttcttgaaatgtaaaatg

SEQ ID NO: 95322 - DNA, 50 bp, homo sapien
gtggtacttgggttttgattttgatyagagaaaattagaacaggtaatat

SEQ ID NO: 95323 - DNA, 50 bp, homo sapien
ttttaaattacaagtctaaggacaamatatgaatgagtaccagcatcaag

SEQ ID NO: 95324 - DNA, 50 bp, homo sapien
tcagtgtaaactttctacataccttmaaaacctattgatgtacatggcca

SEQ ID NO: 95325 - DNA, 50 bp, homo sapien
gagaaatattttattatggagggtaycagagagccattagaagtttccct

SEQ ID NO: 95326 - DNA, 50 bp, homo sapien
aacatctataatacatattactcctraattgttacactgaggtataaact

SEQ ID NO: 95327 - DNA, 50 bp, homo sapien
agtgtaaaatgtattagagtccagamtatgaaaggaagaagaggatttta

SEQ ID NO: 95328 - DNA, 50 bp, homo sapien
tgaaacctctagaacataaccaccayaaaaccttacatatcttctcctaa

SEQ ID NO: 95329 - DNA, 50 bp, homo sapien
agctctgtaaccaaggcccagtaaarttcaaagatactgcactggctaag

SEQ ID NO: 95330 - DNA, 50 bp, homo sapien
ctgtttgagcctgacatccatttgcyactataactccatagtttactttt

SEQ ID NO: 95331 - DNA, 50 bp, homo sapien
taatgttagcatttggggaacactaraactggcatctgtcataaactctg

SEQ ID NO: 95332 - DNA, 50 bp, homo sapien
tagtaatctttaccctagcactggawatatatgtattttctaatagcaac

SEQ ID NO: 95333 - DNA, 50 bp, homo sapien
tatagcaccattcatagaccttaatragtgactttatactgtggcaaaaa

SEQ ID NO: 95334 - DNA, 50 bp, homo sapien
cttaaaaatattataacaaggaacaygaactatagtggtttctagaaagt

SEQ ID NO: 95335 - DNA, 50 bp, homo sapien
ggatccagataatcaggaatccactraagaaaggtatggtccattcaaga

SEQ ID NO: 95336 - DNA, 50 bp, homo sapien
caagtctgtaatctcatttatcaaarcggatggcaaggatttatgcagaa

SEQ ID NO: 95337 - DNA, 50 bp, homo sapien
gatttattcataaatcaagtaataaygaacaagacataatgtactataat

SEQ ID NO: 95338 - DNA, 50 bp, homo sapien
tagtttggtcatgtgtgtgtactgaytagcggtgatttttgaaatactga

SEQ ID NO: 95339 - DNA, 50 bp, homo sapien
acaggacttggggattagattgggawagtttgtgttgcagatatttcaat

SEQ ID NO: 95340 - DNA, 50 bp, homo sapien
ctgttctggatcttctttattacaaygactcttggctgccttaagtaaca

SEQ ID NO: 95341 - DNA, 50 bp, homo sapien
ttactagtttggctgtacggattgaraagtgataattaagaaacagcaac

SEQ ID NO: 95342 - DNA, 50 bp, homo sapien
tacaaaagcatatgatttctgagaamgttttgctataaaagagaaaagat

SEQ ID NO: 95343 - DNA, 50 bp, homo sapien
aatcaacattttccattatctccctwaaatacacaaactgatgtctatgt

SEQ ID NO: 95344 - DNA, 50 bp, homo sapien
tccggtgggcagtggctaaagagagwcacttgcataccagcttgtcggaa

SEQ ID NO: 95345 - DNA, 50 bp, homo sapien
taccatgtgtatgtttctgtgaaaastgctttaatgttttgacataattt

SEQ ID NO: 95346 - DNA, 50 bp, homo sapien
tgctctcaactttcatggtaactccrattaatttattatagccaactgaa

SEQ ID NO: 95347 - DNA, 50 bp, homo sapien
accatttaatagcaaaatgtctgacrcttacaatccatgtggccccaaag

SEQ ID NO: 95348 - DNA, 50 bp, homo sapien
tgtaagcaggtatcatccaaacagartaaaaaggaagagaaagagcaaat

SEQ ID NO: 95349 - DNA, 50 bp, homo sapien
ttttaccgataaggaaacttagtcaktataaagagcagtaaattccctgg

SEQ ID NO: 95350 - DNA, 50 bp, homo sapien
atgtgagaaaaggaatagacatttcrataatcaaaagctccattccataa

SEQ ID NO: 95351 - DNA, 50 bp, homo sapien
aatgaagactggcttaatgtgttaartacttgcagagataaaatgcagag

SEQ ID NO: 95352 - DNA, 50 bp, homo sapien
gtaagctatatgtatggtatgctacragtttattgagctcagatctagac

SEQ ID NO: 95353 - DNA, 50 bp, homo sapien
attatttagcttttttcctctaaaayccatggagcagagttaagcactat

SEQ ID NO: 95354 - DNA, 50 bp, homo sapien
aatacaaaacagcataatcaatttcrctaatgtcacatttttatacatct

SEQ ID NO: 95355 - DNA, 50 bp, homo sapien
gtttaaataccagtacttgagggacmaatattaccatcttaatctttatt

SEQ ID NO: 95356 - DNA, 50 bp, homo sapien
ttaacatataggacgcctacaaataratgaataaccacatactaaaaaat

SEQ ID NO: 95357 - DNA, 50 bp, homo sapien
aaaaaattccttaagggtgtataacrgcatcctaaagagagcttagatgg

SEQ ID NO: 95358 - DNA, 50 bp, homo sapien
gaatacaacagcatggtgggatgagwaggagttggtgactaagggccatg

SEQ ID NO: 95359 - DNA, 50 bp, homo sapien
tcaactgctttaaaattccacttccraagataccatatgaatctaaataa

SEQ ID NO: 95360 - DNA, 50 bp, homo sapien
gcaaatgcttttgattttttaatagwcatacacagattgtgtttctcctt

SEQ ID NO: 95361 - DNA, 50 bp, homo sapien
tgttcatcattatcttctactaacartcaaaatcaggattcacaccattc

SEQ ID NO: 95362 - DNA, 50 bp, homo sapien
agttcattaaattatctagctgtgamctcctaagaacaaaagattgacta

SEQ ID NO: 95363 - DNA, 50 bp, homo sapien
ggagatccttctcttctccttaaacygaaatcatgattcctgtgctgtgg

SEQ ID NO: 95364 - DNA, 50 bp, homo sapien
cttgtaggagtgaattccagagaagragacttatgttatgacttatgtta

SEQ ID NO: 95365 - DNA, 50 bp, homo sapien
aacattcaaaatagatgaattttcamatccaagttcaacaaatgtaatcc

SEQ ID NO: 95366 - DNA, 50 bp, homo sapien
ccccatatccttgattacccattccrctgtcctgatggatctcttcccta

SEQ ID NO: 95367 - DNA, 50 bp, homo sapien
tgtggactgaataagcagtaatgcartagacacaaactagtttttagggc

SEQ ID NO: 95368 - DNA, 50 bp, homo sapien
tgtttttcacttctcgttagtacaargaaaagatcaagatcattcaaaga

SEQ ID NO: 95369 - DNA, 50 bp, homo sapien
gcactacagcggtcttcagtgaagcraacccttaatctactgacaaggga

SEQ ID NO: 95370 - DNA, 50 bp, homo sapien
tgaacaagacaaaaaaattagacctsaagtccagaaagatttttctaggt

SEQ ID NO: 95371 - DNA, 50 bp, homo sapien
tctaagtcaatagacaagtgacattwaacatatagaacatctttgagaat

SEQ ID NO: 95372 - DNA, 50 bp, homo sapien
ctttgttacctaagaatgccttccamattgtatcaggatttcagagaaag

SEQ ID NO: 95373 - DNA, 50 bp, homo sapien
tgaacatttactactacagcgaggtraaagtgtttgtaagtggtacctgt

SEQ ID NO: 95374 - DNA, 50 bp, homo sapien
gttctgttctccttcaggaaagtcaycctttaggaaaagagagggatttg

SEQ ID NO: 95375 - DNA, 50 bp, homo sapien
gtcagttttgattttttttccactaygccctcaaattaaagacctatttt

SEQ ID NO: 95376 - DNA, 50 bp, homo sapien
aatgctattgtatgaaacaacctaaytgattttatgaagttttcaatatg

SEQ ID NO: 95377 - DNA, 50 bp, homo sapien
tgaaaaagccaatgatagaatgaccyggaagaatgattcagctagaggga

SEQ ID NO: 95378 - DNA, 50 bp, homo sapien
gaagatgagcaaggcttagagacaaraagttcattcaataggctgttgcg

SEQ ID NO: 95379 - DNA, 50 bp, homo sapien
atacatgaatcactgcacagtcacaytgctgtacttaaactgttgtgggt

SEQ ID NO: 95380 - DNA, 50 bp, homo sapien
aatcaaggatatggggttagcttcargtatggttttcaatagtacaatat

SEQ ID NO: 95381 - DNA, 50 bp, homo sapien
ggggcagcaaatgcgggaaacagcasatgatgcaggagttgccagggaag

SEQ ID NO: 95382 - DNA, 50 bp, homo sapien
ctggcctgaggtttaatcctgtttcraccacataacaattcacagtaggt

SEQ ID NO: 95383 - DNA, 50 bp, homo sapien
catatctaatctccaatgaaatattsaaaagttaagttattaaaattgcc

SEQ ID NO: 95384 - DNA, 50 bp, homo sapien
acctaaaaggcttacaatttaatgamctgcaaaggttaggaaacagaaca

SEQ ID NO: 95385 - DNA, 50 bp, homo sapien
tccatcatcttatatttctaatttarctggactgaaatgatgttcatctt

SEQ ID NO: 95386 - DNA, 50 bp, homo sapien
attttatcagcctcttccttcatcayatttctccttgtcgtctgatccag

SEQ ID NO: 95387 - DNA, 50 bp, homo sapien
cccaatctttttatgacctaaagaaygtgaggacagtgtttggggaacca

SEQ ID NO: 95388 - DNA, 50 bp, homo sapien
tcacacatcccaactgcctgacctaygttttaaaatcccaattcaagaat

SEQ ID NO: 95389 - DNA, 50 bp, homo sapien
ggtaaacgcttccactttaaagttaygtttcaaaatcaaagatgatgctc

SEQ ID NO: 95390 - DNA, 50 bp, homo sapien
tgagacagttgcactttattattcartcctactacgctatactacttgat

SEQ ID NO: 95391 - DNA, 50 bp, homo sapien
acattattcctagacattgcatagaraagtcctagttaccaaataaggtt

SEQ ID NO: 95392 - DNA, 50 bp, homo sapien
cccctgcattttactaacctaataawgtatccaagagatcatttacatgt

SEQ ID NO: 95393 - DNA, 50 bp, homo sapien
gaatgcagtattcattatcagtttgyaaatggaacattctcagtagcagg

SEQ ID NO: 95394 - DNA, 50 bp, homo sapien
gcccccgtttgctctgtatgccagayggtcaagaatgccaagtggactga

SEQ ID NO: 95395 - DNA, 50 bp, homo sapien
gtttcttggctttagttaaaaagccrcaactgattcttcagtgatttgaa

SEQ ID NO: 95396 - DNA, 50 bp, homo sapien
aggtgccatggacgaggataaggatsacttctgaatcagatattgtggat

SEQ ID NO: 95397 - DNA, 50 bp, homo sapien
catccatcttgatcccataaggtaaytcatttcttacagaatttagggct

SEQ ID NO: 95398 - DNA, 50 bp, homo sapien
taaaatgttatggctcaaggataaayaaaatagaatcatgggacccaggg

SEQ ID NO: 95399 - DNA, 50 bp, homo sapien
ctaactccaaaccacctgcataacaycatctcttggctcttctctgtcag

SEQ ID NO: 95400 - DNA, 50 bp, homo sapien
aagtccaggcttcgcttgattttcawtatgaggacagtgagtaatttttc

SEQ ID NO: 95401 - DNA, 50 bp, homo sapien
aacatgggctcctccacctcaacctwactataactgaattatttgcatct

SEQ ID NO: 95402 - DNA, 50 bp, homo sapien
agaagtaattgtttttatttattttyctgtatcagtgtgttagctgtcgc

SEQ ID NO: 95403 - DNA, 50 bp, homo sapien
ttattcttgctgtttcagggctcacycagtagtattccacagatatcatt

SEQ ID NO: 95404 - DNA, 50 bp, homo sapien
tgtattcaaacctcctgtgaaggaamcttctgatttcatattcattacaa

SEQ ID NO: 95405 - DNA, 50 bp, homo sapien
aagctttattagcaaaaaatctgcastctatgggaaacgaagcttttatg

SEQ ID NO: 95406 - DNA, 50 bp, homo sapien
ctaacaaatgtctttgtgataacaaygaagttaaatgaactgaatttgct

SEQ ID NO: 95407 - DNA, 50 bp, homo sapien
ggttgggagaattacttcagagggakagattaataaacattggaatggtt

SEQ ID NO: 95408 - DNA, 50 bp, homo sapien
taaacagagcaagttaatggaaaaaraggaagagattgtaaaaattactt

SEQ ID NO: 95409 - DNA, 50 bp, homo sapien
atatcatttcctcaggaatcatatcsaatccaatccagatgatgcttcca

SEQ ID NO: 95410 - DNA, 50 bp, homo sapien
ttaccaaaataatgtatgtcttaaaygcaatcccaataaaaatctcaaca

SEQ ID NO: 95411 - DNA, 50 bp, homo sapien
aagctcttcactgccaggaacattaycaagtaaaatagagaactgatatc

SEQ ID NO: 95412 - DNA, 50 bp, homo sapien
gatgaaagtggcacataccaattcakaagagagaaaagaaaagcctggct

SEQ ID NO: 95413 - DNA, 50 bp, homo sapien
gttttaagcactaacatgagcaagcraacttgttaaagcatttttgggag

SEQ ID NO: 95414 - DNA, 50 bp, homo sapien
tgaacctccagttagttatgcactcragaagatagatgtgctggactgtg

SEQ ID NO: 95415 - DNA, 50 bp, homo sapien
ataggatttttatttaataccctcaygaacatttgtctaacagggcaatg

SEQ ID NO: 95416 - DNA, 50 bp, homo sapien
taaaacctagcaaattggaaccgaayattatggcttaaggaattaaaagt

SEQ ID NO: 95417 - DNA, 50 bp, homo sapien
gctcccaagcaatgttatccaagtakgtatgcctgatgatgtggcttgat

SEQ ID NO: 95418 - DNA, 50 bp, homo sapien
agaggtttttagctgcactaaattgraatcatgatactactctggaggag

SEQ ID NO: 95419 - DNA, 50 bp, homo sapien
tagtagttagaatatgatgccattakataactttagatgctttaaattgt

SEQ ID NO: 95420 - DNA, 50 bp, homo sapien
gtagactgagaacaaggatagtttgraatgcacataaaataagatcaggt

SEQ ID NO: 95421 - DNA, 50 bp, homo sapien
ccagatccttcaggccatagtaggtyaagtaaggagtgcagaggcaattg

SEQ ID NO: 95422 - DNA, 50 bp, homo sapien
agaatatgatattttgctactcttaygttgtttgaaaatattaattggaa

SEQ ID NO: 95423 - DNA, 50 bp, homo sapien
gtatcctatttggatgtgtggaaacygagtgtgtctaaggattcggagga

SEQ ID NO: 95424 - DNA, 50 bp, homo sapien
taataagaactatggcagttggtgamacccacctaacaacctcacaggtg

SEQ ID NO: 95425 - DNA, 50 bp, homo sapien
taagcaaatggatgtatagaccaaakggatgtatagattagataatgcaa

SEQ ID NO: 95426 - DNA, 50 bp, homo sapien
aactacagctaagatagtttaaaagscttgccaaaatctatccaactcac

SEQ ID NO: 95427 - DNA, 50 bp, homo sapien
ttttcctgatttccagcacatctaayccaaaaataataataatgaaaaat

SEQ ID NO: 95428 - DNA, 50 bp, homo sapien
aactgaaaattttataatggaaatargaagtataactctccaaatataag

SEQ ID NO: 95429 - DNA, 50 bp, homo sapien
attatttaagatattcagtaaagcargtgaatgctagtcagggtaaaagt

SEQ ID NO: 95430 - DNA, 50 bp, homo sapien
cttaaaaatatagatagccaagtgaraaagatataatgcaaactttgggg

SEQ ID NO: 95431 - DNA, 50 bp, homo sapien
ttttggaaacgactaaattgcatagrctatcattttattgtgctaggtct

SEQ ID NO: 95432 - DNA, 50 bp, homo sapien
aggtctagatgcaagaatcaatgtayccttttggagtaaatctgcctctc

SEQ ID NO: 95433 - DNA, 50 bp, homo sapien
agaatcctgagatcacataatgctaracgtgaagagatttatgtatcaag

SEQ ID NO: 95434 - DNA, 50 bp, homo sapien
aaaggaatgagaaaagacagtgtgaracagaaagtgggtccaggggtcaa

SEQ ID NO: 95435 - DNA, 50 bp, homo sapien
ttaaggatctgacgatagctatgaamcttttccctagaaaaatgtaccac

SEQ ID NO: 95436 - DNA, 50 bp, homo sapien
caaaccacaggaggttagtacaaagycaaagaccttcaagtaccatcaat

SEQ ID NO: 95437 - DNA, 50 bp, homo sapien
cctcctccaagataaattttgtaaamgcaattcattggggtgaagtgaat

SEQ ID NO: 95438 - DNA, 50 bp, homo sapien
tattactaaagatgatgaaataaagwaaaaatcaaaatagctgaaacttc

SEQ ID NO: 95439 - DNA, 50 bp, homo sapien
tctccctgtgcctccactagcacaaycttaattcaaagctttaccatctc

SEQ ID NO: 95440 - DNA, 50 bp, homo sapien
ttctaaccctgtctgtattcctatcrctcacattcagtatgcttgtgaat

SEQ ID NO: 95441 - DNA, 50 bp, homo sapien
ggcattagattttcataggagcatayaccctcttgtgaaccgcacatgtg

SEQ ID NO: 95442 - DNA, 50 bp, homo sapien
cagagaaagaaaaagagattgttcaragacaacatattccttactattct

SEQ ID NO: 95443 - DNA, 50 bp, homo sapien
ctttggctaatgtcaatggtaagatkttggactaagtttatgggaggtgg

SEQ ID NO: 95444 - DNA, 50 bp, homo sapien
aagtgattttgtactgaacttatttwaaaaggcagcaaaaatagaatggc

SEQ ID NO: 95445 - DNA, 50 bp, homo sapien
cattgtatctacccagaattgtatawtataactgttacaataagtcaaga

SEQ ID NO: 95446 - DNA, 50 bp, homo sapien
ttaacattatttacatgttacttaaygatggttattctatctacaactgt

SEQ ID NO: 95447 - DNA, 50 bp, homo sapien
ttagggtaaagatgtgaaatatttgkagaactctggaaaacatgccccct

SEQ ID NO: 95448 - DNA, 50 bp, homo sapien
aattcagtatcagccaatagaattaygagaccagcaagaaagttattata

SEQ ID NO: 95449 - DNA, 50 bp, homo sapien
taacacccagcatcaacttgtcaacsaactgagtgagccatcttggacgg

SEQ ID NO: 95450 - DNA, 50 bp, homo sapien
gtaaactgttctgtgggttgatagaygttttccactggggatatttggaa

SEQ ID NO: 95451 - DNA, 50 bp, homo sapien
tccctcaagcttcctgttcacttaaragattattccttgaaaaataaatt

SEQ ID NO: 95452 - DNA, 50 bp, homo sapien
tttgtgagacaattagcaaaatttgraagagatctgtagatgaaagttag

SEQ ID NO: 95453 - DNA, 50 bp, homo sapien
atcaacatcactataaataacaacartaacaaatatttatctttctgata

SEQ ID NO: 95454 - DNA, 50 bp, homo sapien
ctggtggttttgccaactgcaaggcragttcattccaattatacatccat

SEQ ID NO: 95455 - DNA, 50 bp, homo sapien
aggataaactggtagatatggagcartaggtagatttaagagatttcatg

SEQ ID NO: 95456 - DNA, 50 bp, homo sapien
attcaggccatcgtgaactcaaatgwactattctgatagcctcctaaatg

SEQ ID NO: 95457 - DNA, 50 bp, homo sapien
aattttccttaccattctctaacaartcttcaacataatatatttcccta

SEQ ID NO: 95458 - DNA, 50 bp, homo sapien
aatagtgtttgaacctgtagcaggakaaaggcacttggttagatctgggt

SEQ ID NO: 95459 - DNA, 50 bp, homo sapien
ccctgggtcttcagctcacagatggwagatagtgggaattcttagtctct

SEQ ID NO: 95460 - DNA, 50 bp, homo sapien
ggagttgtttttttctttaatgtacraaaatgtgtaacataagtcagaga

SEQ ID NO: 95461 - DNA, 50 bp, homo sapien
taagtagaagagctaggatcaaatasgtctgttcaatcacaaatcccatg

SEQ ID NO: 95462 - DNA, 50 bp, homo sapien
aaaaaaatgtaggctgagaggctaarccagtctgatctctccacgttgtt

SEQ ID NO: 95463 - DNA, 50 bp, homo sapien
aaataaaatagaccttccttacaaaygtacagtgacaatggcatatctga

SEQ ID NO: 95464 - DNA, 50 bp, homo sapien
tgtgaagcaacaatattggagacccraaaggactaaaaaatattgctgtc

SEQ ID NO: 95465 - DNA, 50 bp, homo sapien
ataactgtttggttacacgggttcayagctatagagaaagtttgcctcaa

SEQ ID NO: 95466 - DNA, 50 bp, homo sapien
acagggtcctctttcaaatgtgatargttcactgtttctctgaaaaatag

SEQ ID NO: 95467 - DNA, 50 bp, homo sapien
aaaaggagacattaaaaaagaaacartaagagtgagagttgatttttaac

SEQ ID NO: 95468 - DNA, 50 bp, homo sapien
tctcaataatggtttacgtgcatcarattctttgtggcaaaatgggcata

SEQ ID NO: 95469 - DNA, 50 bp, homo sapien
catttaaaatgtttcagtcactatawatatgttatacacacctgtaaatt

SEQ ID NO: 95470 - DNA, 50 bp, homo sapien
agatctgctgatccaggtctaagcayggccctggttattctggcatctga

SEQ ID NO: 95471 - DNA, 50 bp, homo sapien
cttatttaccatctatacccaaagakaaggtaaggttgcttacagatttg

SEQ ID NO: 95472 - DNA, 50 bp, homo sapien
gtttctttttatttgattttggcagragaagaatatttatgtagaacttt

SEQ ID NO: 95473 - DNA, 50 bp, homo sapien
ctatgtgtttttacttctcctaagartaactacaaccatgaatgtgaatt

SEQ ID NO: 95474 - DNA, 50 bp, homo sapien
aaataattgcagaataaggattatcraattaccaagaatttgaaaaatac

SEQ ID NO: 95475 - DNA, 50 bp, homo sapien
ctacatgtatctggtcactgaaataracgtatggtagagtgaaaagaaca

SEQ ID NO: 95476 - DNA, 50 bp, homo sapien
tacatgtagttttctgacctagaaakaaagattggattcattatccatag

SEQ ID NO: 95477 - DNA, 50 bp, homo sapien
aatcagtattgtaatggggaaggtayggagcattcaactatagagagaca

SEQ ID NO: 95478 - DNA, 50 bp, homo sapien
ttgtattaccaagaatacgtaaagakagtaacagaagtcgtcttccttat

SEQ ID NO: 95479 - DNA, 50 bp, homo sapien
acatttgtaaccatgatactttaatyagaagcttagccttgaaattgtga

SEQ ID NO: 95480 - DNA, 50 bp, homo sapien
cacaaaggagacaagaaggtaactawctcctcatccttcaaaagaaatta

SEQ ID NO: 95481 - DNA, 50 bp, homo sapien
agtgaggccagaagaattttgttaawcatctctcatgtgctatgtgacat

SEQ ID NO: 95482 - DNA, 50 bp, homo sapien
ataatcatatgcctgtctaacaatayggattccaaatatatcaaggaaac

SEQ ID NO: 95483 - DNA, 50 bp, homo sapien
tccctgataagatacaaatggttgamagaggcaggctaaacaaattaata

SEQ ID NO: 95484 - DNA, 50 bp, homo sapien
gtaagtataataatagtacagctccraaggtagaatcatcacaacatttt

SEQ ID NO: 95485 - DNA, 50 bp, homo sapien
actactttaacccagtagaggctagkgtcctccatttaagccaggagctg

SEQ ID NO: 95486 - DNA, 50 bp, homo sapien
ataatgagagttctatgatggatatrataaattgtcactcagtagctatc

SEQ ID NO: 95487 - DNA, 50 bp, homo sapien
catgtttctgaataagagaatgtaayctagtgatggttaattttgtatgt

SEQ ID NO: 95488 - DNA, 50 bp, homo sapien
gatttctctttctctctctcattctyacaaatgtgcacatacccacatac

SEQ ID NO: 95489 - DNA, 50 bp, homo sapien
aacttcttcgtatctaattgatccaraggacatgctggctataatggtct

SEQ ID NO: 95490 - DNA, 50 bp, homo sapien
tgctatgtgtcaatgtccttagttakgagatctcaatgttctgggctctt

SEQ ID NO: 95491 - DNA, 50 bp, homo sapien
aactcacttaaatagaaggatcttaygtgatttagaaatcccactagtgg

SEQ ID NO: 95492 - DNA, 50 bp, homo sapien
gaaagtcaaaagaagtgtgtcagaaratattaatggttttgaatctcaaa

SEQ ID NO: 95493 - DNA, 50 bp, homo sapien
atccaggttaattcaatgtattgccraaattctatttagaggcaattaaa

SEQ ID NO: 95494 - DNA, 50 bp, homo sapien
cttctcctctccacacaattcccaaygaagagagatatatgcaagaaaca

SEQ ID NO: 95495 - DNA, 50 bp, homo sapien
ctaatgaccataacaggcttagcacratacacaaggaagtgattggtagt

SEQ ID NO: 95496 - DNA, 50 bp, homo sapien
actcatcctctcattgacgctaatarcagtacttactctaatgaccataa

SEQ ID NO: 95497 - DNA, 50 bp, homo sapien
ataaagaaatagaaaagatagcgtawtacatgccactgaaaaagtttcac

SEQ ID NO: 95498 - DNA, 50 bp, homo sapien
ggcaattaaaatttccattgtaaaarcccctcatgccctttcaaaggtcc

SEQ ID NO: 95499 - DNA, 50 bp, homo sapien
gtatttcataatgcagaattcaaaayctagcccatattggacttacgtga

SEQ ID NO: 95500 - DNA, 50 bp, homo sapien
aagcttgctactatgggttatgtaamagctaacgtcattccaagaaaaat

SEQ ID NO: 95501 - DNA, 50 bp, homo sapien
tggtgcctgagtccttgatcttaacyactttttatgttttctacatttac

SEQ ID NO: 95502 - DNA, 50 bp, homo sapien
aattctctcaggacacttaccttgaraataaaacatgtttatcacctgtc

SEQ ID NO: 95503 - DNA, 50 bp, homo sapien
acttaaaatggctaatgatatcttayctgttcagcaaactgtgaaccaat

SEQ ID NO: 95504 - DNA, 50 bp, homo sapien
caggcacttgatggtgtaagaaaatsacatcaagggaagaagccctggtt

SEQ ID NO: 95505 - DNA, 50 bp, homo sapien
cttgcctgttataatacattctgaartaatctaaacccacttaacaccca

SEQ ID NO: 95506 - DNA, 50 bp, homo sapien
aaaacctcacaggctaaggataaagscctcattttgctgttagttgatta

SEQ ID NO: 95507 - DNA, 50 bp, homo sapien
actgcaacgaactcaaaccctgtgcrctttgccttgtagtgtaatcatga

SEQ ID NO: 95508 - DNA, 50 bp, homo sapien
ttgagaaaagagcttcagtaccaaaygaaacaaagaacacagatttccag

SEQ ID NO: 95509 - DNA, 50 bp, homo sapien
atgccttattgtgatagaataagaaygctcaatttcatgcaggtatatat

SEQ ID NO: 95510 - DNA, 50 bp, homo sapien
attactaggatagcaacataatttaycaactcaacattgactttaaaaac

SEQ ID NO: 95511 - DNA, 50 bp, homo sapien
atggagggaagaggatgtgcatttgyttagatgtttgatagcaaagaggg

SEQ ID NO: 95512 - DNA, 50 bp, homo sapien
ttaggctgaggattttggtcttaggkaaataaatcattgaaggcttggaa

SEQ ID NO: 95513 - DNA, 50 bp, homo sapien
ttgaaagggaatgaagtgtgaatgasaatagcacagagatgtcatagcta

SEQ ID NO: 95514 - DNA, 50 bp, homo sapien
agattatctctaacagctgtataacrcttcattatgtgtacatactataa

SEQ ID NO: 95515 - DNA, 50 bp, homo sapien
aaaatagttgctgtgttttctcaacrgtcgtcagaattataatgctattc

SEQ ID NO: 95516 - DNA, 50 bp, homo sapien
aattaggatgccactctcaagtagayatattattctttaaccaatatacc

SEQ ID NO: 95517 - DNA, 50 bp, homo sapien
taattatttaaaatatcaaaacatcsaatcttttatatcatctgagtaca

SEQ ID NO: 95518 - DNA, 50 bp, homo sapien
cacttagaacttgcctataacagaayatattagaagtgatgctgcctgac

SEQ ID NO: 95519 - DNA, 50 bp, homo sapien
agcttaacatttacatagttcttackacttgccacacactgttctaagtg

SEQ ID NO: 95520 - DNA, 50 bp, homo sapien
tcttataaataacctccttataccaygtactgaaaaagtcaacagaggag

SEQ ID NO: 95521 - DNA, 50 bp, homo sapien
tataagtgagaacacgcagtattcasctttcaaagattacatactctcta

SEQ ID NO: 95522 - DNA, 50 bp, homo sapien
ctgctcatggataaaatgtcttcaayaaaatcggtccttggcaaccgctg

SEQ ID NO: 95523 - DNA, 50 bp, homo sapien
actgatgtgctgagtttttggattaygatccagtctgtgtctggcatgaa

SEQ ID NO: 95524 - DNA, 50 bp, homo sapien
gtaaatgaaaggcatgagacttctcragatgggaacaatgccagagttca

SEQ ID NO: 95525 - DNA, 50 bp, homo sapien
caccatctctaaattctcattgtcayctttatttctctaattctctcaca

SEQ ID NO: 95526 - DNA, 32 bp, homo sapien
aaactctaaaaactaarcacattatcgccttc

SEQ ID NO: 95527 - DNA, 50 bp, homo sapien
ttgtttccctatctttatggttttasgccaaaagacttgaaataattttt

SEQ ID NO: 95528 - DNA, 50 bp, homo sapien
tgacacatttgaggtggttttgtcaygaagaacaagagaaatatgatgga

SEQ ID NO: 95529 - DNA, 50 bp, homo sapien
cagttaactaacgattcaatgattamaataacacttttattagaaagggt

SEQ ID NO: 95530 - DNA, 50 bp, homo sapien
taataaagatctgaaattaataaacrcttgaactgagtggagaatggaag

SEQ ID NO: 95531 - DNA, 50 bp, homo sapien
tgcttctctcttctctacatggatgsaatatgttatacttttttgagctg

SEQ ID NO: 95532 - DNA, 50 bp, homo sapien
caaagaaaatgaatatgaataaaatsaataaattgcaaatcgccagaaaa

SEQ ID NO: 95533 - DNA, 50 bp, homo sapien
actgatagtggaactaatctttcaargttctgcttaagcaattgtagata

SEQ ID NO: 95534 - DNA, 50 bp, homo sapien
tcacttcactgcactcatatgaaacyctaggcctaatagatttgtgcccc

SEQ ID NO: 95535 - DNA, 50 bp, homo sapien
gtgttagtttctgttctttataggaygatacattatttccttgaagcaaa

SEQ ID NO: 95536 - DNA, 50 bp, homo sapien
cctaattttttcctgcctttgataayggctctgtagcaactctagaaaaa

SEQ ID NO: 95537 - DNA, 50 bp, homo sapien
tcatgtacactgagggatgattatayactgtttaaggcatgttacctgtt

SEQ ID NO: 95538 - DNA, 50 bp, homo sapien
ctattgcttgctggcctttggctaawtctgggtatgtaacagggaagata

SEQ ID NO: 95539 - DNA, 50 bp, homo sapien
cttctcagttgtgagattattaaccyaaggttcaaggtcctgaagttttg

SEQ ID NO: 95540 - DNA, 50 bp, homo sapien
aggtttggacccacccacaatgatasagaatacatatcaacaaacactat

SEQ ID NO: 95541 - DNA, 50 bp, homo sapien
ttctcaggccattattccatccctcratccattttctactactttccctg

SEQ ID NO: 95542 - DNA, 50 bp, homo sapien
aggcaatcacatattgtatgtgaaayttttgaaacagtaggttttgtcca

SEQ ID NO: 95543 - DNA, 50 bp, homo sapien
ccacatatatttaattaactcacaaygtattcagacacatgttattatat

SEQ ID NO: 95544 - DNA, 50 bp, homo sapien
aaccagttatgtctatctcaatcaartccacacaattaacgactaaatta

SEQ ID NO: 95545 - DNA, 50 bp, homo sapien
gtcagactccaaaagaacactaaaartcattttcccaaataagttttctt

SEQ ID NO: 95546 - DNA, 50 bp, homo sapien
gacctactacaaaggtagctttgccractaagacccagcagagaataaac

SEQ ID NO: 95547 - DNA, 50 bp, homo sapien
tgaattcttatctttagagtgcttaygaagttttataaattctaacctct

SEQ ID NO: 95548 - DNA, 50 bp, homo sapien
tttcttcctaccaagctccaccttayggtaaattacatcctatcagattc

SEQ ID NO: 95549 - DNA, 50 bp, homo sapien
ccccatagatcatatccttggagaayatttaactgcaaaaggccagaatg

SEQ ID NO: 95550 - DNA, 50 bp, homo sapien
ggtatctaaataagccagtgcatcayggtaagagtcattagcattccttc

SEQ ID NO: 95551 - DNA, 50 bp, homo sapien
tccatatctccaacaccaagtaacaygaacatacaggttacaaattcacc

SEQ ID NO: 95552 - DNA, 50 bp, homo sapien
gcagagagagcaaaggattttataayaggaaggagtgtgaagacaggttt

SEQ ID NO: 95553 - DNA, 50 bp, homo sapien
atgggcagctgattctcagcgataaytcttttcaatggaagggaagcaca

SEQ ID NO: 95554 - DNA, 50 bp, homo sapien
tcaattcctctctggacctgcttacrgaatcatctccataaaaggagaac

SEQ ID NO: 95555 - DNA, 50 bp, homo sapien
gtaataaaagtattcataaagaacasaagcattgcaaaagtggtggacga

SEQ ID NO: 95556 - DNA, 50 bp, homo sapien
ttagctttcttgttacttgtatcacrtaagaaagcacccctaaacaataa

SEQ ID NO: 95557 - DNA, 50 bp, homo sapien
taacacagatttgtcattaaattgawgttattgtcgatggagtatccctt

SEQ ID NO: 95558 - DNA, 50 bp, homo sapien
caagatttcaagtttgatgaaggatmagataagttgttcatgaatatgtt

SEQ ID NO: 95559 - DNA, 50 bp, homo sapien
cccctaaatcatccttcctaaaatasccagcaatacatttgtggttttca

SEQ ID NO: 95560 - DNA, 50 bp, homo sapien
aaacagggctcaactaataacacacratgttctgaacgccaagctcattt

SEQ ID NO: 95561 - DNA, 50 bp, homo sapien
aaaattcaaagtaagaattaacttgsatattgaagcttacttttctagat

SEQ ID NO: 95562 - DNA, 50 bp, homo sapien
catttcaacaatgaaacatttaaaawtatgataagcattttcaagccctg

SEQ ID NO: 95563 - DNA, 50 bp, homo sapien
ctgggtaattattagagatgtgaccrgagaaaattagtgttctgatgtcc

SEQ ID NO: 95564 - DNA, 50 bp, homo sapien
agaacaatggtatacctgttgttgaygaaaattagctattatgatttctt

SEQ ID NO: 95565 - DNA, 50 bp, homo sapien
tctagattagattattttatagccaytaatgtttactctattaaaactca

SEQ ID NO: 95566 - DNA, 50 bp, homo sapien
ggtaaaaatacaattttatggttacratggctgtcctcaatacattggtt

SEQ ID NO: 95567 - DNA, 50 bp, homo sapien
catcatcagaagtgctaaggaaaaakaatgatccatggaggattggatat

SEQ ID NO: 95568 - DNA, 50 bp, homo sapien
taggtaaatgtacacaaataagtaayggaaaagatgattgtgaacatgtc

SEQ ID NO: 95569 - DNA, 50 bp, homo sapien
tttgacttgtctaaaactgatcatcraactcctttgttttcctgacttac

SEQ ID NO: 95570 - DNA, 50 bp, homo sapien
atttcgtctcactttttgttgtttgratcccaatattaagatgacatata

SEQ ID NO: 95571 - DNA, 50 bp, homo sapien
gttatctacatttgtcttagtttccmattcgaaatgtcataggattctat

SEQ ID NO: 95572 - DNA, 50 bp, homo sapien
aaccttgataaattctatgtcagtargagaaagttcaggtttttaatgcc

SEQ ID NO: 95573 - DNA, 50 bp, homo sapien
aaatttgccaagatgcatgatcaacsactcctgggaaatgaaaatgttca

SEQ ID NO: 95574 - DNA, 50 bp, homo sapien
aaatggacattctgcctcctattacyagccctttatatgtactgtcttct

SEQ ID NO: 95575 - DNA, 50 bp, homo sapien
gtgggacctctttgcggcgattcacygaagagctgaagcagattgctagg

SEQ ID NO: 95576 - DNA, 50 bp, homo sapien
aataaaatccaagagtgatatcttaygaggttttgctagtcaccaattaa

SEQ ID NO: 95577 - DNA, 50 bp, homo sapien
tcatatattttaggaagacatggaamgaataccagaataaaataaaaatt

SEQ ID NO: 95578 - DNA, 50 bp, homo sapien
gtgtctctgaatgattccagatgtcraaataataaaacaaaaaaaaagca

SEQ ID NO: 95579 - DNA, 50 bp, homo sapien
tggagtgttgtgaaaacgaaagagtyaatgtacaagaaacaccaagaaca

SEQ ID NO: 95580 - DNA, 32 bp, homo sapien
cattttcattttgagasgtcaatgtagtagtc

SEQ ID NO: 95581 - DNA, 50 bp, homo sapien
tcacagtgtaagagaagttatagaartctacagtaaatagagttaattcc

SEQ ID NO: 95582 - DNA, 50 bp, homo sapien
tcacagaaaatcaatccgtgggtaayagaatcccagctcctatgccaagg

SEQ ID NO: 95583 - DNA, 50 bp, homo sapien
ggaaaagtatttagagctgaaaatakagttgtttcccagaaaattttgtg

SEQ ID NO: 95584 - DNA, 50 bp, homo sapien
ttatgtttgaatacttaagcataaaygttaactggatattttcccttttg

SEQ ID NO: 95585 - DNA, 50 bp, homo sapien
ggaaacatttgttttctgaatttttstactgtggaatttttcaacagcat

SEQ ID NO: 95586 - DNA, 50 bp, homo sapien
gtacagacccaacaccaccacagaawctaggaatttccctagaagcattt

SEQ ID NO: 95587 - DNA, 50 bp, homo sapien
atctagtgaagcagatgcaacgcaargtggagacactgggaactggctgg

SEQ ID NO: 95588 - DNA, 50 bp, homo sapien
tgctctaaagatctgtagttaatgcygattctattttccatttttattct

SEQ ID NO: 95589 - DNA, 50 bp, homo sapien
tgtaggtaatgggaattccatttctktatatgttcatgttcataatagct

SEQ ID NO: 95590 - DNA, 50 bp, homo sapien
catacatttcatatttttctgctaamaggaaaggccactgacatatttaa

SEQ ID NO: 95591 - DNA, 50 bp, homo sapien
tatttttttatgaagggacttgaaaktttattccagagcagtatttaggc

SEQ ID NO: 95592 - DNA, 50 bp, homo sapien
ttacatgttccttctctgcctatacmtgggtccagactccatttctgaaa

SEQ ID NO: 95593 - DNA, 50 bp, homo sapien
ttttttttttctggataaagctatgyactgtgtttgtcaggtggaagatg

SEQ ID NO: 95594 - DNA, 50 bp, homo sapien
atgttttttgctagaccgtccacccracttttaacagcaaagtaactaat

SEQ ID NO: 95595 - DNA, 50 bp, homo sapien
tgcaaaacaattagagttttcaatargaagcataactaatatcccagtca

SEQ ID NO: 95596 - DNA, 50 bp, homo sapien
tactctcctgtgcatcaaatgaccaygttaataaccattaccacagattc

SEQ ID NO: 95597 - DNA, 50 bp, homo sapien
acccagattattgtattcagcaatarcaacaagtaatgaaattagacacc

SEQ ID NO: 95598 - DNA, 50 bp, homo sapien
atatctctattacccccttcagcaaygatgcttccaatatataacttctc

SEQ ID NO: 95599 - DNA, 50 bp, homo sapien
gtttcatcttgaatacatgtagaaarcattactcagaactatggatgagg

SEQ ID NO: 95600 - DNA, 50 bp, homo sapien
caccttttatgactccaatatgagamctgctttatgtctcatacagcatc

SEQ ID NO: 95601 - DNA, 50 bp, homo sapien
gaaggtttacacctatgcattcctcyaagttttagttttaccccttctat

SEQ ID NO: 95602 - DNA, 50 bp, homo sapien
aacattcgcatggcctttgctatcarccaggaaatagcttttttgaacta

SEQ ID NO: 95603 - DNA, 50 bp, homo sapien
ctcatgattggtaggtaaaaatacarttaggcagaactctgatgaaatta

SEQ ID NO: 95604 - DNA, 50 bp, homo sapien
gatgaatttttgaatggcttctttaygttttcttgaagtttgttaagatt

SEQ ID NO: 95605 - DNA, 50 bp, homo sapien
catgtgtaaaccaccataaagtgtayacagccatatctcaaaggacttaa

SEQ ID NO: 95606 - DNA, 50 bp, homo sapien
tattttgtgctcataatgttctaaawttggcctttaaaagctctttcaat

SEQ ID NO: 95607 - DNA, 50 bp, homo sapien
atgagaagaatgtcaattctgttgtwcttacatggagtcttctctagatg

SEQ ID NO: 95608 - DNA, 50 bp, homo sapien
tcttctgagggtatttttggaatacyagtcatttgaatatcgaaagatac

SEQ ID NO: 95609 - DNA, 50 bp, homo sapien
atcattgggacaagtggaaaatccaytggaatacacatatatatagtaaa

SEQ ID NO: 95610 - DNA, 50 bp, homo sapien
taaagttagagtcacataacttttaygcagaaacaccttgtatacaccag

SEQ ID NO: 95611 - DNA, 50 bp, homo sapien
aaacctttgccagctctaacaggcckcgattttaacacatagttgtattc

SEQ ID NO: 95612 - DNA, 50 bp, homo sapien
atttctttccttcactactgaaatcygagtactttctcacaaaagtagct

SEQ ID NO: 95613 - DNA, 50 bp, homo sapien
acagtgtttttttgtgactgactaaygttggaaatgcagaagacccaacg

SEQ ID NO: 95614 - DNA, 50 bp, homo sapien
cagctaaaacctgaacaacgacaaastgaaaggactctgaccctccggca

SEQ ID NO: 95615 - DNA, 50 bp, homo sapien
ctctaatagatcaaggactataggakctatcatcttccctcaacagaaca

SEQ ID NO: 95616 - DNA, 50 bp, homo sapien
cttccagctggagctgtgaccataamccattgtagtatccaggtaagcta

SEQ ID NO: 95617 - DNA, 50 bp, homo sapien
caaaatgaacaagatgagggtgagawatttacttgatgttctctgtgttt

SEQ ID NO: 95618 - DNA, 50 bp, homo sapien
ttaagctgtccaaaatcaactgttascaaactcctcgatcctgctcccat

SEQ ID NO: 95619 - DNA, 50 bp, homo sapien
ttcagactttcagagcaatgggacasaatttagcattttttttgtcagaa

SEQ ID NO: 95620 - DNA, 50 bp, homo sapien
caaacatattttacctcacttatcaytagatccaaccccttatattttca

SEQ ID NO: 95621 - DNA, 50 bp, homo sapien
acacagctatattgagatataattcrcgtactgacatgatttgtctgtgt

SEQ ID NO: 95622 - DNA, 50 bp, homo sapien
aaagaaggggatctttaggaagtaayctgtggcataacagatattacatt

SEQ ID NO: 95623 - DNA, 50 bp, homo sapien
cacaaatgatgtgcatgttcatataygttcacttaaaaggaaagtagtgc

SEQ ID NO: 95624 - DNA, 50 bp, homo sapien
acatttaaaacatctgtctagcaaastcaacctggaatagtgggtgtgca

SEQ ID NO: 95625 - DNA, 50 bp, homo sapien
agagcatgcttttgcactctgacaaytaagtaattcccaaaatgtccatg

SEQ ID NO: 95626 - DNA, 50 bp, homo sapien
ttcagatgagtgaatatcatccaagyaatgtctatcttcaataccacaag

SEQ ID NO: 95627 - DNA, 50 bp, homo sapien
tttgccatattttgatagtggttaaygcaaattttcctagattattcttc

SEQ ID NO: 95628 - DNA, 50 bp, homo sapien
atggtgttataggcatagaacagatsaatcttagcaataaaagcaaatga

SEQ ID NO: 95629 - DNA, 50 bp, homo sapien
tctcctgtgcctgagactgaggccasaaagttaactgtatgttttgagcc

SEQ ID NO: 95630 - DNA, 50 bp, homo sapien
aacaaactagccacaaaaggacttayatcagaaatctgtggcaggcatct

SEQ ID NO: 95631 - DNA, 50 bp, homo sapien
tgttggcagcattacattacattcayaaggacagtgagtgaagatcccaa

SEQ ID NO: 95632 - DNA, 50 bp, homo sapien
taagtttggcttctaacaacagttcratgcctctcccatgacctactcta

SEQ ID NO: 95633 - DNA, 50 bp, homo sapien
aacaaaacaactccttttctgtgcawaaaaattatcttcaaaagtacctc

SEQ ID NO: 95634 - DNA, 50 bp, homo sapien
aagaaaacacttgacctattagccaycatcgactatagggaacttaacac

SEQ ID NO: 95635 - DNA, 50 bp, homo sapien
taagcagatatgcttgcaaaaacaamatcattctttacagtacatggaaa

SEQ ID NO: 95636 - DNA, 50 bp, homo sapien
gcttcctgaacagttgtcaataaackaaattacacaacttgtaaatgtga

SEQ ID NO: 95637 - DNA, 50 bp, homo sapien
acagatttcttattttttactggcawtatagttgggtctctggaatatta

SEQ ID NO: 95638 - DNA, 50 bp, homo sapien
tcagtggattagattacctttgtgaratggttggctggaggtaaatgcat

SEQ ID NO: 95639 - DNA, 50 bp, homo sapien
tggaacactatgctttatccatgacyattgatttccaccatttgcttcaa

SEQ ID NO: 95640 - DNA, 50 bp, homo sapien
aagcaaaacaacagtgtatatcaccrcataaattatttgacattaaaaat

SEQ ID NO: 95641 - DNA, 50 bp, homo sapien
actcgaggtccccttctttcctcaakggatcaaatcaaacctgctctact

SEQ ID NO: 95642 - DNA, 50 bp, homo sapien
tgtgaatgtcatgatttttatacgaygagcaagaggtaaaagggtagcct

SEQ ID NO: 95643 - DNA, 50 bp, homo sapien
tatggaaggaaaactccatgtaactraaaaatcatctcaaatgcatattg

SEQ ID NO: 95644 - DNA, 50 bp, homo sapien
ttaaagatgcaattccaacatttaargtatctgtcagttaaggaaaagtt

SEQ ID NO: 95645 - DNA, 50 bp, homo sapien
ggcacagtaagataagtgagggtgaygtaatggaaggaactggagtctga

SEQ ID NO: 95646 - DNA, 50 bp, homo sapien
gcacttggatggtcgaatttttagcyctatgtcacaactgactagacatt

SEQ ID NO: 95647 - DNA, 50 bp, homo sapien
aagaatcagattttcttatgtactayctgcaaatgtatccatctgttcat

SEQ ID NO: 95648 - DNA, 50 bp, homo sapien
aggcgctgtttagctatttggcctakatactagtaaactgctttggggtt

SEQ ID NO: 95649 - DNA, 50 bp, homo sapien
aatatgtaggtatagtaactatgtargactttcactacagtcatttcatg

SEQ ID NO: 95650 - DNA, 50 bp, homo sapien
catttagagaaatgcaaaatacaccrgaaagtcccagcaatagagttgaa

SEQ ID NO: 95651 - DNA, 50 bp, homo sapien
tcattctttgaaaaactgtaacatgraatgactgtagtgaaagtcctaca

SEQ ID NO: 95652 - DNA, 50 bp, homo sapien
caaatacctccttccttttctaagcrcaaactaaagtgagtagcatgtgt

SEQ ID NO: 95653 - DNA, 50 bp, homo sapien
tgtcattttatatagcaatataaccraaatctgtctacaaaaacaacttt

SEQ ID NO: 95654 - DNA, 50 bp, homo sapien
tgctaggttctagacttgaaacagamattttttaaaacattgaattaggc

SEQ ID NO: 95655 - DNA, 50 bp, homo sapien
cattttgtgtaaacatgttgaaaccygacttgatttaagccatttctctt

SEQ ID NO: 95656 - DNA, 50 bp, homo sapien
acaaattatgtccacaaatgtttgayacttctgcaattgagaggcaggtt

SEQ ID NO: 95657 - DNA, 50 bp, homo sapien
tgtttgacttgagatttctggtgccytctttacaggatctaaggatttag

SEQ ID NO: 95658 - DNA, 50 bp, homo sapien
ggacaacttgctgaaggctcaggtarctgttagcatgtattagcataaag

SEQ ID NO: 95659 - DNA, 50 bp, homo sapien
ccagctttggggctctaagtcaaaaytctaagacagtagggaacatccca

SEQ ID NO: 95660 - DNA, 50 bp, homo sapien
aggtgctccctttaaggctaaatcaygaaatatcctaaatgctggaaatg

SEQ ID NO: 95661 - DNA, 50 bp, homo sapien
tgatcagcataaagtcaggatgttcrataaccgcagatagttttccaaat

SEQ ID NO: 95662 - DNA, 50 bp, homo sapien
aaaaaagaaaggtgttgctctgaaaratgataggtttaaaatgcaagggt

SEQ ID NO: 95663 - DNA, 50 bp, homo sapien
atcttaaaatggatatgaaatggtartaaactgttaattctttaaaatga

SEQ ID NO: 95664 - DNA, 50 bp, homo sapien
aaaaagtatcactcacctttactatwaaatcagattgtatgttaggtctt

SEQ ID NO: 95665 - DNA, 50 bp, homo sapien
atggaccccatcctagcagaattcaygccctgctaactgaagtggtcctg

SEQ ID NO: 95666 - DNA, 50 bp, homo sapien
ttattaattttttttgtagttgttayacatttggtagcatgctggaattt

SEQ ID NO: 95667 - DNA, 50 bp, homo sapien
cagagccccaaattgggactctccaygtgtatttattttgctaaacgagt

SEQ ID NO: 95668 - DNA, 50 bp, homo sapien
ctgttcatgattatgcttagttttawctccacagaattgttgctgtgttt

SEQ ID NO: 95669 - DNA, 50 bp, homo sapien
aataggagttaacacagacccagtcrttgaagcaagcaccttggtaaacc

SEQ ID NO: 95670 - DNA, 50 bp, homo sapien
atgacatttatcaatgtgttttcacraggtggtatatcgaataaggcagt

SEQ ID NO: 95671 - DNA, 50 bp, homo sapien
ctaacactggtaacatggtctcatgkagtactattctatcatgttgctgg

SEQ ID NO: 95672 - DNA, 50 bp, homo sapien
tgtcaatagggtatggctacttgaastgtatatgagcagcatcattttct

SEQ ID NO: 95673 - DNA, 50 bp, homo sapien
tttttatctttctatactctttgtaygcccaattgagaatagtctctact

SEQ ID NO: 95674 - DNA, 50 bp, homo sapien
taacatcaagtttgactgtcataaayaggctttggaacaaacacaactga

SEQ ID NO: 95675 - DNA, 50 bp, homo sapien
aaaacaatgctcagagggaaatatayagctgcaaatgcctttcttaaaaa

SEQ ID NO: 95676 - DNA, 50 bp, homo sapien
aatgcttacagccccgtgcatgtacraagatgaaaaatcagtgcaattgg

SEQ ID NO: 95677 - DNA, 50 bp, homo sapien
ggaggatgaaaaccaaacacatcatrtcaaaatgcatgggattaaataaa

SEQ ID NO: 95678 - DNA, 50 bp, homo sapien
atgctaaagttttgtaatgagcattrtgaagtttaacatgtatttaaaat

SEQ ID NO: 95679 - DNA, 50 bp, homo sapien
acagacttattaaattttttagggayactcgagatcaactgactcagaaa

SEQ ID NO: 95680 - DNA, 50 bp, homo sapien
gatttttcttataagaccaacattcyttgttaagtgaaataatgatttca

SEQ ID NO: 95681 - DNA, 50 bp, homo sapien
atggagcaaagaaaacttggttaaasataaggctgtaatgccagatgaca

SEQ ID NO: 95682 - DNA, 50 bp, homo sapien
gacatggaatactttgttggatagakagtaaacatcctctttttccttga

SEQ ID NO: 95683 - DNA, 50 bp, homo sapien
ttcttgcttcctatatgtaaataaayggtgaagtcttatcagttttgctc

SEQ ID NO: 95684 - DNA, 50 bp, homo sapien
tgagaaatttacatccaggcactatygtagatccagattttggggagtat

SEQ ID NO: 95685 - DNA, 50 bp, homo sapien
tagtatctgcagtttcaggcatagamtaagaggcttgaattcccctgcag

SEQ ID NO: 95686 - DNA, 50 bp, homo sapien
accatatataattcaggagtaagaastcattactttgcgaacatacttaa

SEQ ID NO: 95687 - DNA, 50 bp, homo sapien
gcagagaaatatttaaatatacctgratccaaattacattttccttctac

SEQ ID NO: 95688 - DNA, 50 bp, homo sapien
tatctcagagtgacctcacatttaamaaggtcctgaactaatttattgtc

SEQ ID NO: 95689 - DNA, 50 bp, homo sapien
actaagtggatgatgagttagggaayaccggatgaggagtcataacaaga

SEQ ID NO: 95690 - DNA, 50 bp, homo sapien
tctgttgtttttgcttttataaagaytctaaccagcactgaggtaatgga

SEQ ID NO: 95691 - DNA, 50 bp, homo sapien
atatttttatcttatgcatcctaaamtacagaagagactatgagtttaaa

SEQ ID NO: 95692 - DNA, 50 bp, homo sapien
ggggctgataaaaacttaactttcawctagtatccagtatgtgcaacata

SEQ ID NO: 95693 - DNA, 50 bp, homo sapien
tttttcaatagactatacattctccmagacaggtattgtgacttgtatac

SEQ ID NO: 95694 - DNA, 50 bp, homo sapien
tcttgggtgaagagggataagactcmgacacattctacagtttctcggag

SEQ ID NO: 95695 - DNA, 50 bp, homo sapien
tccagatcggttcttggcaataaaayttagagcaggagaaagaagataag

SEQ ID NO: 95696 - DNA, 50 bp, homo sapien
ttattcagtcctattttcattcatargtcagccagtcactgtatctccta

SEQ ID NO: 95697 - DNA, 50 bp, homo sapien
ctttttcactgttgtaataatttcckatatactcagcacttttgtttgtg

SEQ ID NO: 95698 - DNA, 50 bp, homo sapien
atcagcaacctatctttgagttataygatcagattctcttgaacttgcat

SEQ ID NO: 95699 - DNA, 50 bp, homo sapien
aaatgtgtataatactaaatataacwatgcttaacaaaggatagaatcac

SEQ ID NO: 95700 - DNA, 50 bp, homo sapien
aaatacatttagttacatttgagtayaatgtaggtcgggactttaatttt

SEQ ID NO: 95701 - DNA, 50 bp, homo sapien
ttcctaccaaagtcctattctatacwgaagaaaagaagctaaaagaagcc

SEQ ID NO: 95702 - DNA, 50 bp, homo sapien
acctatatcttacatatgattctcawccttaagactatggatcattttaa

SEQ ID NO: 95703 - DNA, 50 bp, homo sapien
tttatccttctaaggaaacctgtaastaccagtgcagtaattgaagtgag

SEQ ID NO: 95704 - DNA, 50 bp, homo sapien
tccaacactatgtatgtgaacataartcagtttaaccacttggaaaagtg

SEQ ID NO: 95705 - DNA, 50 bp, homo sapien
acttccctaatcgaatccatcaaaastcttaatgtccacttagacatttc

SEQ ID NO: 95706 - DNA, 50 bp, homo sapien
gttatttttaactattgaatcgtagkatttctgtatatattttggatatt

SEQ ID NO: 95707 - DNA, 50 bp, homo sapien
cataacggctgtctcattttatactsctactaacagtgcacaaagcttcc

SEQ ID NO: 95708 - DNA, 50 bp, homo sapien
tctagaagttttaattaagactaaaytagattacataccaagatgctgtg

SEQ ID NO: 95709 - DNA, 50 bp, homo sapien
tctttttgtcccaaaaccaagacaaygtcacaactttcacacaatcttat

SEQ ID NO: 95710 - DNA, 50 bp, homo sapien
aaattatcttccgtaacttagattayattcacctccatatagaattactc

SEQ ID NO: 95711 - DNA, 50 bp, homo sapien
tcaaatgctggctggagctacacacygtcaaattaaggctcaaataaggc

SEQ ID NO: 95712 - DNA, 50 bp, homo sapien
ttaagatagtattctgtatatacacraacaattattattgttccttctta

SEQ ID NO: 95713 - DNA, 50 bp, homo sapien
acatcattaaacataagtattacccrgaaatttgtctagctccaaataca

SEQ ID NO: 95714 - DNA, 50 bp, homo sapien
ttcacatttggatggatctctgtcaytaaggaatgttttctctgagcagt

SEQ ID NO: 95715 - DNA, 50 bp, homo sapien
ataaccaaacttaactctagccctawcatagacaaaataagccagtttca

SEQ ID NO: 95716 - DNA, 50 bp, homo sapien
tttaaattgataccaacatagcctcratagcataaaaacactctgtttca

SEQ ID NO: 95717 - DNA, 50 bp, homo sapien
taatataaaataagatcaagtttatsataaaatgttatagatcttggagt

SEQ ID NO: 95718 - DNA, 50 bp, homo sapien
tttttaatgtaaggaaatggagaagraatgagactgagagatacataaaa

SEQ ID NO: 95719 - DNA, 50 bp, homo sapien
gcatttgttgggacagatctttgctsacggaagacttatgaacaatgtga

SEQ ID NO: 95720 - DNA, 50 bp, homo sapien
tcaagctggcccttatcctgattcayggtggctgcaggaggggggtgagg

SEQ ID NO: 95721 - DNA, 50 bp, homo sapien
aaatattgtttgtcataaatccaatraatgttgactaactgatatggttt

SEQ ID NO: 95722 - DNA, 50 bp, homo sapien
tgcttattttttatttgcagatctgracttactgctgaaatttgcattaa

SEQ ID NO: 95723 - DNA, 50 bp, homo sapien
tgcttaaacaagctattatattgccrcagggatccaagtcctagttgtta

SEQ ID NO: 95724 - DNA, 50 bp, homo sapien
tgaccacacacaaatctctggataaractcttctggcacaaatttttggg

SEQ ID NO: 95725 - DNA, 50 bp, homo sapien
ttgcacagtcttagataagctcaacmatttttgaactctattttaatgat

SEQ ID NO: 95726 - DNA, 50 bp, homo sapien
tgctaaggataaggattgcaaaactwactggttatttaactacatcaagt

SEQ ID NO: 95727 - DNA, 50 bp, homo sapien
gttaatgcggtatatgacatttaccmatttgtgcatgttgagccatcctt

SEQ ID NO: 95728 - DNA, 50 bp, homo sapien
ttaccctccaatcactataacttgasgtctgacacaaacaaaaagcagtc

SEQ ID NO: 95729 - DNA, 50 bp, homo sapien
attagctcattgtatgttggtagtamcacaatgagtttctccagaaacgt

SEQ ID NO: 95730 - DNA, 50 bp, homo sapien
tgtgtatagatggatggataggaaaktaatgaaaaagtgaatgggataaa

SEQ ID NO: 95731 - DNA, 50 bp, homo sapien
taaatgaatattttggagttaagtarataaagacacaattatccaattaa

SEQ ID NO: 95732 - DNA, 50 bp, homo sapien
tgtataaaaggaaaaattataaattraatcttacaaaattgcaatctcac

SEQ ID NO: 95733 - DNA, 50 bp, homo sapien
attgccataattattaaccattaagmccacatatatatggatctgtttct

SEQ ID NO: 95734 - DNA, 50 bp, homo sapien
tctagggttaagcaaagtgttcttaracttgatactaaaggcataatgta

SEQ ID NO: 95735 - DNA, 50 bp, homo sapien
aggtgtttggagaagattccagaaartagatcccttattctacttatgaa

SEQ ID NO: 95736 - DNA, 50 bp, homo sapien
atggtcttagtaaaactacatttgargtactgaactaatctattgaattc

SEQ ID NO: 95737 - DNA, 50 bp, homo sapien
gcataaaggtaattgttttactcctygcttaacatctttatgtgtctcat

SEQ ID NO: 95738 - DNA, 50 bp, homo sapien
cagaaactatgttctatttagtgtakgtaatcattgatttggacatgtaa

SEQ ID NO: 95739 - DNA, 50 bp, homo sapien
ctccagctgtgacaaaaagtggcgayggtatgactcaggctgttacttca

SEQ ID NO: 95740 - DNA, 50 bp, homo sapien
aaaaacagccacaacttgaaagctaraagttcaggaggtacaacccacct

SEQ ID NO: 95741 - DNA, 50 bp, homo sapien
ttattgctgttacagtgctaaaaatkatccaggaagttcatctcaattta

SEQ ID NO: 95742 - DNA, 50 bp, homo sapien
tccacagcagtcaacttaatggtcakataattaaagtttatgtatgtgca

SEQ ID NO: 95743 - DNA, 50 bp, homo sapien
aagttgtgttcatttcaagatcatgrattaattgtacataagaaaagtta

SEQ ID NO: 95744 - DNA, 50 bp, homo sapien
gaagggacccaaacattatcagtaayaggacatgagtgagaacagcagaa

SEQ ID NO: 95745 - DNA, 50 bp, homo sapien
ttctgttgctaaatctaccaaacagwatttgaagtcttttatgccaggac

SEQ ID NO: 95746 - DNA, 50 bp, homo sapien
ccaaccagacctgtaaacatttctgycattacattagtcaacacatctat

SEQ ID NO: 95747 - DNA, 50 bp, homo sapien
tttgtgcagatgtttttcctggaacyacttctaaaataacagtattagcc

SEQ ID NO: 95748 - DNA, 50 bp, homo sapien
aagatttcccattaccaaatcagtamaatctgaactttttatcaggacac

SEQ ID NO: 95749 - DNA, 50 bp, homo sapien
ttaattgatttattttacctcaaaaygttacagaaagcctactttaaaca

SEQ ID NO: 95750 - DNA, 50 bp, homo sapien
agattattttttgaaagatcttttcracatttcctacatagaaaaaaata

SEQ ID NO: 95751 - DNA, 50 bp, homo sapien
gcttttctacattttacatatctgtsaactgttcttatttaagattcagc

SEQ ID NO: 95752 - DNA, 50 bp, homo sapien
tccacacaactatttcaagtcaccartatagctatgtgaaatggttttca

SEQ ID NO: 95753 - DNA, 50 bp, homo sapien
ttaaatgtcctagaacagtatgtacmcctgtagtgcaaggcaacttggac

SEQ ID NO: 95754 - DNA, 50 bp, homo sapien
gtttgtggatgacactctgagaaccrctggtttgtttgtttgtttgttta

SEQ ID NO: 95755 - DNA, 50 bp, homo sapien
atatgctgtaatgccgtattaccacrattaagtatactgctgtacaacta

SEQ ID NO: 95756 - DNA, 50 bp, homo sapien
gtcaaaattatccacctacagattaracatggcttctgtgtgagtgaaac

SEQ ID NO: 95757 - DNA, 32 bp, homo sapien
agtttaactccaattaytttatgggtagtctg

SEQ ID NO: 95758 - DNA, 50 bp, homo sapien
cccttctaatagttatgtagtggtawttcagtgaggttttaatttgcaat

SEQ ID NO: 95759 - DNA, 50 bp, homo sapien
attactaagagaacatatagaaagasaccaaaaaatgtatttgtacagta

SEQ ID NO: 95760 - DNA, 50 bp, homo sapien
agtaaaacttcttatagtgttataaytaaagtaagcatgaatatatacaa

SEQ ID NO: 95761 - DNA, 50 bp, homo sapien
taaaaccttgatacaaaagtagctcraattatataaatcagggggaaata

SEQ ID NO: 95762 - DNA, 50 bp, homo sapien
aatctaatttgtctctagtaagccarttcctctcttgttctctgactatt

SEQ ID NO: 95763 - DNA, 50 bp, homo sapien
cttgaagaacccgcatggatcatacyctgatgatttaaaccaaacaaaag

SEQ ID NO: 95764 - DNA, 50 bp, homo sapien
gcggttgtttagaaattaggccaacraaagatttttccaggtaataatag

SEQ ID NO: 95765 - DNA, 50 bp, homo sapien
agaaaatatgaattgtagagatagawtaatgtcttcctctcagtgcttgc

SEQ ID NO: 95766 - DNA, 50 bp, homo sapien
aatttcttaaacaataagacctcaawatttaaatcactccttgatccatg

SEQ ID NO: 95767 - DNA, 50 bp, homo sapien
tacactttcctggagctgggaaaaarcatgagaatgcacctgaataaata

SEQ ID NO: 95768 - DNA, 50 bp, homo sapien
acttacttggacaaagcagcttaaaygttacttcactttacactttctaa

SEQ ID NO: 95769 - DNA, 50 bp, homo sapien
caaaggaatatatactcatgttatakgctagttattacaacagatagtaa

SEQ ID NO: 95770 - DNA, 50 bp, homo sapien
gtttctacttacaagtctgttttgayccgacagcttattccaaaagattg

SEQ ID NO: 95771 - DNA, 50 bp, homo sapien
gtgaaacatttgccacaatgtactckaaggatgtagttctcttctctttt

SEQ ID NO: 95772 - DNA, 50 bp, homo sapien
tcaataatgaaatcacattgaaaaaygatgtatgtgaaaaggcaaattta

SEQ ID NO: 95773 - DNA, 50 bp, homo sapien
atgtagaaatttaagacaagggttasagattatgcattaaatggtttcac

SEQ ID NO: 95774 - DNA, 50 bp, homo sapien
actgcctcatttctttatcctggaayggtaaatggtatgtagacagaata

SEQ ID NO: 95775 - DNA, 50 bp, homo sapien
gctggactgcttgggttcaaataagratacaatacttgctagctgtttta

SEQ ID NO: 95776 - DNA, 50 bp, homo sapien
ccttatgtatggtatgtgtacaagasagaaattcttatcatattttttta

SEQ ID NO: 95777 - DNA, 50 bp, homo sapien
gacaatggaaaaaaataatctaagcractttggggctcagtactaacgaa

SEQ ID NO: 95778 - DNA, 50 bp, homo sapien
aatttaaatgttcagcttaccaggaytttaaactctttcttatgcgactc

SEQ ID NO: 95779 - DNA, 50 bp, homo sapien
aaaaccccagaagttctagtttcagwaattgatgtttcagaattcaaaac

SEQ ID NO: 95780 - DNA, 50 bp, homo sapien
ctgcacgcatacccctgatcttaaaktaaaagttggaaattaaaaaaata

SEQ ID NO: 95781 - DNA, 50 bp, homo sapien
atattaattcctatggctaattcaaytattcaacaagcatcccacatcat

SEQ ID NO: 95782 - DNA, 50 bp, homo sapien
ccacaagcacaattcctctattcccraattttgcttaacctcctcttgct

SEQ ID NO: 95783 - DNA, 50 bp, homo sapien
tttccatccatccataattatctaarcttttctgatgtcagaaacattgg

SEQ ID NO: 95784 - DNA, 50 bp, homo sapien
agctgcacaaattatttcatattgaygtttgcaggtagaaagtgatttac

SEQ ID NO: 95785 - DNA, 50 bp, homo sapien
gtacaaatataaatgtcctcatgagwtcaaagtataaaataagtataaaa

SEQ ID NO: 95786 - DNA, 50 bp, homo sapien
aagttaaaaagttaatagacaactaractagttacgtgagcaaaactgaa

SEQ ID NO: 95787 - DNA, 50 bp, homo sapien
cagtccaaaccaacatacatttttcrctcagaagatactactttagcttt

SEQ ID NO: 95788 - DNA, 50 bp, homo sapien
cttgagaaatcagcacttcctttaawtaatatctggaatgcaactattct

SEQ ID NO: 95789 - DNA, 50 bp, homo sapien
gatgactaattatactattctgctgyagtagtagctatgcttcaggaaat

SEQ ID NO: 95790 - DNA, 50 bp, homo sapien
tgggttagtagaaatgttctaacagygaattttgagtgaaagttgcacaa

SEQ ID NO: 95791 - DNA, 50 bp, homo sapien
cctagaggttaataaactgttacagraaatgactgcttgaagcaaaacta

SEQ ID NO: 95792 - DNA, 50 bp, homo sapien
ccatcaatcacaatttccacagcacrattggtgtctcataccaggtttag

SEQ ID NO: 95793 - DNA, 50 bp, homo sapien
aaatttataagtatgaaagttcagastaggaatagccaaaagggcaaaaa

SEQ ID NO: 95794 - DNA, 50 bp, homo sapien
ctccttttttccctcaaaacattctrtcttgtaatcccctgatcaacatc

SEQ ID NO: 95795 - DNA, 50 bp, homo sapien
agaaatttagacctgaaatgcaaaaktgaggtcaacagaactataattac

SEQ ID NO: 95796 - DNA, 50 bp, homo sapien
atttcagaatgttaaaaagtgaatayatgtgcattgacaaaacaaagcaa

SEQ ID NO: 95797 - DNA, 50 bp, homo sapien
ctgaatagtaagcctacctgcaactsactttaagggcactcgttcagaca

SEQ ID NO: 95798 - DNA, 50 bp, homo sapien
tgtgtatgtgtatttttaatcactascatatttaagccaatgtgatgtaa

SEQ ID NO: 95799 - DNA, 50 bp, homo sapien
tttgaaggtttcccattggagttagrattggacttggacattgactggtg

SEQ ID NO: 95800 - DNA, 50 bp, homo sapien
taatcaggtgttttcctgttagttayatccacttcatctagtaaataaac

SEQ ID NO: 95801 - DNA, 50 bp, homo sapien
tgtgcaagaatctcactgagagcaaragtattattattcattagttcatt

SEQ ID NO: 95802 - DNA, 50 bp, homo sapien
aacatttgagaccaaaaatccttacrcctacaaacactttaaatttatta

SEQ ID NO: 95803 - DNA, 50 bp, homo sapien
taataatgggcaagttgaacagttaraagttgagatggaatttagattta

SEQ ID NO: 95804 - DNA, 50 bp, homo sapien
gcaaatgtttagaaagtcagtgatastacatctttgtttgttgtgttcac

SEQ ID NO: 95805 - DNA, 50 bp, homo sapien
ttgtttttctcttgaaattaaaacaytgatgagaccttagattattacgt

SEQ ID NO: 95806 - DNA, 50 bp, homo sapien
atttttcttccatgtttataccacakctttctagtaacactgcttggtga

SEQ ID NO: 95807 - DNA, 50 bp, homo sapien
gtggtagataaaactctttaatacastggaatatttgatgtatggataat

SEQ ID NO: 95808 - DNA, 50 bp, homo sapien
agggtaagattatctctgttctttgraagcacaatattacagtagttcag

SEQ ID NO: 95809 - DNA, 50 bp, homo sapien
ggatggggctgtcatcagtagattgytgaaaaatattccacaaccagttc

SEQ ID NO: 95810 - DNA, 50 bp, homo sapien
cagccaagtagccatttggtcaggartagcccccaatgagtacttgccct

SEQ ID NO: 95811 - DNA, 50 bp, homo sapien
ctaaatttattttgaatttcttctcygaacaaatcatctgttcttagact

SEQ ID NO: 95812 - DNA, 50 bp, homo sapien
ctctgaatgaggtagacaagtgtaaycttcaaagtttctgacaattacag

SEQ ID NO: 95813 - DNA, 50 bp, homo sapien
ttttgttttgtgactccttgcttcaratataagcaaactgatagaccaaa

SEQ ID NO: 95814 - DNA, 50 bp, homo sapien
cttgacatttttaacatcagaaaaarttaaaggaattggcattcagaaag

SEQ ID NO: 95815 - DNA, 50 bp, homo sapien
ttttattgaagtttagcgaatatacraaagatatataaaacatgagacta

SEQ ID NO: 95816 - DNA, 50 bp, homo sapien
tagaggcagaaaagattacatttccrtacaagaagtccagattagttgaa

SEQ ID NO: 95817 - DNA, 50 bp, homo sapien
tttctcatttaactgaatactgaaastacaattactataaatggaaagtc

SEQ ID NO: 95818 - DNA, 50 bp, homo sapien
taattaaggggataggataaaaatayacacatgaagaaaagaccaaaaca

SEQ ID NO: 95819 - DNA, 50 bp, homo sapien
aaaacaattattcaacaaagatgaarcaagaatgaaaacaaacacataaa

SEQ ID NO: 95820 - DNA, 50 bp, homo sapien
tccaaagtttatctgggctatttccyataatgcaatagagtagtatctag

SEQ ID NO: 95821 - DNA, 50 bp, homo sapien
tacctaatcttgcagagaatatggarcaacttactttgttgttgggtgta

SEQ ID NO: 95822 - DNA, 50 bp, homo sapien
ctgaaaatgtacagtggttgcattayagccagaggtgtgctgaaggtagc

SEQ ID NO: 95823 - DNA, 50 bp, homo sapien
ttgtggtgatttccctctgcgaatasaaagtaatatagcatgaaaaataa

SEQ ID NO: 95824 - DNA, 50 bp, homo sapien
aattagttaatatatacatcacttcraatacttaacattttttgtaattt

SEQ ID NO: 95825 - DNA, 50 bp, homo sapien
actaaggtgcttttgggcagttcaaytggtgaaaacattatgcattaatt

SEQ ID NO: 95826 - DNA, 50 bp, homo sapien
ccatcattaaattatactgaaatcakggttaaaattaaatatgtagtcat

SEQ ID NO: 95827 - DNA, 50 bp, homo sapien
atatacggtaatgattaaatataaaratcaagctgagtctctccatcaaa

SEQ ID NO: 95828 - DNA, 50 bp, homo sapien
ttttctatcgggaacttggtgctatkaagagtgccaattcatttcctatt

SEQ ID NO: 95829 - DNA, 50 bp, homo sapien
atgtcacttacccaagggctgtccarggggaactaaagaagataccaatg

SEQ ID NO: 95830 - DNA, 50 bp, homo sapien
ttttgaaacatgtaaatactagtagwcattcataaccaaatctgaatata

SEQ ID NO: 95831 - DNA, 32 bp, homo sapien
tagtatgaacaaaaaaygtatctcattaataa

SEQ ID NO: 95832 - DNA, 50 bp, homo sapien
gcctgcaatgcctactccctaatcaytcacaatcccttctatagctgcta

SEQ ID NO: 95833 - DNA, 50 bp, homo sapien
cagagaaataaaataggctttaaacyacaagtgattaagtgctttatgca

SEQ ID NO: 95834 - DNA, 50 bp, homo sapien
acttttaattttggtatttcttagcwcctataaagggtagcaggtggcct

SEQ ID NO: 95835 - DNA, 50 bp, homo sapien
ttctttcttcactgttatttagtcaygtgtttagcgttcactatactctg

SEQ ID NO: 95836 - DNA, 50 bp, homo sapien
tgtatagtgggatgaagataaacccrgacgcactggtacatgaatttgta

SEQ ID NO: 95837 - DNA, 50 bp, homo sapien
tatcacacgtattcatcctacttaamctggctgagtaaggccgtatttta

SEQ ID NO: 95838 - DNA, 50 bp, homo sapien
atcactttcccaatggactgctaaayatgtacaccctaaaacacacattc

SEQ ID NO: 95839 - DNA, 50 bp, homo sapien
tcagttgaagattggcgaggtaataycagatagtggagaagccagaggag

SEQ ID NO: 95840 - DNA, 50 bp, homo sapien
gtcacctgccagaagcaactttccaratgaatcttaaagaatgagttgga

SEQ ID NO: 95841 - DNA, 50 bp, homo sapien
gctttttgaaccagtcttagtatttmtctggttccctcattatgagttga

SEQ ID NO: 95842 - DNA, 50 bp, homo sapien
tttttagattagaccaacttgtcccraaactttgtgctatagaaaatgac

SEQ ID NO: 95843 - DNA, 50 bp, homo sapien
gacctactgttttacagccttattamatcttagattccattccccatgac

SEQ ID NO: 95844 - DNA, 50 bp, homo sapien
ctttcactgctctaaaagttgtctcrttctctccttattccttatgatct

SEQ ID NO: 95845 - DNA, 50 bp, homo sapien
cccttttagcttcaacaggacagaarccttttcgagatgtatgcaactta

SEQ ID NO: 95846 - DNA, 50 bp, homo sapien
tagaatcagtgtgcaatgagtcttcyatttagccagtcactgtgttatga

SEQ ID NO: 95847 - DNA, 50 bp, homo sapien
tcatctggtttaatcaaatatatcaraataatctagccactacctggttt

SEQ ID NO: 95848 - DNA, 50 bp, homo sapien
gacactggaatctgaactaaacaggrtgtgtaagtgggaggagcactaca

SEQ ID NO: 95849 - DNA, 50 bp, homo sapien
ctaatcccccaaacatgctttttcaygtccatatgtttctctttaaagta

SEQ ID NO: 95850 - DNA, 50 bp, homo sapien
cctgttattagaaaaatctgttgcartctatagtaccttgtggcttttca

SEQ ID NO: 95851 - DNA, 50 bp, homo sapien
ttattaacacatgtgcataactaaastaaaatttgtttctataaaatata

SEQ ID NO: 95852 - DNA, 50 bp, homo sapien
atataatttttgctctgtcttattayactcaaacatttcaatccagtgta

SEQ ID NO: 95853 - DNA, 50 bp, homo sapien
ctggaagatgcccaaatgattagatwagcctttttcaaaagtcagtatga

SEQ ID NO: 95854 - DNA, 50 bp, homo sapien
agggtgggagaggtgatggtaataaygaaagtttagcacatacttctaat

SEQ ID NO: 95855 - DNA, 50 bp, homo sapien
aggcccaaagataatagctaaaaaastactaataatccaactctgtaggc

SEQ ID NO: 95856 - DNA, 50 bp, homo sapien
ttagatattatgttactaacttttamcacaaagcaaacaaccaaactctc

SEQ ID NO: 95857 - DNA, 50 bp, homo sapien
taaacagtccctatacattctttcarttctgtccaccttactgctgtctg

SEQ ID NO: 95858 - DNA, 50 bp, homo sapien
atttgatatatcataaaatcagaggrcagccagtaagactttcatcccct

SEQ ID NO: 95859 - DNA, 50 bp, homo sapien
gcaacgtcatagaacaatgtggagawttttttaggacaaagtattgttaa

SEQ ID NO: 95860 - DNA, 50 bp, homo sapien
aaacttcaatatgatggtgacaacaraaatgaaatggttggtactctagc

SEQ ID NO: 95861 - DNA, 50 bp, homo sapien
aaatctagagacctactgtaggacaygaagaatatagttagtaatatttt

SEQ ID NO: 95862 - DNA, 50 bp, homo sapien
cccaggctctgtacattagtggaaargtttttggtcatttattttggtgg

SEQ ID NO: 95863 - DNA, 50 bp, homo sapien
atttaccttgggctatcaaagatcayaaacagtgcaaattgagacagaaa

SEQ ID NO: 95864 - DNA, 50 bp, homo sapien
aaccatttttcttatttgtcagttargttcaccttcactaagttcccttt

SEQ ID NO: 95865 - DNA, 50 bp, homo sapien
agcctgaatgtttttctgtacatcakgaagtataacaagtggaagtggaa

SEQ ID NO: 95866 - DNA, 50 bp, homo sapien
acgaccacggctaatccggttgccaygtcaggcgctgtaatgggcagcca

SEQ ID NO: 95867 - DNA, 50 bp, homo sapien
gattccagaccactgaaagtcagacrctacagatagcaaaggacagcaat

SEQ ID NO: 95868 - DNA, 50 bp, homo sapien
ttggtttgcatttcatcacataatarcttcaccttctttgtaagagtaat

SEQ ID NO: 95869 - DNA, 50 bp, homo sapien
aaagtcaagaattcatttactatccragtgaaatcacccatgttagaaga

SEQ ID NO: 95870 - DNA, 50 bp, homo sapien
aacattggtggaaagtaagtgaacasaataatagccaaatatatccaact

SEQ ID NO: 95871 - DNA, 50 bp, homo sapien
atccaattacacctcaagattcaacracattgagctgggcctctaatgtt

SEQ ID NO: 95872 - DNA, 50 bp, homo sapien
gactctcgggagagtacttggtaaaytgtgacatgccctgcagataatat

SEQ ID NO: 95873 - DNA, 50 bp, homo sapien
agagatcttgaccatgatttgatgaygctatagggaaaaagagatcagat

SEQ ID NO: 95874 - DNA, 50 bp, homo sapien
ttgcattgaatctatatattgctttragaagtgcggtcatttttataatg

SEQ ID NO: 95875 - DNA, 50 bp, homo sapien
catgcactgtctcttcaaagtagaayatatctgaatgatgcattcaatat

SEQ ID NO: 95876 - DNA, 50 bp, homo sapien
cactgaagcttagttagatgtataaycagtaaaaacggaagtagaaagga

SEQ ID NO: 95877 - DNA, 50 bp, homo sapien
cactgtcttcgaatactatttgacaytctcaattcagtacattttattta

SEQ ID NO: 95878 - DNA, 50 bp, homo sapien
agaaagttgattagaaatgaagtcaragaatctcacaaattccaggagga

SEQ ID NO: 95879 - DNA, 50 bp, homo sapien
agacaggtggctcagggagctaaatraaacactggccttttacagactat

SEQ ID NO: 95880 - DNA, 50 bp, homo sapien
tatttgttaaaagttcctctctgacrttcaaccacatgctctagctgggc

SEQ ID NO: 95881 - DNA, 50 bp, homo sapien
taaatgggagttattagtttggatayaatttggggtcactatttactgct

SEQ ID NO: 95882 - DNA, 50 bp, homo sapien
tggagacacagccaagcttgaaatgrtgctgacaagggccagggcaggtg

SEQ ID NO: 95883 - DNA, 50 bp, homo sapien
gacatcttatattgtaatttaagtaygaatgagagtgccaagaagcctat

SEQ ID NO: 95884 - DNA, 50 bp, homo sapien
atttcatgtcaatgaagtttatgaawaacatgtatttgtaaaatattttg

SEQ ID NO: 95885 - DNA, 50 bp, homo sapien
tcaatagtttaagtgaagtaacaaayatagttgaaatatgtgaacatttt

SEQ ID NO: 95886 - DNA, 50 bp, homo sapien
gaggtttccctaaattgccaggacgwatagagattcagagaaaactccaa

SEQ ID NO: 95887 - DNA, 50 bp, homo sapien
taaatgcatctgtctggtgtagagarctatcaacctaagtacatgtgcag

SEQ ID NO: 95888 - DNA, 50 bp, homo sapien
aaattcgttctagctgtagccttaamatcattggatatgagaaatttgaa

SEQ ID NO: 95889 - DNA, 50 bp, homo sapien
tctttggattattgctgtcccaaaartgagtgaggagtagagaaaggaaa

SEQ ID NO: 95890 - DNA, 50 bp, homo sapien
acgtgacaggttctccttatctaccytttaatatcttcctccacacagtg

SEQ ID NO: 95891 - DNA, 50 bp, homo sapien
ccattagtattagtcgaggttctccmaaataacaataccaatatccaata

SEQ ID NO: 95892 - DNA, 50 bp, homo sapien
cttcatgcgttccaggtgctcaataygtgtttgtcgaatgaaagataaga

SEQ ID NO: 95893 - DNA, 50 bp, homo sapien
agtaaacaggtttgcctcatcagaartgaatatggatattgctacacaat

SEQ ID NO: 95894 - DNA, 50 bp, homo sapien
ctatctaccaggaaggctgcaatacrctcagatgtgaatcgcctcctgtt

SEQ ID NO: 95895 - DNA, 50 bp, homo sapien
tcatctggccagtctcctttgctgayataagatccggaactgctgcagca

SEQ ID NO: 95896 - DNA, 50 bp, homo sapien
tattatggcctatctgctatcatgtwaatccaaagcttgaataaatttta

SEQ ID NO: 95897 - DNA, 50 bp, homo sapien
taaaaaatgccctggcaaccaaagarggagcttttacaccagacctagcc

SEQ ID NO: 95898 - DNA, 50 bp, homo sapien
atgaagtacctgaactttgaatcaarctctacgcagatccaccagttcta

SEQ ID NO: 95899 - DNA, 50 bp, homo sapien
tgatagcagataggccataatatagraacccagaggaaggaggtgcttaa

SEQ ID NO: 95900 - DNA, 50 bp, homo sapien
tccattctagagctatgtatcaaatsaagtacctgaactttgaatcaagc

SEQ ID NO: 95901 - DNA, 50 bp, homo sapien
ttaacagataacagaaacttcatctyatattcacagagacacgagcagaa

SEQ ID NO: 95902 - DNA, 50 bp, homo sapien
tacattatgttattgaaggtcattgyattaatttagtgactagtatagac

SEQ ID NO: 95903 - DNA, 50 bp, homo sapien
taggtttctagaatataaatgaataygaatatggacttctgtaacagcaa

SEQ ID NO: 95904 - DNA, 50 bp, homo sapien
tgcttttattgtggtgtgatagcagyctgcatatacattttctaactaca

SEQ ID NO: 95905 - DNA, 50 bp, homo sapien
agatgcatagtagcacactattatamggtatttacaccacacagaaataa

SEQ ID NO: 95906 - DNA, 50 bp, homo sapien
tatcagcagagaaatttgttaggaarattttagtcacaatctagataaca

SEQ ID NO: 95907 - DNA, 50 bp, homo sapien
gttcttatctcttctggttgttctcraatggaataaatatattccagcat

SEQ ID NO: 95908 - DNA, 50 bp, homo sapien
ctgtaaatggctataaatgttaagaycagccctcaaaaaaagaaaatctc

SEQ ID NO: 95909 - DNA, 50 bp, homo sapien
tttccatgttgcattagccaattaasatgatttatctaaatccgcagata

SEQ ID NO: 95910 - DNA, 50 bp, homo sapien
tgagtctgtagagttctttgcatagyataaatattttaacaatattgatt

SEQ ID NO: 95911 - DNA, 50 bp, homo sapien
tcttcagatttgcttactataaagasaaggaaaggcatagatgagcaaaa

SEQ ID NO: 95912 - DNA, 50 bp, homo sapien
ttagcaggaaacaggaccatgataartgattgacatctgccacagaagtc

SEQ ID NO: 95913 - DNA, 50 bp, homo sapien
gggaggcggcataggagagtaggaaygtgatatttggcatcgaacaggct

SEQ ID NO: 95914 - DNA, 50 bp, homo sapien
agtgtagtatttgcaaaataataagyacaccaatccaagctgatagagtc

SEQ ID NO: 95915 - DNA, 50 bp, homo sapien
tcacattcattaactgtagatcattyttcagaggtcaggtcacgtgtgct

SEQ ID NO: 95916 - DNA, 50 bp, homo sapien
agaggaagaaagcatttatatttgcygagtttcttaagggtttttaggcc

SEQ ID NO: 95917 - DNA, 50 bp, homo sapien
tttgctaaattcaaaattcctaaatyatgatcccagtgctgttaatgatt

SEQ ID NO: 95918 - DNA, 50 bp, homo sapien
taaggcaataaaatgaaatcacagartaacagcaaattatccattttaag

SEQ ID NO: 95919 - DNA, 50 bp, homo sapien
tagtctccctattatgctaccaaacrctcagtcttatcccctctgtctaa

SEQ ID NO: 95920 - DNA, 50 bp, homo sapien
ttcaactatttgggcttaaaattcasattgtgtggtataattaatactaa

SEQ ID NO: 95921 - DNA, 50 bp, homo sapien
tcaaaataacttctgtccgaacagakacctcattttagcctctcaaactg

SEQ ID NO: 95922 - DNA, 50 bp, homo sapien
ctctctgtaaagcctctgaatataamtgacgcaaagagaggcgatgaaac

SEQ ID NO: 95923 - DNA, 50 bp, homo sapien
tagtagccaccaacgggttaggcaaygattggagacagtgttggtgggct

SEQ ID NO: 95924 - DNA, 50 bp, homo sapien
ttttggagaggtaataagtttgcacrcacaaatgtagatgtttgcaaaac

SEQ ID NO: 95925 - DNA, 50 bp, homo sapien
acagggcttgtgacagggacgtgaartgactggcttatttggtgccctgc

SEQ ID NO: 95926 - DNA, 50 bp, homo sapien
atggagaaatttgtcccaaagcagasaactaataagtggcatatctggga

SEQ ID NO: 95927 - DNA, 50 bp, homo sapien
aaattatcaaggaagaatgatgagaycagatgatgaaataaagaattgag

SEQ ID NO: 95928 - DNA, 50 bp, homo sapien
gtgccttaggatgcatctattgaaaytagtggaacagagtataacatatt

SEQ ID NO: 95929 - DNA, 50 bp, homo sapien
aagagccttcaggagtgacagataartggtcagagagagaggaggacaac

SEQ ID NO: 95930 - DNA, 50 bp, homo sapien
ttctgtatccacatggtgttgctagmagtattatatcttttggtaagaga

SEQ ID NO: 95931 - DNA, 50 bp, homo sapien
gatttcagaagcctcacttccaacargcaaactcaactatttgcctttgg

SEQ ID NO: 95932 - DNA, 50 bp, homo sapien
ataagctttgaacaaaaacagtgccrtgttactcaataagttattctgag

SEQ ID NO: 95933 - DNA, 50 bp, homo sapien
gtaatttgaactttatcctggtagcratgaagaaatatacagaaatttta

SEQ ID NO: 95934 - DNA, 50 bp, homo sapien
gaacttttgatagtcctttcggttcrctgaagaaaacaatgtttggcata

SEQ ID NO: 95935 - DNA, 50 bp, homo sapien
ggttaaacatgtttctgtacagccaytcatcttgagagatgcttctagag

SEQ ID NO: 95936 - DNA, 50 bp, homo sapien
ctcttttccttgagctcttttgttaycttgttcctctgtaacaaatgctt

SEQ ID NO: 95937 - DNA, 50 bp, homo sapien
gagggcctgttcatctgagcttcaamcttattcattttcagtattcataa

SEQ ID NO: 95938 - DNA, 50 bp, homo sapien
attagtgaaatctgactactaaaaartgtaagtctgggcatggtgactca

SEQ ID NO: 95939 - DNA, 50 bp, homo sapien
accacaattttcttgaaattcagtckactttaatttccatttgcacaata

SEQ ID NO: 95940 - DNA, 50 bp, homo sapien
gtgtcaggattaagttgaattatagracagtcaggtgatatgtgctagag

SEQ ID NO: 95941 - DNA, 50 bp, homo sapien
aggagcccccaaacaatatgaagtasatcactcagaaagtttttcctctc

SEQ ID NO: 95942 - DNA, 50 bp, homo sapien
actggggtcacatagataatccaggwtattctccttatatgaaagtccat

SEQ ID NO: 95943 - DNA, 50 bp, homo sapien
ggagactcagggaagcattaaatgaygacagtgcagcttaagtgccataa

SEQ ID NO: 95944 - DNA, 50 bp, homo sapien
ttttctcctgatgaacaatcataagkactcaagcatttccagggcaataa

SEQ ID NO: 95945 - DNA, 50 bp, homo sapien
tatctatgcatctttaaatactgacsgcttattacagtcctgtcctcctc

SEQ ID NO: 95946 - DNA, 50 bp, homo sapien
ggaaaaggacaaaatttaagcacaartgatattagaaaagtaaatggcaa

SEQ ID NO: 95947 - DNA, 50 bp, homo sapien
tatattaatatcgtaattaggaatargtcaaacattttacttttatatga

SEQ ID NO: 95948 - DNA, 50 bp, homo sapien
taggtttagacatttaacattatccmaaactacttggagtcttcgttcat

SEQ ID NO: 95949 - DNA, 50 bp, homo sapien
taagactatcacttaaaaaaatccasaatccttttattcagtttttgttg

SEQ ID NO: 95950 - DNA, 50 bp, homo sapien
ggatttttttaagtgatagtcttaargttgatcaaactactataaaaatt

SEQ ID NO: 95951 - DNA, 50 bp, homo sapien
cacagccatatgcttcactcagatartcatagtgcccctgtagccattgc

SEQ ID NO: 95952 - DNA, 50 bp, homo sapien
tagttctgaaaaacatagtgagtcayaaaatgttccattccacacattaa

SEQ ID NO: 95953 - DNA, 50 bp, homo sapien
cagctctacctttgcttaaatttacsgcaatcgcgatcctagacaaatta

SEQ ID NO: 95954 - DNA, 50 bp, homo sapien
gcacaggtgtatggtatggttaaaaygaatttattggagaaactcagaga

SEQ ID NO: 95955 - DNA, 50 bp, homo sapien
ggtattcattcaatttatctttgaawctctaaagactagtatagtagcaa

SEQ ID NO: 95956 - DNA, 50 bp, homo sapien
tccctccttcatactcttcttcacarctgttggaccgttaccgccatctg

SEQ ID NO: 95957 - DNA, 50 bp, homo sapien
atgttagaactcctgtaatggataargctaatgtttcatatgtcagtttt

SEQ ID NO: 95958 - DNA, 50 bp, homo sapien
atcctccccggaattaacaaacagcstaaactctttcacctgacagtgtc

SEQ ID NO: 95959 - DNA, 50 bp, homo sapien
tattctccagagatagttattgatasagggcaaagaatcgggatttatac

SEQ ID NO: 95960 - DNA, 50 bp, homo sapien
gctgcaatatcatgccaacttacackctagctctgcctgtcaactaaaac

SEQ ID NO: 95961 - DNA, 50 bp, homo sapien
ttatactgtatctgaatgtctgaaayacccaacctacctcaatcacttag

SEQ ID NO: 95962 - DNA, 50 bp, homo sapien
gaaagaaattaaatgtttagcatatwatagaacagaaagtttgaacattt

SEQ ID NO: 95963 - DNA, 50 bp, homo sapien
tgaaagccaggaaatgctttctaaakagacatatgaaccacaagctatga

SEQ ID NO: 95964 - DNA, 50 bp, homo sapien
gaataagttagtcctggcactctctrtgaacattctctcctctacagata

SEQ ID NO: 95965 - DNA, 50 bp, homo sapien
gcctcaaaatccagaagatgaaagaygcttaataatggtctttcagcaca

SEQ ID NO: 95966 - DNA, 50 bp, homo sapien
agcagtaagttatccctgactgtaarcattattaatatagttctgcaaca

SEQ ID NO: 95967 - DNA, 50 bp, homo sapien
acagggcctactggtaacttttagarctgtctgaattatcttctttcaac

SEQ ID NO: 95968 - DNA, 50 bp, homo sapien
tggtggtgcttacaatcacctagtamgcgcatttttcactccgcagtcag

SEQ ID NO: 95969 - DNA, 50 bp, homo sapien
aatgtcaatattttatcctttattayaaaagagttggctacataataaaa

SEQ ID NO: 95970 - DNA, 50 bp, homo sapien
aatatatcttgcctattcctatacartcttttacatttgaattcattcac

SEQ ID NO: 95971 - DNA, 50 bp, homo sapien
ttaataaatctgagtaagaatttaaracctgaggctagcttgtaactggg

SEQ ID NO: 95972 - DNA, 50 bp, homo sapien
aaccaccttgcattgtagaaatttawgagctattaaaaatgtttcattag

SEQ ID NO: 95973 - DNA, 50 bp, homo sapien
tttgaggggccatcccactctttacmatcatgtcaaatcactccctggtc

SEQ ID NO: 95974 - DNA, 50 bp, homo sapien
taataatgaaggaataagtttaaccrgatgcttgaagttaacaggcagaa

SEQ ID NO: 95975 - DNA, 50 bp, homo sapien
gttttcactacatctctattccttcmagaaaaaattctcccaactacaaa

SEQ ID NO: 95976 - DNA, 50 bp, homo sapien
ataaatctataaatgaaggccgtaayaaaatgtgaacttgaaatttagga

SEQ ID NO: 95977 - DNA, 50 bp, homo sapien
gcaggaatatcattgcccctattcarccttaagaagctacagaagacaga

SEQ ID NO: 95978 - DNA, 50 bp, homo sapien
gaaaaaacttatagtcctgtcagtayagtagcaccactgttatgttgagt

SEQ ID NO: 95979 - DNA, 50 bp, homo sapien
acaggtaatccttgacatattagaaygatggtagataggagataggacta

SEQ ID NO: 95980 - DNA, 50 bp, homo sapien
tgaagatctcagcatgacataccgargaaaaagtggttgctcaatcttgc

SEQ ID NO: 95981 - DNA, 50 bp, homo sapien
gctgcatccttacatgacaaaagacmagaagagagcaaacccactcccta

SEQ ID NO: 95982 - DNA, 50 bp, homo sapien
gtgttcttgtcttgggaccaagaggratcaggtatgcacacatcaaagag

SEQ ID NO: 95983 - DNA, 50 bp, homo sapien
ggaccacaagattgcttaccttacartatgtatcacttatagtttgtccc

SEQ ID NO: 95984 - DNA, 50 bp, homo sapien
ttaaatcttaactgtattggcaatakgttgggatcttggggaaaagtcat

SEQ ID NO: 95985 - DNA, 50 bp, homo sapien
caaacattagtgcacagttgggtacmgaaggaaatgataaaagtatgaac

SEQ ID NO: 95986 - DNA, 50 bp, homo sapien
cattttaggatcaatatctgcagaaytgaatatgggttgatagtactggg

SEQ ID NO: 95987 - DNA, 50 bp, homo sapien
gagaattccaggaggagagaatacamtgaactatggtaatagtcatgagt

SEQ ID NO: 95988 - DNA, 50 bp, homo sapien
tgtgtacctgttccctcaggtagtayacgctcaccccacggtagacaaaa

SEQ ID NO: 95989 - DNA, 50 bp, homo sapien
aaatgcaattcaacccatgacgatayataagtctcagctgactttttttg

SEQ ID NO: 95990 - DNA, 50 bp, homo sapien
tgtacaactgaaaacagtatagtccrataaaataacattctggaactcaa

SEQ ID NO: 95991 - DNA, 50 bp, homo sapien
aactgtttgaatattaaaatcttacycaaagctaaggataaaatgtccat

SEQ ID NO: 95992 - DNA, 50 bp, homo sapien
aaaaataacgtgttttagcaatatayacttaagcaccaaactaagaaaat

SEQ ID NO: 95993 - DNA, 50 bp, homo sapien
aagcctagaatttaaatagacaaaaytggtgctgctctgaaaatcttcag

SEQ ID NO: 95994 - DNA, 50 bp, homo sapien
tcatactttattcaggattaaattasacttttagagtttaattaattcat

SEQ ID NO: 95995 - DNA, 50 bp, homo sapien
aggggattatggtggtgtgaacagtmtgaataaaaggagatgaggtcaga

SEQ ID NO: 95996 - DNA, 50 bp, homo sapien
aactctcaacctaacgtgtctaaaawtacaagcacctagactgagtgtga

SEQ ID NO: 95997 - DNA, 50 bp, homo sapien
gaattttctgaaaagcaaaactctayatattaagtgtcagagaggagaca

SEQ ID NO: 95998 - DNA, 50 bp, homo sapien
attagtccttggatagcacatcataycaactgagtaagaactgactccct

SEQ ID NO: 95999 - DNA, 50 bp, homo sapien
taaaaatttaactcagtattaattasagagccaggaagatgttacaacaa

SEQ ID NO: 96000 - DNA, 50 bp, homo sapien
tattgcttgcataccttaatttgtasactgagaatcatacctgctacaaa

SEQ ID NO: 96001 - DNA, 50 bp, homo sapien
gaactggagtactttagctgggctgrtctgaatacaattgtttttctgct

SEQ ID NO: 96002 - DNA, 50 bp, homo sapien
ttcctcatttgaacttgttctctccractgcagtgctatatcaccaaatt

SEQ ID NO: 96003 - DNA, 50 bp, homo sapien
gttctaagtttttaacaagcacctarataattcttaagctcatgattttt

SEQ ID NO: 96004 - DNA, 50 bp, homo sapien
ctcatgttaaaatcggaatagtaacracacatccctgaaaaagctcacct

SEQ ID NO: 96005 - DNA, 50 bp, homo sapien
gaactaaagaaagaagaaaaactgakcccaatgttagcagaaggaaaaaa

SEQ ID NO: 96006 - DNA, 50 bp, homo sapien
taaatgagaatataagcatttaaatraagtgcagataggaacattccttt

SEQ ID NO: 96007 - DNA, 50 bp, homo sapien
ttcagtgggtatattttgacatgcgyatctttaataattagaaattcctt

SEQ ID NO: 96008 - DNA, 50 bp, homo sapien
cattatgtctttgtctttggtatcaygctaagagaggtattttctgccca

SEQ ID NO: 96009 - DNA, 50 bp, homo sapien
tgttttattttaataaccttacatargtttcaatcacaagtaaagcatat

SEQ ID NO: 96010 - DNA, 50 bp, homo sapien
cattcaaataatccatatgttaaaaytgcaagcagatataagaaaaaaca

SEQ ID NO: 96011 - DNA, 50 bp, homo sapien
ccagaatatacacagagaactaaagkacaaaacctgagagaaaaaaaaaa

SEQ ID NO: 96012 - DNA, 50 bp, homo sapien
agtcctcacaataatttaacgtgaaytgtgtagtcttatgcaagtaccac

SEQ ID NO: 96013 - DNA, 50 bp, homo sapien
ttatagtgttatttaagtttctgagratatgtacaagttactgttaaaca

SEQ ID NO: 96014 - DNA, 50 bp, homo sapien
ctctgttgacatttatattctaaaaragatgtacttgtggaaaaagtgtt

SEQ ID NO: 96015 - DNA, 50 bp, homo sapien
ttaccgaaaatgaataaattggaacyagagtaaattttggcaagcatttg

SEQ ID NO: 96016 - DNA, 50 bp, homo sapien
taaagtaccaaatcctctcacttccraatattactcctatttacatgata

SEQ ID NO: 96017 - DNA, 50 bp, homo sapien
tcattctctgtagtttgactctctcraagtggctaatgaggagaacaaat

SEQ ID NO: 96018 - DNA, 50 bp, homo sapien
aaactcaatatagtaaaggtatcaaytctcttcacatttatatatgttta

SEQ ID NO: 96019 - DNA, 50 bp, homo sapien
gaatacttaaaactcagccgtaaaawtactatctatacgagggtgcggtg

SEQ ID NO: 96020 - DNA, 50 bp, homo sapien
agccacacccatttgtttaagtatcrcctatagctgctttcgcattacag

SEQ ID NO: 96021 - DNA, 50 bp, homo sapien
atgcaaatatacacttggtttgctaygagttaaaataaaaatacttattg

SEQ ID NO: 96022 - DNA, 50 bp, homo sapien
taatacaagcggaggagtcccagaakgtaatgctgaatggtagagtcgtg

SEQ ID NO: 96023 - DNA, 50 bp, homo sapien
tattctaagttacatatctggaacargaatgactggatcatggaggtatc

SEQ ID NO: 96024 - DNA, 50 bp, homo sapien
gggcaactagttaggtaactctgaasaacagtttctaaagtagtgagaat

SEQ ID NO: 96025 - DNA, 50 bp, homo sapien
gaaattaaaaacgtgatggaattacrataaagaagttaaaacaactatta

SEQ ID NO: 96026 - DNA, 50 bp, homo sapien
aaaataatttcctgacaaatcatgaraatatgagattaagaatatagcac

SEQ ID NO: 96027 - DNA, 50 bp, homo sapien
gatctagagtggaatgtagaaaaaakatgttggtgtctaaattaaagatt

SEQ ID NO: 96028 - DNA, 50 bp, homo sapien
ggctctgcattaattatcattactayggttaagtgtgactaatttatgaa

SEQ ID NO: 96029 - DNA, 50 bp, homo sapien
catgtaggaaactagaagaaaggcawcttagggcagaataaatactatga

SEQ ID NO: 96030 - DNA, 50 bp, homo sapien
gggcagagtttttaaccattggtcckcctcgtcctccagacctaagtatt

SEQ ID NO: 96031 - DNA, 50 bp, homo sapien
ctactgtggtagcttgttatagtgayggctgacggtgaacatatcttacc

SEQ ID NO: 96032 - DNA, 50 bp, homo sapien
gctggttgacacatttgttcaattasagctaccttgtttctaattgctac

SEQ ID NO: 96033 - DNA, 50 bp, homo sapien
aaattagaatgcataataaaattgartatcatttggccactggaaaatac

SEQ ID NO: 96034 - DNA, 50 bp, homo sapien
actgttttctgctctataatctacamccttatttattttagttagcttcc

SEQ ID NO: 96035 - DNA, 50 bp, homo sapien
agtggacacaatatctacaactcaasatttccagcttaaaccaaagtaat

SEQ ID NO: 96036 - DNA, 50 bp, homo sapien
gaaaagcaaactatattctcttctayggtctcctttgattatcagttttt

SEQ ID NO: 96037 - DNA, 50 bp, homo sapien
atgtctttactctctatatggaaaaygaattagaaagttcacacaggtcc

SEQ ID NO: 96038 - DNA, 50 bp, homo sapien
caattttataagaaactcaatagatracgataaataccttcaagcttaaa

SEQ ID NO: 96039 - DNA, 50 bp, homo sapien
gtaaagcaactaattctaagacacaytggcgtaaaacagaacttagtaaa

SEQ ID NO: 96040 - DNA, 50 bp, homo sapien
tgaaagaggttgataggtggatgaartagacaagatacataggaatatat

SEQ ID NO: 96041 - DNA, 50 bp, homo sapien
tttaacatgagataggaagattaaayaatactcgtgactaagtattcttt

SEQ ID NO: 96042 - DNA, 50 bp, homo sapien
tggaattctaaatcagtaactcaaayataacaagttgaaaatttaaccaa

SEQ ID NO: 96043 - DNA, 50 bp, homo sapien
tagaggcgatttaaagtatatgagaraaagtggatgtgtgtaggctatat

SEQ ID NO: 96044 - DNA, 50 bp, homo sapien
tgagatccacaggaccttcatgcaarggaagagatgaccttgtcacagag

SEQ ID NO: 96045 - DNA, 50 bp, homo sapien
ccaggtgggagagggattcctgagartaggtttagagaatgtagaaaaag

SEQ ID NO: 96046 - DNA, 50 bp, homo sapien
taagtaaagagtagtacatttttaawcctggtgcactttaaatcatattt

SEQ ID NO: 96047 - DNA, 50 bp, homo sapien
ttgtgtttcaaagtttgcctgatacraaaaggtttatttttttaattaaa

SEQ ID NO: 96048 - DNA, 50 bp, homo sapien
aactttaaactacaagatcttgtgcrgcaatttagtagaggtaaagggaa

SEQ ID NO: 96049 - DNA, 50 bp, homo sapien
agcatagaattctagtcagagaacasattccagctgcaaaaaaatacata

SEQ ID NO: 96050 - DNA, 50 bp, homo sapien
tcccagtggtccatggctgcataacrctatttttgtatcatttcttcaga

SEQ ID NO: 96051 - DNA, 50 bp, homo sapien
tatatagaaatattttcttcagcagyatataaatatgtatttcccgacaa

SEQ ID NO: 96052 - DNA, 50 bp, homo sapien
gatcaaggaaagctttacaaagaagsaggttttcagctgcctgtggaata

SEQ ID NO: 96053 - DNA, 50 bp, homo sapien
tattacttagtatcaagattcttaaragtaagtaggcacatacactcagg

SEQ ID NO: 96054 - DNA, 50 bp, homo sapien
aaatctattttactcctaagcataartcttgttctctatcccctatctcc

SEQ ID NO: 96055 - DNA, 50 bp, homo sapien
ggaaaattgccacctacttcctagakctgttgtaaggcttaaaggagatg

SEQ ID NO: 96056 - DNA, 50 bp, homo sapien
atataactcttataaatttcctaccrcacatacaacagtgagtggttcat

SEQ ID NO: 96057 - DNA, 50 bp, homo sapien
aactagtaccttgtgacaagagtacracataaactttagagctctagaat

SEQ ID NO: 96058 - DNA, 50 bp, homo sapien
tttcaaattatttacgatgagcaaargtatataaatgaaagtaaataaat

SEQ ID NO: 96059 - DNA, 50 bp, homo sapien
agttttttgagggttttttttgtcayggtgagacattgaattttgtcaaa

SEQ ID NO: 96060 - DNA, 50 bp, homo sapien
aactgtaaaatgctacctgaccaaakgaccggcaggccagaggaccagcc

SEQ ID NO: 96061 - DNA, 50 bp, homo sapien
tatcttttatattatttatctcttawgttgcagttattatttttgttata

SEQ ID NO: 96062 - DNA, 50 bp, homo sapien
ctaaacatttgcatgaagaggtgccrtaattattaaacatgaattcagct

SEQ ID NO: 96063 - DNA, 50 bp, homo sapien
gtcatttcataattatcagctaccartatctcaatgtgaaacagcatggt

SEQ ID NO: 96064 - DNA, 50 bp, homo sapien
catggttgtagacagacgttgtttayattatacagatgatgctacctatg

SEQ ID NO: 96065 - DNA, 50 bp, homo sapien
gcttgatttctaaacactattctctwatgaaaaggatcaaggtttattgg

SEQ ID NO: 96066 - DNA, 50 bp, homo sapien
tatcatgcaaaaccacagtatactaygcaactgagattgaataacgtatg

SEQ ID NO: 96067 - DNA, 50 bp, homo sapien
caactggtaacagaccaagtgattcyaattctttcccattatagctggat

SEQ ID NO: 96068 - DNA, 50 bp, homo sapien
cattttatttgctttgttgctcttayggacattgcaaattgtgtacagtt

SEQ ID NO: 96069 - DNA, 50 bp, homo sapien
ggggtagataagtctctgaacatacygtacttgtccaaatgatcaaactt

SEQ ID NO: 96070 - DNA, 50 bp, homo sapien
gagataaatcattaagaggtgaacastcattattcctgtactctaatctc

SEQ ID NO: 96071 - DNA, 50 bp, homo sapien
tatgggggaatgaatgagtaacatcraagggttgcctgccataagaataa

SEQ ID NO: 96072 - DNA, 50 bp, homo sapien
tctaatgccttttctaaaaatggaargctcttaatgaatatgggtaggtg

SEQ ID NO: 96073 - DNA, 50 bp, homo sapien
aacagcaaaaatacacaaagtccacmgcaatcttctttttacctctcttt

SEQ ID NO: 96074 - DNA, 50 bp, homo sapien
gtttaaagttattaaaaattataaamccttgtgaagtttttgatataaat

SEQ ID NO: 96075 - DNA, 50 bp, homo sapien
ttcaagactagaagtaaaactaggtwaaaatctatcattctaggctagta

SEQ ID NO: 96076 - DNA, 50 bp, homo sapien
tatacatgtgagaatgtctattacastattgttggtaatcagatgttggt

SEQ ID NO: 96077 - DNA, 50 bp, homo sapien
attttaaaaaatttttgtatgtttargaggtacaagtgcagatatctgac

SEQ ID NO: 96078 - DNA, 50 bp, homo sapien
tggtgggaaaccaaaacatggattayagcacattaattagagagcgtagt

SEQ ID NO: 96079 - DNA, 50 bp, homo sapien
ctccttgaaggcaggcagttccctayagatcctgttccacatttaacaca

SEQ ID NO: 96080 - DNA, 50 bp, homo sapien
tggcagatactgatcaataatacaasgaatacccacaaatttagttgtat

SEQ ID NO: 96081 - DNA, 50 bp, homo sapien
ggagaggactgaagaatattttgaaraggtagaaggtgagatttattatg

SEQ ID NO: 96082 - DNA, 50 bp, homo sapien
gggcttaatcaatacctgttgaatgwcaatgctttctggagaaaaaaatg

SEQ ID NO: 96083 - DNA, 50 bp, homo sapien
acaactgccatttgctaaacatccaycatgtagacattcacatacaacag

SEQ ID NO: 96084 - DNA, 50 bp, homo sapien
cgacacagtcaatgtccatctcttakcccattggcacacatttgtacata

SEQ ID NO: 96085 - DNA, 50 bp, homo sapien
atatacttgatcaaagtacagagtargaaaggtccaggagtaaaaatcat

SEQ ID NO: 96086 - DNA, 50 bp, homo sapien
gttatgtttccatatctttatcgacrgtaaagtaaattgtattatgttat

SEQ ID NO: 96087 - DNA, 50 bp, homo sapien
ggagggagtagaagctttaaagaaayggaagaaatcttctagaaggaaga

SEQ ID NO: 96088 - DNA, 50 bp, homo sapien
tttactcaagcactcttaatgcagcratctcaggctttattttgaagtat

SEQ ID NO: 96089 - DNA, 50 bp, homo sapien
gagcccctgaatgggaatagaagtcrcaacatatccagttcgatctgggc

SEQ ID NO: 96090 - DNA, 50 bp, homo sapien
tgacacatgatagggcttttaacaayggcgcgcatgacgccaccattcac

SEQ ID NO: 96091 - DNA, 50 bp, homo sapien
tgtgcagctctagaatgaatgggaaygtctattgatccagtgtctgagag

SEQ ID NO: 96092 - DNA, 50 bp, homo sapien
tatgaatgtgaatgttacttcattaygtgctttatatttttttcacatct

SEQ ID NO: 96093 - DNA, 50 bp, homo sapien
ctcaggcttgagggtaacatctacgkatctgtggaggtgagcagccagtc

SEQ ID NO: 96094 - DNA, 50 bp, homo sapien
atgtttggtagtaaagataaaaagasaggcattgtatctcacaaacctca

SEQ ID NO: 96095 - DNA, 50 bp, homo sapien
tggtggggacacacattttgcattaygacttcacaatagaaaacagacct

SEQ ID NO: 96096 - DNA, 50 bp, homo sapien
ctagattttgccctgcaaataatgtraactcaaaatacctgttaccaccc

SEQ ID NO: 96097 - DNA, 50 bp, homo sapien
tgtcttttgcacagtaatggtggaayaccctgataggggaaatgtatgtc

SEQ ID NO: 96098 - DNA, 50 bp, homo sapien
gatagcgagaccctagtcactgaacrctcacagttacacacaggactgat

SEQ ID NO: 96099 - DNA, 50 bp, homo sapien
aatttccaccttctccattgatgtaratttgacaggttgtatatgtaaaa

SEQ ID NO: 96100 - DNA, 50 bp, homo sapien
cagattactggctttgtaggaggaaygagctggaaataaatggttgaaaa

SEQ ID NO: 96101 - DNA, 50 bp, homo sapien
aagggggactatggtatagttcataytaacagtgctcatcaaagacctgc

SEQ ID NO: 96102 - DNA, 50 bp, homo sapien
aactatctctcaaatactctactggwttgctttacatatagttaatcacc

SEQ ID NO: 96103 - DNA, 50 bp, homo sapien
acttttaatatttattgtcaatacawcccagtcataggcatctagcaaaa

SEQ ID NO: 96104 - DNA, 50 bp, homo sapien
caaggcaaatgtctacatctctttayggcagtaggaactgctgttagggt

SEQ ID NO: 96105 - DNA, 50 bp, homo sapien
tagtttgctttgtctcatattttgcygaaccagatatttatcgcaaccac

SEQ ID NO: 96106 - DNA, 50 bp, homo sapien
ggcttctctagactatgcataatcayaagggaagccaatttgtataattt

SEQ ID NO: 96107 - DNA, 50 bp, homo sapien
tcaggcaccgtatttccatcagtgtmgcctaatctactcttcttttgatg

SEQ ID NO: 96108 - DNA, 50 bp, homo sapien
ataacaaaaaatcctggtacaaatayaatgaaaagtaggaaatcgttcat

SEQ ID NO: 96109 - DNA, 50 bp, homo sapien
aactgctccatccagaaggcattccraactctgaccttaaattccccttc

SEQ ID NO: 96110 - DNA, 50 bp, homo sapien
tatgagaaagtacctaactgtcgccragaaactcaaaagacatgattaaa

SEQ ID NO: 96111 - DNA, 50 bp, homo sapien
tgctcaaactgcttaagtgaagttayggtaagctgagtgcaggaagcttt

SEQ ID NO: 96112 - DNA, 50 bp, homo sapien
agcaagaagaaaattatcattccaawcaaggatctattattaaacacaaa

SEQ ID NO: 96113 - DNA, 50 bp, homo sapien
ctgcacctggctacaccacaactctwaaattggcttttcttatgagattg

SEQ ID NO: 96114 - DNA, 50 bp, homo sapien
gttctgctttctttatcaaaattccraaatataaaggcagtctgatatgc

SEQ ID NO: 96115 - DNA, 50 bp, homo sapien
tttttatttttgcattctgagagcarcttttgacagaagcatctcacagc

SEQ ID NO: 96116 - DNA, 50 bp, homo sapien
ctgaggtctacattgttctcagcaaytatccttacaactatccaaagtga

SEQ ID NO: 96117 - DNA, 50 bp, homo sapien
gataggagagagaagagaagagggtyggtttctcatatttgaagtccttc

SEQ ID NO: 96118 - DNA, 50 bp, homo sapien
gaaataacacttacttatagatagcrattataaactgtctcaggtaatca

SEQ ID NO: 96119 - DNA, 50 bp, homo sapien
ttcctccaatttatttaatagacgayaaaggatccagaagtgctattgga

SEQ ID NO: 96120 - DNA, 50 bp, homo sapien
acatgatttaaggatttaatattcayccctgaccagagatcagtgattgg

SEQ ID NO: 96121 - DNA, 50 bp, homo sapien
aaattatcacaaaaaataaataatakgcaatgtggaaacacatcacaatt

SEQ ID NO: 96122 - DNA, 50 bp, homo sapien
ggtgcagttatcctacactagtaacratggacagcagcctagtgtgggaa

SEQ ID NO: 96123 - DNA, 50 bp, homo sapien
tttagaggtgacagataatatcatcktccaggagggttccatgttagaaa

SEQ ID NO: 96124 - DNA, 50 bp, homo sapien
ccagacagattatagatttatcgtarcctcttgatttctggtagatggct

SEQ ID NO: 96125 - DNA, 50 bp, homo sapien
gggttaggagagatctaggaggaggkatcgatgtagaaggacatggtaac

SEQ ID NO: 96126 - DNA, 50 bp, homo sapien
aggaagcagactttcaagaaaagtayggaatgagatctttaaagttctga

SEQ ID NO: 96127 - DNA, 50 bp, homo sapien
ggatgaacaactctgcccaaagaaaraaccatgccgtcatcttgaatctt

SEQ ID NO: 96128 - DNA, 50 bp, homo sapien
acaagtctttaaacatctttattgcyaccaaattatatgtaggtatcatg

SEQ ID NO: 96129 - DNA, 50 bp, homo sapien
gccaatatacattttaacgctggcastaaacttttgttctacattaacct

SEQ ID NO: 96130 - DNA, 50 bp, homo sapien
gccctcaaggagttcagaatctaaayggagtaatttaaattttaatggaa

SEQ ID NO: 96131 - DNA, 50 bp, homo sapien
tagtgaaaatctgaaggccagtaaarcaattgggatctccagttttgtgt

SEQ ID NO: 96132 - DNA, 50 bp, homo sapien
acataggtgcctgtgaggtcacgtartacaagccatggctcccttggctt

SEQ ID NO: 96133 - DNA, 50 bp, homo sapien
cctccagaaatgtcactgatattaascaagctgagttatttccaggcgtt

SEQ ID NO: 96134 - DNA, 50 bp, homo sapien
ctttagggaagttagcagataagacygtactgaacaagtgatcagaggta

SEQ ID NO: 96135 - DNA, 50 bp, homo sapien
ttccaagtagatgattttaacaaacygtaagcttttatgcctgtccttca

SEQ ID NO: 96136 - DNA, 50 bp, homo sapien
agagcttttaaagaaccttttgacaygtaaccatcttctttctctacaga

SEQ ID NO: 96137 - DNA, 50 bp, homo sapien
acttggtgttactgtgactaagatgrtacccaagttgcaagactaagttc

SEQ ID NO: 96138 - DNA, 50 bp, homo sapien
tttagataatcatatttagaacatgraaacggtgattagaagtaattctt

SEQ ID NO: 96139 - DNA, 50 bp, homo sapien
gaactcaatgccagaaacttcagaarcacgtcatagatcacaacagatcc

SEQ ID NO: 96140 - DNA, 50 bp, homo sapien
aagctacccatgtccacagaaataartattaggaataagcttaaaaacaa

SEQ ID NO: 96141 - DNA, 50 bp, homo sapien
tgcataacctaatggaagatgaagaygcttgtaggaaacatttttctcaa

SEQ ID NO: 96142 - DNA, 50 bp, homo sapien
caattctcaaagatttacaaaaatawatacagcaatctctctggaattgg

SEQ ID NO: 96143 - DNA, 50 bp, homo sapien
aaattttcttataatcggaaatctckaaataatgttctaaaagtgagcta

SEQ ID NO: 96144 - DNA, 50 bp, homo sapien
cgaatactcttagagtttcccaatayatgttaccaaattaaaggctctga

SEQ ID NO: 96145 - DNA, 50 bp, homo sapien
agaatctcaggccttcatccagggakaatgcaaaaatgtaagagcaaatt

SEQ ID NO: 96146 - DNA, 50 bp, homo sapien
aaaaatatgaagttagggtaaactayatccattttgagaaactgaattct

SEQ ID NO: 96147 - DNA, 50 bp, homo sapien
caccggatggcataaaagtcactaamaacagattctcctttttatttctg

SEQ ID NO: 96148 - DNA, 50 bp, homo sapien
agcaccatcgagtcaatattaaaatsaccagaacaagataatctgaaaaa

SEQ ID NO: 96149 - DNA, 50 bp, homo sapien
tatagattgcctggcacactacctayggtggttcttcttcccttaccatg

SEQ ID NO: 96150 - DNA, 50 bp, homo sapien
aatccctcctccatatctggacaaawcttaaaataacaccacatttactc

SEQ ID NO: 96151 - DNA, 50 bp, homo sapien
cacataggcatttcatagagtattamtaagaatgtatctttttattatgt

SEQ ID NO: 96152 - DNA, 50 bp, homo sapien
tattcaaaatcagaggctttcaaccmatgtttcagagagcttaagtagga

SEQ ID NO: 96153 - DNA, 50 bp, homo sapien
tttagctttgcaacaagaattttaasactctcaaccctctgataatagaa

SEQ ID NO: 96154 - DNA, 50 bp, homo sapien
aagtaagaaagtgaaaaatatatggycaaaataaaagaaaacatggaata

SEQ ID NO: 96155 - DNA, 50 bp, homo sapien
ggtggttctccagagactaagttcarctactgatgcagtttcatatactg

SEQ ID NO: 96156 - DNA, 50 bp, homo sapien
catggaaggagaatattgaagtgggwacacttaacagctttttaggaaga

SEQ ID NO: 96157 - DNA, 50 bp, homo sapien
atggggaattagactctgatgcatayggaattgtgactctctaataaaca

SEQ ID NO: 96158 - DNA, 50 bp, homo sapien
attgagtagatatcactttgccaacyataatttttacaattcagcttttc

SEQ ID NO: 96159 - DNA, 50 bp, homo sapien
gtgtaaagagatctgaaacggacaasgaactggaagaaatgtaaaaccta

SEQ ID NO: 96160 - DNA, 50 bp, homo sapien
gtttgaatctcttctggactaactaygcaacaatctctcttagacccagt

SEQ ID NO: 96161 - DNA, 50 bp, homo sapien
tttctcttacagacagccaggaactrctaaaaagacatgggaatgatata

SEQ ID NO: 96162 - DNA, 50 bp, homo sapien
gttctcaatatattaaggattccaaycaggtcattttgtgaaacatttca

SEQ ID NO: 96163 - DNA, 50 bp, homo sapien
gaacctatgaccagattctacaaaaygaacctaatctatagccatatatg

SEQ ID NO: 96164 - DNA, 50 bp, homo sapien
tcaaggtcttaactgattatttaccrctcacattactcacaatgatgctt

SEQ ID NO: 96165 - DNA, 50 bp, homo sapien
tatctggttgttgaaaagatcctggracctacccccacttctctttctcg

SEQ ID NO: 96166 - DNA, 50 bp, homo sapien
gaatccttttttgtttcagtctaccratgtttgaataaaggagccataag

SEQ ID NO: 96167 - DNA, 50 bp, homo sapien
atatatattcatggccataaatcaaytcagcatgatatagagacatattc

SEQ ID NO: 96168 - DNA, 50 bp, homo sapien
aaattgtgccgtacactctcaggcgmataagccaaaaggctcataataat

SEQ ID NO: 96169 - DNA, 50 bp, homo sapien
aaatatctccttcataaaccataaargcaagagtctgaaagaattattat

SEQ ID NO: 96170 - DNA, 50 bp, homo sapien
gggtagtgccaagggaatatttgacrccaaagctttcaaatcttaactta

SEQ ID NO: 96171 - DNA, 50 bp, homo sapien
aagttttagctattaggacctttaaygggatccacctagccctataggat

SEQ ID NO: 96172 - DNA, 50 bp, homo sapien
taaatgagatcttgttaaatacctargcatctcaaaaaaaaaaagtgcta

SEQ ID NO: 96173 - DNA, 50 bp, homo sapien
ggtagtgtacccagaaactttttaaytagtatgttccctcctgccttttt

SEQ ID NO: 96174 - DNA, 50 bp, homo sapien
tactgaaaactggaaatgcttcttaytgatcatgtgaccacttagaaaat

SEQ ID NO: 96175 - DNA, 50 bp, homo sapien
agaaatgaataaactccttctctggkattaacaattagggatttgaagcc

SEQ ID NO: 96176 - DNA, 50 bp, homo sapien
tattctgtggtggaagaatacatcayggcctgttttacccatcgacccca

SEQ ID NO: 96177 - DNA, 50 bp, homo sapien
cacatcataagtagagagctggatcrgagttatactgcacccctacatca

SEQ ID NO: 96178 - DNA, 50 bp, homo sapien
agaaatactgacactgacatatggaraatgaaaagatcagctttcagtta

SEQ ID NO: 96179 - DNA, 50 bp, homo sapien
cacatgactcagttccaccaatagcktgtgaatggaagtgatatgcacta

SEQ ID NO: 96180 - DNA, 50 bp, homo sapien
cagacttcatctaaatggccacaatkatgctaatccctgttttctactga

SEQ ID NO: 96181 - DNA, 50 bp, homo sapien
tttctatgagacactcaattcaaaayagcgaacataaggcagtactcttt

SEQ ID NO: 96182 - DNA, 50 bp, homo sapien
ccaaagtcaagtgattgtcaatggayctctcaaataaactgacttctaaa

SEQ ID NO: 96183 - DNA, 50 bp, homo sapien
atctttcctggcatccattttttcartaattgtgtgagcttctaactcct

SEQ ID NO: 96184 - DNA, 50 bp, homo sapien
aagcagtaaaagacacacttgctcaycaaaaaaatgtctctgctgagcct

SEQ ID NO: 96185 - DNA, 50 bp, homo sapien
ttaggtgggcagaaatgtatgaaacrgaataccctttcctcgtcttctgg

SEQ ID NO: 96186 - DNA, 50 bp, homo sapien
gatagaagagtgcattagtgttaagwagtaagtagaggctgggcttggtg

SEQ ID NO: 96187 - DNA, 50 bp, homo sapien
ttctttcacaatatagcttctaaacrgatcatcaagaaggttgtaaagac

SEQ ID NO: 96188 - DNA, 50 bp, homo sapien
tccttcttggcttagaaggtgaattraaagcactgtccaagatgcaaatg

SEQ ID NO: 96189 - DNA, 50 bp, homo sapien
tatgtggaaaactttggagatgttawatgcgtttcgtcaatagaagacct

SEQ ID NO: 96190 - DNA, 50 bp, homo sapien
agaggagggggatgtcttagaacacrcttattggcaatgtccaggccaga

SEQ ID NO: 96191 - DNA, 50 bp, homo sapien
acgtttttaacatctggagagaccaycaacaatagggtctagtgtcctgt

SEQ ID NO: 96192 - DNA, 50 bp, homo sapien
catttttttccctaagaaatggtcaygttacaagtcataaaatgccaaaa

SEQ ID NO: 96193 - DNA, 50 bp, homo sapien
taggtcatcgtttattgcatgttaaygttgtggtatgttctttacatctt

SEQ ID NO: 96194 - DNA, 50 bp, homo sapien
ctacatctttaaagaaagagaattargtatttgaagtaaaagaatttgct

SEQ ID NO: 96195 - DNA, 50 bp, homo sapien
ttttttttaaagagctgaggataacraatactgatgttcaatttgctaac

SEQ ID NO: 96196 - DNA, 50 bp, homo sapien
accctgaattgctctgcagtttgaargagagtctgatatctgaaccaaca

SEQ ID NO: 96197 - DNA, 50 bp, homo sapien
ctagagaactgttatccaaaaccaayggtatgagatttctacataacatg

SEQ ID NO: 96198 - DNA, 50 bp, homo sapien
ttttagtttagggtgtgtttgaacaygtttgtagataaaatgggacaaca

SEQ ID NO: 96199 - DNA, 50 bp, homo sapien
atacccagacaagataacgtggacamatggctcagggaatataactaccc

SEQ ID NO: 96200 - DNA, 50 bp, homo sapien
aacttctttaatatcataacgatcartgaaaaactcttgatcttattctg

SEQ ID NO: 96201 - DNA, 50 bp, homo sapien
ctggaagagacttggaaattgatggyctcaaaagatagtgccctggaata

SEQ ID NO: 96202 - DNA, 50 bp, homo sapien
atgaaagaatacaaatctaggagggyatcataactatcaacaagattgaa

SEQ ID NO: 96203 - DNA, 50 bp, homo sapien
tctgcagtaaggcccttttgataaarccaataaacaagtaacaggtttct

SEQ ID NO: 96204 - DNA, 50 bp, homo sapien
cataaggaaacaatgcaaaaggtacraaaaccaatggaaaaaatagacaa

SEQ ID NO: 96205 - DNA, 50 bp, homo sapien
ttcccagggtcatcattatgaactcyaatttttgtacttggttgtaaaca

SEQ ID NO: 96206 - DNA, 50 bp, homo sapien
ccctattcttccagctaagctctaaytaactacaaatccgggaccttata

SEQ ID NO: 96207 - DNA, 50 bp, homo sapien
agtcaactaaaacagaaggcttaatwatatacagtctcagaacataatag

SEQ ID NO: 96208 - DNA, 50 bp, homo sapien
tattcaattttgagaggtcactttamcttcctgaatcctctttcctcagc

SEQ ID NO: 96209 - DNA, 50 bp, homo sapien
caacaacttctagtgctgaatactawgtagaggataggtagtggtgcata

SEQ ID NO: 96210 - DNA, 50 bp, homo sapien
atgtagagctgtcattgacttttccyaaggtgtttaattgcctgtaggaa

SEQ ID NO: 96211 - DNA, 50 bp, homo sapien
gaccactatgaatttccgtgaatgckcagagaattttcaaacaaaacaag

SEQ ID NO: 96212 - DNA, 50 bp, homo sapien
gaattctggttggacattcattgtaycttatcattatatctctataactc

SEQ ID NO: 96213 - DNA, 50 bp, homo sapien
tttgtcaataactactttatagaatracaaaattttacagtagctgtaat

SEQ ID NO: 96214 - DNA, 50 bp, homo sapien
cttgaaattgaaagatgtttcagcartatctgatttatacacacacatac

SEQ ID NO: 96215 - DNA, 50 bp, homo sapien
aaggcttgactggaaccggaatcatyatgaaataagttgaactacaacca

SEQ ID NO: 96216 - DNA, 50 bp, homo sapien
aaatattatatccaaatagttttaawtggcttaataattggaattaaatt

SEQ ID NO: 96217 - DNA, 50 bp, homo sapien
aaaggaaagttttataaaagacatgmaattagagttttcaactgggcaga

SEQ ID NO: 96218 - DNA, 50 bp, homo sapien
acacaggccatgctactgcaactaarggactcccaatacacaaattcaat

SEQ ID NO: 96219 - DNA, 50 bp, homo sapien
ttttttttcctctttatttctttaaracctctaatttgcaggggtttagg

SEQ ID NO: 96220 - DNA, 50 bp, homo sapien
tcgatctctattaggctcacatacaytattttaatttgactccagctctg

SEQ ID NO: 96221 - DNA, 50 bp, homo sapien
agaattaaattcaactcagaagtaaygctaattgggaaaaagtaaaactg

SEQ ID NO: 96222 - DNA, 50 bp, homo sapien
gagcagtgagttcgagcagatacttmtaggaaagagactttctttcttcc

SEQ ID NO: 96223 - DNA, 50 bp, homo sapien
gacctgagtctattaatccacatacyggtgttttgcctgaaagccatatt

SEQ ID NO: 96224 - DNA, 50 bp, homo sapien
tgaaggcaacaggcatgaactggaayaaccttggccatgctgggacgtat

SEQ ID NO: 96225 - DNA, 50 bp, homo sapien
taggcggactatctgctggcccagamaaattacatcataggatcctgaga

SEQ ID NO: 96226 - DNA, 50 bp, homo sapien
caatgatttgcttgggaaatagcaayggtgtgagccccgacagtatctgg

SEQ ID NO: 96227 - DNA, 50 bp, homo sapien
ctgtaccctgcaatctgtctggaaaytatattagtcctatcataaaaaat

SEQ ID NO: 96228 - DNA, 50 bp, homo sapien
tggagctatcaaggggcgggcacagraaatgctatattcggtttacatgt

SEQ ID NO: 96229 - DNA, 50 bp, homo sapien
aggagatagcggatgggagatgcaayggtagaagagggccgagggctgtg

SEQ ID NO: 96230 - DNA, 50 bp, homo sapien
attcacatcaataacacatagaatakttttctcagaacttgtgtcatgtt

SEQ ID NO: 96231 - DNA, 50 bp, homo sapien
acaacactttttgactctgccgctarcatttttctcaggtctcaactttt

SEQ ID NO: 96232 - DNA, 50 bp, homo sapien
tctcacagaatgacatttgagatacygctatggttttacatttttttctc

SEQ ID NO: 96233 - DNA, 50 bp, homo sapien
tgaactgaatgggcaaatacgacaayggctgaggaatgttgctgtgaagg

SEQ ID NO: 96234 - DNA, 50 bp, homo sapien
aatctctagaagtaattgttcttatygcaccttattgacaatgcatagta

SEQ ID NO: 96235 - DNA, 50 bp, homo sapien
atgaattccataatcagaaatcctasctgatctaacagactaatgaccaa

SEQ ID NO: 96236 - DNA, 50 bp, homo sapien
agaaagtcttcaagacttttgattaygtaaagatttccttagctatgata

SEQ ID NO: 96237 - DNA, 50 bp, homo sapien
gcagactttttctgggtagaagtatwacttgaaagaggcagctcccatct

SEQ ID NO: 96238 - DNA, 50 bp, homo sapien
tctgcccacctttattctcattagcmaaaagagactgtcctctagaatgt

SEQ ID NO: 96239 - DNA, 50 bp, homo sapien
accatacattgttttaatccttcaayggacataacattcccctcttgtga

SEQ ID NO: 96240 - DNA, 50 bp, homo sapien
cgtagcattcctataaaccaacagcraaactgatagccaaatcagaaaag

SEQ ID NO: 96241 - DNA, 50 bp, homo sapien
ataattcaaataaaatctcatacacrgtcttctagcctttaatttactca

SEQ ID NO: 96242 - DNA, 50 bp, homo sapien
acacagatccaaaccgtatcacttayatttcttacctctaaactatttct

SEQ ID NO: 96243 - DNA, 50 bp, homo sapien
atctttcttatctttgcacaatcaaracttataaaagcctcagggaactg

SEQ ID NO: 96244 - DNA, 50 bp, homo sapien
tctcacactcagtaatgcttcaagaycatttaatctgctgaattaagctc

SEQ ID NO: 96245 - DNA, 50 bp, homo sapien
tgcaaagctgatgtgtatagtatcaygcatagtccaatgcacaatgctcc

SEQ ID NO: 96246 - DNA, 50 bp, homo sapien
actatctcacaaatcagtatcataayggtagtgttacaaactcacatgcc

SEQ ID NO: 96247 - DNA, 50 bp, homo sapien
taaggccagcaaacatgtatcaagcrcatattatgattcagccactatta

SEQ ID NO: 96248 - DNA, 50 bp, homo sapien
gagtcagtttcattagtaaatgtggwataaggaatggattaaaacatgga

SEQ ID NO: 96249 - DNA, 50 bp, homo sapien
ttaaggaacgtggatttaatctttasgtgaaaatgatgcccactaggtcc

SEQ ID NO: 96250 - DNA, 50 bp, homo sapien
ggagaggggacagggtgtaaaaagawaaaagcatcatcattctttcaatt

SEQ ID NO: 96251 - DNA, 50 bp, homo sapien
tgttgaaacctcttcctgatgaccayacattgttttaatccttcaatgga

SEQ ID NO: 96252 - DNA, 50 bp, homo sapien
tcttatgtaagtattggatgccattraaatccattgaaagagcaaggggc

SEQ ID NO: 96253 - DNA, 50 bp, homo sapien
ttcactctttcaaaaagtatccctargagattaaaatactactgttagat

SEQ ID NO: 96254 - DNA, 50 bp, homo sapien
acttttagcaacaacaatgaatctcyacacaataaaacatttccaagccc

SEQ ID NO: 96255 - DNA, 50 bp, homo sapien
aaaatgttggcattgcttaggaatawcaaacataaaactctagaattatt

SEQ ID NO: 96256 - DNA, 50 bp, homo sapien
caactgcagtgtcatctgggaagtcraatgcctctttgaatgtgccgatt

SEQ ID NO: 96257 - DNA, 50 bp, homo sapien
acaatctcattttagtgtggtgaccracatgtaaaaacatgaccaaagaa

SEQ ID NO: 96258 - DNA, 50 bp, homo sapien
aactaagagctcttctaaagcatgcrtacactcacaaaacccatgagaat

SEQ ID NO: 96259 - DNA, 50 bp, homo sapien
gactggagcccttggcttctgatatrgcataataccaagaagacaatttc

SEQ ID NO: 96260 - DNA, 50 bp, homo sapien
gctctggggaaggagcttcctgttayaaatcaagtttggtcagaagagtg

SEQ ID NO: 96261 - DNA, 50 bp, homo sapien
atttggataaagactcttactagtamattgtggcggtctctttggacctg

SEQ ID NO: 96262 - DNA, 50 bp, homo sapien
tccagagtgctaaagccagtgcatakatcagcaaagtaacccagaacata

SEQ ID NO: 96263 - DNA, 50 bp, homo sapien
aaagtacttttctcttttcaattgcyctacaagtgcttggagactccctg

SEQ ID NO: 96264 - DNA, 50 bp, homo sapien
actatttaaaagtgtaccaatagctstatataatagtagaaaaaaaaaaa

SEQ ID NO: 96265 - DNA, 50 bp, homo sapien
tctctgggaatgaaaaatgaggaaarctcacttagagaaagatatgagag

SEQ ID NO: 96266 - DNA, 50 bp, homo sapien
tttaggcttgaactggtatctgaccraaagcaatttaattaacctcaagg

SEQ ID NO: 96267 - DNA, 50 bp, homo sapien
ttccttttagctagccaaggaaaaaygtaagctacggcaaacaattctaa

SEQ ID NO: 96268 - DNA, 50 bp, homo sapien
tctgcaaacctaatatgaaatacacrctaatcttcattacacggcagaag

SEQ ID NO: 96269 - DNA, 50 bp, homo sapien
ctttcagtactgttacaagtgcttayagatagaattatttaccttaggag

SEQ ID NO: 96270 - DNA, 50 bp, homo sapien
cgggaaagcctgtggtggcccaaaakgcgtcatcagctgtcagagggagc

SEQ ID NO: 96271 - DNA, 50 bp, homo sapien
ttgaatgttctatatgtatctaaaaygcccagttaagtcttagtcactga

SEQ ID NO: 96272 - DNA, 50 bp, homo sapien
ggctctgttctgatctagtcagtaarctcaccaatgtcttcttagaaagc

SEQ ID NO: 96273 - DNA, 50 bp, homo sapien
tttctcccattctgtaggttgcattyggttaattatattctttgatgtgc

SEQ ID NO: 96274 - DNA, 50 bp, homo sapien
ttgtgcatgttgaattaatcatgtcratttaattattaattcaacgtgca

SEQ ID NO: 96275 - DNA, 50 bp, homo sapien
tgtaaaactcatatgccagagacagmaaatttattaaggcatgaagggat

SEQ ID NO: 96276 - DNA, 50 bp, homo sapien
tgctagttaatgtgaaaattagaaayctttgattaaggataaaggaagat

SEQ ID NO: 96277 - DNA, 50 bp, homo sapien
tttaaaattgtctcagaggaaattayaaagagcactcttaaggtgtactg

SEQ ID NO: 96278 - DNA, 50 bp, homo sapien
tgtcttgtaattagatcatccaaaarctgtattgataatgttaacttttg

SEQ ID NO: 96279 - DNA, 50 bp, homo sapien
ttatttttgctaatatagtcactcartacttcaagcaaggaattcagaat

SEQ ID NO: 96280 - DNA, 50 bp, homo sapien
agaggactccagtttctgaaaggacrgatataagccaggctcatctcaag

SEQ ID NO: 96281 - DNA, 50 bp, homo sapien
tcacttcaatatcaaggaatataaamcagataaaattaacttaagagatg

SEQ ID NO: 96282 - DNA, 50 bp, homo sapien
aacataacacaaacaatcagatatgsaagtgttattataatagggtgacg

SEQ ID NO: 96283 - DNA, 50 bp, homo sapien
actgggcgagactatgggaaagaaartatatttagctctactttgatggg

SEQ ID NO: 96284 - DNA, 50 bp, homo sapien
ggtaggatttcaacttccaaccaccrccatctgggtgacactcttaaatt

SEQ ID NO: 96285 - DNA, 50 bp, homo sapien
tgggagagagtgattatttcaactcycttatatagcaagtcacccaaaca

SEQ ID NO: 96286 - DNA, 50 bp, homo sapien
agagctaagcctattggtaacattayggctaagtgatggtctatgtgtga

SEQ ID NO: 96287 - DNA, 50 bp, homo sapien
aaaattgcatgattaagagagttgaygacttgaacttcaacactgataaa

SEQ ID NO: 96288 - DNA, 50 bp, homo sapien
ctttaaaacaatttatcttataacaygccttactgtctcaggaaaacaac

SEQ ID NO: 96289 - DNA, 50 bp, homo sapien
agatggactatctgggaatgggtgaygcaagtttaaataaaatccttgaa

SEQ ID NO: 96290 - DNA, 50 bp, homo sapien
gcaagcttggacaacaattgggaaayactcttgccagcaaaagcatgcaa

SEQ ID NO: 96291 - DNA, 50 bp, homo sapien
aaaaaatttcaccatattaacataaytactgcattaataaccttagataa

SEQ ID NO: 96292 - DNA, 50 bp, homo sapien
tttataaattacttctacctaaaaawtaatgggctaaataattcaggtaa

SEQ ID NO: 96293 - DNA, 50 bp, homo sapien
tttgcctgtattggccaaccacttaygtaggaaatgatgctatgaaagga

SEQ ID NO: 96294 - DNA, 50 bp, homo sapien
agtaacttgtcaaaggacttcaattwaatgaattttacatattttttacc

SEQ ID NO: 96295 - DNA, 50 bp, homo sapien
ttccagagctcagcaaactctaacastacaaaattatcctaaattcgcca

SEQ ID NO: 96296 - DNA, 50 bp, homo sapien
gtttactcatagtaaatcttctggcrcttcactgatctatacaaagagaa

SEQ ID NO: 96297 - DNA, 50 bp, homo sapien
gaaaaattatcaatatctgaatccayctaagcatatataatgttttcata

SEQ ID NO: 96298 - DNA, 50 bp, homo sapien
ccacttcctctatcatccatctatckctatgtaccggcctatctatatat

SEQ ID NO: 96299 - DNA, 50 bp, homo sapien
gtctgttgcaaaatggcctagggaargaagtcagtagaaggcaggccact

SEQ ID NO: 96300 - DNA, 50 bp, homo sapien
tgtacaaatggctctaatctcaggaygttcaaaaaatgcattttacaaat

SEQ ID NO: 96301 - DNA, 50 bp, homo sapien
gctttttatataacacctatttgaawagagaaatatcctaggtataccac

SEQ ID NO: 96302 - DNA, 50 bp, homo sapien
tgatctcctaattcgaaatcgatacycaggactatttataaacccaaaat

SEQ ID NO: 96303 - DNA, 50 bp, homo sapien
tgcttggagctgccttttttgcacayggactgacttgagtagtcccttgg

SEQ ID NO: 96304 - DNA, 50 bp, homo sapien
tgatacctcactggagacactgacartaattgatgcctttatactcttag

SEQ ID NO: 96305 - DNA, 50 bp, homo sapien
tcatatgctgaataaagtgcattacraagaacttgggttttgaaaaaagt

SEQ ID NO: 96306 - DNA, 50 bp, homo sapien
gaaaaagcccaagtatatcgaatcasgaagttctgcaacatggaaactat

SEQ ID NO: 96307 - DNA, 50 bp, homo sapien
ctcctgggaaacaattttgctatgcyattgtattcacttccattgctgtc

SEQ ID NO: 96308 - DNA, 50 bp, homo sapien
agatggagaaactaaagctaagggarattaaaagatccagctaaggtcat

SEQ ID NO: 96309 - DNA, 50 bp, homo sapien
ccaaaaagcatatgaaaaagtgttcratatgactaatacctatcaatgct

SEQ ID NO: 96310 - DNA, 50 bp, homo sapien
catattgaatgaagaaaataacaacygaagataaatgccttgatatcacc

SEQ ID NO: 96311 - DNA, 50 bp, homo sapien
aaaattcaatcagaagagaggtgaasttaggaaggcctaaaatatttatc

SEQ ID NO: 96312 - DNA, 50 bp, homo sapien
tttccaatgttacttgaacacaatayaagtaatataagttttaaaaatga

SEQ ID NO: 96313 - DNA, 50 bp, homo sapien
gaggtaaccagattgcaagaactgawagtccagaactcggtttattctcc

SEQ ID NO: 96314 - DNA, 50 bp, homo sapien
gagctagccaaccatttattactgakgataaaagagaagaatttgcattt

SEQ ID NO: 96315 - DNA, 50 bp, homo sapien
ggttctaattttatttggaaatgcasgatttatgtctgttgtaaaatatg

SEQ ID NO: 96316 - DNA, 50 bp, homo sapien
atctggaagttttaagaatatatcartagcccaaatgaaaaataaaatta

SEQ ID NO: 96317 - DNA, 50 bp, homo sapien
gttatttgagctgaggtaactaaaaraatgagctagccaaccatttatta

SEQ ID NO: 96318 - DNA, 50 bp, homo sapien
gtacaggacacatttctgaacctcaratttcttagtctgcacatttcaca

SEQ ID NO: 96319 - DNA, 50 bp, homo sapien
tacttatcctgggagtagctgtgggwtctaacaatgaacagtggatcagc

SEQ ID NO: 96320 - DNA, 50 bp, homo sapien
tcatttgtaacctttgaaaatactaytaccataaagtgacacatggggac

SEQ ID NO: 96321 - DNA, 50 bp, homo sapien
gtattgtgagctgcattatgaagagraccatgtggcaagacactgaggga

SEQ ID NO: 96322 - DNA, 50 bp, homo sapien
gtagctaaaataaatccacagatccrctctgacttttcatattcctttcc

SEQ ID NO: 96323 - DNA, 50 bp, homo sapien
ctaactaatatctttgtttggagaawtttacttgccttaaatgaacaaac

SEQ ID NO: 96324 - DNA, 50 bp, homo sapien
tctagaggactattaaatagagtaayctttcattaactggcattgttgag

SEQ ID NO: 96325 - DNA, 50 bp, homo sapien
caaaactcttctcatggaattgttayctaaattaaatgacgggattgtaa

SEQ ID NO: 96326 - DNA, 50 bp, homo sapien
ataatgagataaccaaatataatacrcttggcatgcaaatactacctttc

SEQ ID NO: 96327 - DNA, 50 bp, homo sapien
tcactttgcctagagcaaaaggtacygtacagagagctatgacacagaga

SEQ ID NO: 96328 - DNA, 50 bp, homo sapien
cttaacttcaggccatctttatgccsaaattgttgctacagtccttggac

SEQ ID NO: 96329 - DNA, 50 bp, homo sapien
agacagtgggattaaatatctactaygtctatggcaacaaactgttctgc

SEQ ID NO: 96330 - DNA, 50 bp, homo sapien
tgaatataggcatcatgggaggaaaygtataattagtagaactaagaggt

SEQ ID NO: 96331 - DNA, 50 bp, homo sapien
actttgtaatttgccacaaagaaaargttctgtatataatattggtattc

SEQ ID NO: 96332 - DNA, 50 bp, homo sapien
atgaatgagcaagaaaaggagtttcwtgagatacaatatagtcctggtga

SEQ ID NO: 96333 - DNA, 50 bp, homo sapien
gggcaagttcaaaaactcctacgcargatatattttctatggctttcgac

SEQ ID NO: 96334 - DNA, 50 bp, homo sapien
gaacaagttgatttcagccctgatgmatgattttgaagggttcaaggcca

SEQ ID NO: 96335 - DNA, 50 bp, homo sapien
ctagttagaagttttctaattggtasagtggtgatggtagtgtcttttac

SEQ ID NO: 96336 - DNA, 50 bp, homo sapien
gtgaaagcccataactattctaatgwagtggaacatctgtaatggttgtg

SEQ ID NO: 96337 - DNA, 50 bp, homo sapien
aggtccttctcagctgtgcagaatcraaattgtaaggacataaatctgaa

SEQ ID NO: 96338 - DNA, 50 bp, homo sapien
aatgattttgctagtgatgtttaggmaaagtgcaaacagatctcagaaga

SEQ ID NO: 96339 - DNA, 50 bp, homo sapien
tgctcagccaagcagcctttcaactkaaggaccaattttcaggaccaatc

SEQ ID NO: 96340 - DNA, 50 bp, homo sapien
ctttaacttcttcctacttcaaaaaytagttctaaagccactctttttct

SEQ ID NO: 96341 - DNA, 50 bp, homo sapien
attacttattttccagatgtcttcaygcagtataagaaaacgagcaaata

SEQ ID NO: 96342 - DNA, 50 bp, homo sapien
tttctgtaaaatttgttaacagtagraacaaatattataaaaaactaagt

SEQ ID NO: 96343 - DNA, 50 bp, homo sapien
cacaggaacttgcagtgttccgtaastgttccttaagacaaatctataaa

SEQ ID NO: 96344 - DNA, 50 bp, homo sapien
tttatcttatgactgcacattatcayggaatacaacaaagtcattaattt

SEQ ID NO: 96345 - DNA, 50 bp, homo sapien
actgctagcaaaatttttagtaaccwacattagagtacaaattgatctag

SEQ ID NO: 96346 - DNA, 50 bp, homo sapien
tattctcttattatgctgtgtttttrgttagctctccatagaattcagtt

SEQ ID NO: 96347 - DNA, 50 bp, homo sapien
aaaagttgacataatataagtattawccaggctaattagtagcattatat

SEQ ID NO: 96348 - DNA, 50 bp, homo sapien
cattccaaacgcattactctttgtgsaactgctttgaacacggtacagag

SEQ ID NO: 96349 - DNA, 50 bp, homo sapien
tgaagagattgctttgtaaagcacaraacgctgttatcagatcattgaag

SEQ ID NO: 96350 - DNA, 50 bp, homo sapien
aggcttgtataatctactattaagamaagaaaagatatcagttgaaagct

SEQ ID NO: 96351 - DNA, 50 bp, homo sapien
tacaatgaagcaggaaaatatggccyataaccaggaaatgtcagataaca

SEQ ID NO: 96352 - DNA, 50 bp, homo sapien
aagatatgatagaattagcacacaaraacattaagaaagctattgcaatt

SEQ ID NO: 96353 - DNA, 50 bp, homo sapien
gagttagaggccaagaaattaacaartgaaaggagaggaaggtagggagg

SEQ ID NO: 96354 - DNA, 50 bp, homo sapien
caacccgtcttcccacaaactatccragctttcttattaatttatggttt

SEQ ID NO: 96355 - DNA, 50 bp, homo sapien
gtaatttttctagcagggctgaatgkataggatgttcacgagcatatttt

SEQ ID NO: 96356 - DNA, 50 bp, homo sapien
tgttttaatagttagtttattatcartcttttcctacataaactatgaac

SEQ ID NO: 96357 - DNA, 50 bp, homo sapien
tggctcccacactttatacctactgmcctggcgtctcaccggagcttctg

SEQ ID NO: 96358 - DNA, 50 bp, homo sapien
ctataaatctttatatgtaggacacrctatggttatgtttaatatgataa

SEQ ID NO: 96359 - DNA, 50 bp, homo sapien
ttaaatattctgattaattacttcaygctttgatcatctacatttccgaa

SEQ ID NO: 96360 - DNA, 50 bp, homo sapien
ggtttatacacaggcaacggttaggycaagcattctttctatcacttcac

SEQ ID NO: 96361 - DNA, 50 bp, homo sapien
tattctactgtggctgaactgatatmcagtttgtaagaaaaaggtctctt

SEQ ID NO: 96362 - DNA, 50 bp, homo sapien
ttgattcccaggcatggggtaccttyatcggactcatcaaaattctagag

SEQ ID NO: 96363 - DNA, 50 bp, homo sapien
caacttcttaagtgtctaatttccaygatgccctaaatgcactgccccct

SEQ ID NO: 96364 - DNA, 50 bp, homo sapien
tgtttttgtccttttaattatgtatwaaaggcaaaacagttgttgtgcct

SEQ ID NO: 96365 - DNA, 50 bp, homo sapien
aaaaaataatttcaccatgtaaaagracaatatgcaaatattgatggaca

SEQ ID NO: 96366 - DNA, 50 bp, homo sapien
catctctacattctcagttttcctakggaacattaaccatgcattttact

SEQ ID NO: 96367 - DNA, 50 bp, homo sapien
gatctgatgacctgagtgaaggttgrtatcattttctgagatggagcagg

SEQ ID NO: 96368 - DNA, 50 bp, homo sapien
tgatttcctctataactataggaacygaaaaaattgtattacatacaccc

SEQ ID NO: 96369 - DNA, 50 bp, homo sapien
gacagtaaatcattaaaattgtaacrgatagaagaatagcaatggtcttt

SEQ ID NO: 96370 - DNA, 50 bp, homo sapien
ccaggcatatgtgcagatagcttgaragagatcatgttattcagataatc

SEQ ID NO: 96371 - DNA, 50 bp, homo sapien
cttgtttcttctcttttaattcagayggaaagttgaccataatcagaatt

SEQ ID NO: 96372 - DNA, 50 bp, homo sapien
ttgatgaaaacgatacaaaaagtaayactgagcattagaataagggaaag

SEQ ID NO: 96373 - DNA, 50 bp, homo sapien
tccatgcagatagataaaacgaatakcatgcctttaatcttttccacata

SEQ ID NO: 96374 - DNA, 50 bp, homo sapien
tagtgaaataagtcaggtattttgaraagactttagtcagaagtgaaata

SEQ ID NO: 96375 - DNA, 50 bp, homo sapien
tttgatttgggtatagatttgggtgyagatttgcaatgctatgagaaata

SEQ ID NO: 96376 - DNA, 50 bp, homo sapien
tttctccttactggcaccaggtcaarttcctaacgagtcttcagaggagg

SEQ ID NO: 96377 - DNA, 50 bp, homo sapien
tatagctgctccaaattgtgctgtgraacatagatcagggcagatagctt

SEQ ID NO: 96378 - DNA, 50 bp, homo sapien
acaataacacaaattaatagatgacractacctcatgctttataaaatgg

SEQ ID NO: 96379 - DNA, 50 bp, homo sapien
tattctgcaatattcactttagatgwagccagttcaaatcaatgcaaagg

SEQ ID NO: 96380 - DNA, 50 bp, homo sapien
atagagtttctgtaatccgtgaagayagtgagtacctaaatgtttcttgc

SEQ ID NO: 96381 - DNA, 50 bp, homo sapien
ttagttagtctctggaaaatacaatmaccgagaaattccctgtaactatt

SEQ ID NO: 96382 - DNA, 50 bp, homo sapien
gaatttgatgattttaaaatgttgaygaagacttctggaggtatggcaga

SEQ ID NO: 96383 - DNA, 50 bp, homo sapien
atcgcacacaaagctgtttgaattaygggtatttctttttgctcacaatt

SEQ ID NO: 96384 - DNA, 50 bp, homo sapien
atgagttgccttgttgcattaaaccrcattacaaagaaatccattagcca

SEQ ID NO: 96385 - DNA, 50 bp, homo sapien
gggaggctgatggatactattaaackgagcctctgtaagtggcatttgtg

SEQ ID NO: 96386 - DNA, 50 bp, homo sapien
cagcaatgcacaggaattggacacaraaaatcggcaaagagtcttttata

SEQ ID NO: 96387 - DNA, 50 bp, homo sapien
aagaagctatttgtaactgattttargctctgtgtatttttatgttcatt

SEQ ID NO: 96388 - DNA, 50 bp, homo sapien
tgggaaatactgaagctaacccaaakacacacttgagttttatttgtttt

SEQ ID NO: 96389 - DNA, 50 bp, homo sapien
ctggggaaagaatggatattgttacsagatccaaaaatggcatccatgat

SEQ ID NO: 96390 - DNA, 50 bp, homo sapien
tacaaaccatttaccagcattctccratgtgatagtaataccagtgccat

SEQ ID NO: 96391 - DNA, 50 bp, homo sapien
aaggatagagtgtttggacattttcyaagtgcctacttactttctgttct

SEQ ID NO: 96392 - DNA, 50 bp, homo sapien
agaacaaaatcttcaaatatattaamcacagcaattaaaaactcaaatgc

SEQ ID NO: 96393 - DNA, 50 bp, homo sapien
ctacgtacaataaaagtaaccttcartctgttcttctagtctaaacatgc

SEQ ID NO: 96394 - DNA, 50 bp, homo sapien
taccatagggtagttttgaaatttaygtaatttaagccttacagggtgaa

SEQ ID NO: 96395 - DNA, 50 bp, homo sapien
ccttctttccacttttgacatcacayaggagcagttaacattatatttct

SEQ ID NO: 96396 - DNA, 50 bp, homo sapien
ctactaaatacctggatgttttcaartagtcgcatttttagcacagcata

SEQ ID NO: 96397 - DNA, 50 bp, homo sapien
ttggaagggagtattggaggagtagycatcacttttgaggactctgcaga

SEQ ID NO: 96398 - DNA, 50 bp, homo sapien
aaacatgatgaattttgagtgaatgyataaatcaatatatcacagccttg

SEQ ID NO: 96399 - DNA, 50 bp, homo sapien
atgtgcctcgatttcatatatttcaygtgtttatttatgagggacagcat

SEQ ID NO: 96400 - DNA, 50 bp, homo sapien
aaaaacatacctgtttctcattcacrcataatatctcttccagttatgca

SEQ ID NO: 96401 - DNA, 50 bp, homo sapien
tttttcacttactcctttccataaaraagtgtaacaatggagtacgttat

SEQ ID NO: 96402 - DNA, 50 bp, homo sapien
ttgttaggctattccactatgttgakgaaaagtacagatttctagtattt

SEQ ID NO: 96403 - DNA, 50 bp, homo sapien
tctctgaactgagcaacaatggagaraaatcccagagctttacataatgg

SEQ ID NO: 96404 - DNA, 50 bp, homo sapien
aagcctgagtgaatcatgtccagtargagacaaggactgcgaaagatatg

SEQ ID NO: 96405 - DNA, 50 bp, homo sapien
gatatggaccaatccctgaggccacrtaaagttagatcttctctctctgc

SEQ ID NO: 96406 - DNA, 50 bp, homo sapien
ttgtggctaagatgttagggataaaktgtactgatgtctacaatatgcac

SEQ ID NO: 96407 - DNA, 50 bp, homo sapien
cactggaggattgacattctgggtcrcttgcaggagggtaactttcatac

SEQ ID NO: 96408 - DNA, 50 bp, homo sapien
tgatgaaggttagctctggaagtgaygctgacaccttctgatacaaaatt

SEQ ID NO: 96409 - DNA, 50 bp, homo sapien
gcaagatggggaaaaacgagtttaaratatgcaggtcatggtgttctaca

SEQ ID NO: 96410 - DNA, 50 bp, homo sapien
taaaaaaaagctgctataaaacataraggttggtaaagttgagaaagcca

SEQ ID NO: 96411 - DNA, 50 bp, homo sapien
tttggaattcgagaaaggtcttcatraatggaaaattgtcaacagtgcta

SEQ ID NO: 96412 - DNA, 50 bp, homo sapien
ttcacaaagtaaaatacttttcaaarctagcaaagaactaatgctcaaag

SEQ ID NO: 96413 - DNA, 50 bp, homo sapien
actctgacactacatttctcatccaygcctttatatttcaactgctttaa

SEQ ID NO: 96414 - DNA, 50 bp, homo sapien
gagaagtatcgatcactagaaactayggactgtaatgtcaataaaatact

SEQ ID NO: 96415 - DNA, 50 bp, homo sapien
gtttgattaattgggaataccattamgtttagtagttagattatgaaact

SEQ ID NO: 96416 - DNA, 50 bp, homo sapien
gccttacacaaacctggacaggtgaraggaaaccaggaaggtgagtgtgg

SEQ ID NO: 96417 - DNA, 50 bp, homo sapien
caggacaataaaaatagctccacatwaagtaattcaaacttttctcaata

SEQ ID NO: 96418 - DNA, 50 bp, homo sapien
tttaaaatcctctggtttagattcaratatggactaaatggagaagtgtt

SEQ ID NO: 96419 - DNA, 50 bp, homo sapien
ttgtacaacacatgcacacacagaarggtatatacttgacctcccagatc

SEQ ID NO: 96420 - DNA, 50 bp, homo sapien
ctgaatgtaactcagtttcgatatamgtttttaaaattctgatttagcaa

SEQ ID NO: 96421 - DNA, 50 bp, homo sapien
gtccagtggtatttaccagtcagctrcaattcagagtttaccgagatggc

SEQ ID NO: 96422 - DNA, 50 bp, homo sapien
tgtaataaagttcctctgcattgcaygaactgatgtgcacaaagacactg

SEQ ID NO: 96423 - DNA, 50 bp, homo sapien
ttttgaatgttttgttcagtgttttrtccccagatcctaaaaagttccta

SEQ ID NO: 96424 - DNA, 50 bp, homo sapien
cacttaatcctgggatagcgattcayatatacttgggtattaaaattggt

SEQ ID NO: 96425 - DNA, 50 bp, homo sapien
gaggaaagatagcatttccaaatagytgaactgtaaaccacctagtttcc

SEQ ID NO: 96426 - DNA, 50 bp, homo sapien
attccctttctttggattgattgaarcaaaaccagctatatttttctact

SEQ ID NO: 96427 - DNA, 50 bp, homo sapien
gtgggtcatgagtaaaaatacaccartgattcttctgtagacacaattgt

SEQ ID NO: 96428 - DNA, 50 bp, homo sapien
agcaccacaagaaagatcactgaagrtttgagaaacataattggaaaatt

SEQ ID NO: 96429 - DNA, 50 bp, homo sapien
taactaatagacacctcccaaatgarcaatgtgaaaaagaatagcagtct

SEQ ID NO: 96430 - DNA, 50 bp, homo sapien
gaatcttacagaaattgtggagctgrgtaataccctcattacttttcatc

SEQ ID NO: 96431 - DNA, 50 bp, homo sapien
tacctctcttgccttgtggggaaacsaatcccatttttcagtcttgatcc

SEQ ID NO: 96432 - DNA, 50 bp, homo sapien
taaaagcttcctttgctttatttaaratcacagcagttacctcacattgc

SEQ ID NO: 96433 - DNA, 50 bp, homo sapien
attgaaaatattatttctttttctaygttcagagtgattcagacattttt

SEQ ID NO: 96434 - DNA, 50 bp, homo sapien
ttgttccgtgagccggaactcttaayaatgttctggaagcagtcacattt

SEQ ID NO: 96435 - DNA, 50 bp, homo sapien
actaagtctcattttatgagaccacyatttcttaatatcacatccagtgc

SEQ ID NO: 96436 - DNA, 50 bp, homo sapien
cccggctaatttttgtatttttaatsaagttggagtgtcactatgttggc

SEQ ID NO: 96437 - DNA, 50 bp, homo sapien
tttgtttattcagatgtgggcaatastaggccataattctttttttaaca

SEQ ID NO: 96438 - DNA, 50 bp, homo sapien
agattgaatccacacattgtaaacaygatcgccaagtaacccacaacacc

SEQ ID NO: 96439 - DNA, 50 bp, homo sapien
cagtctgttctccacttctattccartcaagatagtgagttactctttac

SEQ ID NO: 96440 - DNA, 50 bp, homo sapien
aaagttaattctgaatgtcttagtaygctgtcatccaatttttttaaatt

SEQ ID NO: 96441 - DNA, 50 bp, homo sapien
taaaaacttgtccattagcattggargatacaaaaatatacatgaaaaaa

SEQ ID NO: 96442 - DNA, 50 bp, homo sapien
atcttacggacatagaatgaatacawaataaacctttctaattctaaact

SEQ ID NO: 96443 - DNA, 50 bp, homo sapien
gcccctctccttggaagaactctgaygggaaacagatgctaagaagggat

SEQ ID NO: 96444 - DNA, 50 bp, homo sapien
ggaaactttgttatatttatttgtargtgatttatatcatattgtacttt

SEQ ID NO: 96445 - DNA, 50 bp, homo sapien
ttacaaagcagactcgctttaacacscagaacaaccatctggatcttgtt

SEQ ID NO: 96446 - DNA, 50 bp, homo sapien
gtatgctcattactttgtccagtatsttcttttttgatccttatttcaat

SEQ ID NO: 96447 - DNA, 50 bp, homo sapien
attatgaaaataactgtaactcttcycttggtactaagaaaacatcctga

SEQ ID NO: 96448 - DNA, 50 bp, homo sapien
gctttaattctctgtatgtaccttaygctagagaaattcaacattgttga

SEQ ID NO: 96449 - DNA, 50 bp, homo sapien
acatattgcaactacttaagaaaagyctggagtgacattagcaagatggc

SEQ ID NO: 96450 - DNA, 50 bp, homo sapien
taggttagaataatcagaaacgactyaatgagaaaattggattttcacaa

SEQ ID NO: 96451 - DNA, 50 bp, homo sapien
atttcatgcctatgtaactcctagarctttctaaattacttcccatgtct

SEQ ID NO: 96452 - DNA, 50 bp, homo sapien
tatttaccatgccaatgtcaagcacygtccctggttgggattgtgggaag

SEQ ID NO: 96453 - DNA, 50 bp, homo sapien
acaaagcactcccacatacaaggacraaatcctataaccaatagctgttt

SEQ ID NO: 96454 - DNA, 50 bp, homo sapien
gtttcctttaattaacttatttaagrctggagtaatactgtttgttacct

SEQ ID NO: 96455 - DNA, 50 bp, homo sapien
tagagaattatcagaattgctttaaygaaaaaccttgagaataccagtta

SEQ ID NO: 96456 - DNA, 50 bp, homo sapien
gtattgctattgcacttctcttacarcaactaaagtgatctcatttttaa

SEQ ID NO: 96457 - DNA, 50 bp, homo sapien
aatttaaatactattggcattattargtctatgaatgattgatttcattt

SEQ ID NO: 96458 - DNA, 50 bp, homo sapien
gagatggatagtacccctaagaaaakctctctgtactcctaactctgggt

SEQ ID NO: 96459 - DNA, 50 bp, homo sapien
tgctattttatggcaagtacaaacayggagattgaagagtaaagaaaaaa

SEQ ID NO: 96460 - DNA, 50 bp, homo sapien
ggctgacaactatacaaattaattascttataggtctaaagctaagaagt

SEQ ID NO: 96461 - DNA, 50 bp, homo sapien
ttggaaggaagtaggactcaagagtraagtattaaggtggggtttcaagg

SEQ ID NO: 96462 - DNA, 50 bp, homo sapien
aaatctgtttccaagtttttcactaratcctttaacatcttcatcatacc

SEQ ID NO: 96463 - DNA, 50 bp, homo sapien
tattaagataataagagaaatcaccrctttagatagaacttagaaaggaa

SEQ ID NO: 96464 - DNA, 50 bp, homo sapien
ccctttttaaataaaatatcacataygacagtctagttcttaaagctgac

SEQ ID NO: 96465 - DNA, 50 bp, homo sapien
tgagccagtgttttcagattttaggracagatttgtattcagcagaaaag

SEQ ID NO: 96466 - DNA, 50 bp, homo sapien
gttgagaaatgctaagcaatatgtayggtttaatcatttatagtgtgatg

SEQ ID NO: 96467 - DNA, 50 bp, homo sapien
acttctttatcaatcgtgttcttaaytgtaactaccctggacattttgct

SEQ ID NO: 96468 - DNA, 50 bp, homo sapien
gggaaaagggttaactaaaaaaaaayagatctgtgaagctgaagttacat

SEQ ID NO: 96469 - DNA, 50 bp, homo sapien
gtttatcaagacaatacgtgcacaaygggacatagaccctcatcagcaca

SEQ ID NO: 96470 - DNA, 50 bp, homo sapien
tgtggaaatatttgaacagaaagtarcagttaaatggtagttaggtaaaa

SEQ ID NO: 96471 - DNA, 50 bp, homo sapien
tgacaccatgatatcaattgctccaytaagatgatttcaggccatgtata

SEQ ID NO: 96472 - DNA, 50 bp, homo sapien
aactcatctttctattgtttaaagargtagagggaggccaaggtgggcgg

SEQ ID NO: 96473 - DNA, 50 bp, homo sapien
tcctactttgcttgtcttaacttgcrcctcattgtttatactgggacttg

SEQ ID NO: 96474 - DNA, 50 bp, homo sapien
aagagattgcagaggaaaagtaatargtgataagccctgtcttctaaacc

SEQ ID NO: 96475 - DNA, 50 bp, homo sapien
aaaagactaacattggataattagtraacttcaaagggaaaaaagcaaca

SEQ ID NO: 96476 - DNA, 50 bp, homo sapien
ttttattcagatggtacatatgatgragattgtgagtataggaggaaagc

SEQ ID NO: 96477 - DNA, 50 bp, homo sapien
aaaattaccaatgccttgttaatacyaagcatgtcctgggagataaggac

SEQ ID NO: 96478 - DNA, 50 bp, homo sapien
aacacaattatcaaagtagacaagaytatttgtacagttcatgtatacta

SEQ ID NO: 96479 - DNA, 50 bp, homo sapien
gctttctgcctcacatttttaacagwacctagattggaagagatgtatct

SEQ ID NO: 96480 - DNA, 50 bp, homo sapien
atctacttttaaactgaaatatctgygcatgcaatagaggttttaagggc

SEQ ID NO: 96481 - DNA, 50 bp, homo sapien
ctgataagatgtagattactcagatyactggttgcattctagagatttgt

SEQ ID NO: 96482 - DNA, 50 bp, homo sapien
gtatttggtagagacagtcttttagkttgtttgactgaagcataaattca

SEQ ID NO: 96483 - DNA, 50 bp, homo sapien
ttgtagtaatagcatgtaaatgggakaaaagggagtgttgcaaaggttgg

SEQ ID NO: 96484 - DNA, 50 bp, homo sapien
tctgctcatgtccaacttcataaagwctgttcattaatctgttcctcccc

SEQ ID NO: 96485 - DNA, 50 bp, homo sapien
tgtctgctcttctgccgctattgctrttcattctggaattgacacaataa

SEQ ID NO: 96486 - DNA, 50 bp, homo sapien
gtttaattcaggaactgtgaccctgmagtgttctttttgacaatttgtca

SEQ ID NO: 96487 - DNA, 50 bp, homo sapien
ttttagaaggaacaatttatacgtcracagagatagggattagtgtagtc

SEQ ID NO: 96488 - DNA, 50 bp, homo sapien
tctgcttggtgccctattctactgcractaagctgccatccaagccacac

SEQ ID NO: 96489 - DNA, 50 bp, homo sapien
tatatgaataatctctctgcttttargtatattgctccatagctgtttag

SEQ ID NO: 96490 - DNA, 50 bp, homo sapien
gagcttctattgtctggaactagatsaatctttacaaatgatttggtcca

SEQ ID NO: 96491 - DNA, 50 bp, homo sapien
tagaaaagttatcaaaaaactgtcayggaaataaataacttggaatggta

SEQ ID NO: 96492 - DNA, 50 bp, homo sapien
ctactctgcgatcccatgatatacaytgaaattagggatcctttttcaat

SEQ ID NO: 96493 - DNA, 50 bp, homo sapien
gaagggagagtgggagttaattagtsaaaggaggccaatgtatttaggca

SEQ ID NO: 96494 - DNA, 50 bp, homo sapien
tcccaggctctcactccatctgtaaytgagaaaagctgtataagatctct

SEQ ID NO: 96495 - DNA, 50 bp, homo sapien
tctgtagaaagttcatcttcaaggtsaacagaaacatctactgagcagtt

SEQ ID NO: 96496 - DNA, 50 bp, homo sapien
catgcatttatgtgttttgtaagtartaataactatcacttttggaatgt

SEQ ID NO: 96497 - DNA, 50 bp, homo sapien
tttccgaatccttgtgtccttttcaytatgatcaattcatctaaatcacc

SEQ ID NO: 96498 - DNA, 50 bp, homo sapien
ggtctcagttaacggggacgctttaragaaacgcactcgcctctcctgtt

SEQ ID NO: 96499 - DNA, 50 bp, homo sapien
caaaagtctgatcaactctgaaggarctaacaaaatagtttctagacctg

SEQ ID NO: 96500 - DNA, 50 bp, homo sapien
ggatcccacatggaacacatacttaygaggttttagcattttcaccatta

SEQ ID NO: 96501 - DNA, 50 bp, homo sapien
tgttctcctccaacatatttttccartagcataggggatgtctagaggaa

SEQ ID NO: 96502 - DNA, 50 bp, homo sapien
ttagtattataattaaaaaatgtacrcctataatctgtagctctataata

SEQ ID NO: 96503 - DNA, 50 bp, homo sapien
gtgagaaaaggaaatgctcctccaaygaagcagggtgttattccgtgatg

SEQ ID NO: 96504 - DNA, 50 bp, homo sapien
gaacttgatcagcagtttctagtacmacactttgctgaggtaaagggaac

SEQ ID NO: 96505 - DNA, 50 bp, homo sapien
gaagttaaacatagtaacaacattaraaaccctctgcaccacagtggaca

SEQ ID NO: 96506 - DNA, 50 bp, homo sapien
aaaaactaaatgaaagcgcaaatccrgagacgtaagttgaccactgaagc

SEQ ID NO: 96507 - DNA, 50 bp, homo sapien
gtgtttgacatatagtagtgcctcartgaaagtaggctattgtcaactgt

SEQ ID NO: 96508 - DNA, 50 bp, homo sapien
tttcattttgctgtatttaatccaartgataaaggaatttaataaaatta

SEQ ID NO: 96509 - DNA, 50 bp, homo sapien
caagtctgtgaacgcctttaggttcrggaagtagatgagaaattgtgaat

SEQ ID NO: 96510 - DNA, 50 bp, homo sapien
acagagaagactgaaaacagaaaacsggtcaatttactacaacatgggaa

SEQ ID NO: 96511 - DNA, 50 bp, homo sapien
tctggaaattaggagtaattatacarattgcagtgacaagtaagtgaaat

SEQ ID NO: 96512 - DNA, 50 bp, homo sapien
ctctagaaaaatatgcctgagaatgrattaaagtgttaattctttctttg

SEQ ID NO: 96513 - DNA, 50 bp, homo sapien
attaaaaatatcacttcatgcagtamtttcacccttgggaatctctccca

SEQ ID NO: 96514 - DNA, 50 bp, homo sapien
ttcatgttgtggatttggcggaggasattttactggttaccgttcttact

SEQ ID NO: 96515 - DNA, 50 bp, homo sapien
tgtccaatgtggctggattaggatamaaagtgtgatcaaggccggaaatg

SEQ ID NO: 96516 - DNA, 50 bp, homo sapien
tattaaccaatgtgttcatatttcawactttactattaaacccactagtt

SEQ ID NO: 96517 - DNA, 50 bp, homo sapien
ttacttttctctaacaaacatgaatraaacctagtaaaatctccaaacca

SEQ ID NO: 96518 - DNA, 50 bp, homo sapien
catctaacagaaagctcctttggtcragaagaattagctacaacttacat

SEQ ID NO: 96519 - DNA, 50 bp, homo sapien
ctttgaggtgtgtacaagtatactcygactctataaacttactcttcttt

SEQ ID NO: 96520 - DNA, 50 bp, homo sapien
atcaattatttccatgctaaggagayaagtaatttttttaagtcttggta

SEQ ID NO: 96521 - DNA, 50 bp, homo sapien
ctagataaagaaggaagtgtggagartagatgcttaagtcaaaaaatatt

SEQ ID NO: 96522 - DNA, 50 bp, homo sapien
caaataatgatataaaatctatagaratgattatcacttgggcattaatg

SEQ ID NO: 96523 - DNA, 50 bp, homo sapien
atgtttatccacaaacatgtttcagyagagagtaattcataatattattt

SEQ ID NO: 96524 - DNA, 50 bp, homo sapien
ttcatgcctgtaacacaactcctagmatgtcccttaattatctatttaca

SEQ ID NO: 96525 - DNA, 50 bp, homo sapien
gcatgtcccttaattatctatttacrcatcaatttctcacaggaaagttt

SEQ ID NO: 96526 - DNA, 50 bp, homo sapien
tttgaactgtaatgatgatcctggaragaaaaaaaattcctcatatgtct

SEQ ID NO: 96527 - DNA, 50 bp, homo sapien
ggaatacttaggtgggatgaacaaamgtcattggaattggcctctagatt

SEQ ID NO: 96528 - DNA, 50 bp, homo sapien
agtttttaaaaagccttcaagacatragtagcacttttagttaactgcta

SEQ ID NO: 96529 - DNA, 50 bp, homo sapien
taattatcctagttctacttcttacwatcattgtcaccctacacaaacct

SEQ ID NO: 96530 - DNA, 50 bp, homo sapien
cacagtcatatttctaatgccgaatracacatctggtgcgcagtgcttaa

SEQ ID NO: 96531 - DNA, 50 bp, homo sapien
tagaacatagtacatttaaagagccrtgattattgtaaatacaggggcat

SEQ ID NO: 96532 - DNA, 50 bp, homo sapien
gcaagcttcttataaaatgcagctaytgagagagatgccagaactcttct

SEQ ID NO: 96533 - DNA, 50 bp, homo sapien
ttctagagatattcttttggctctascattctaaacttttttaaaattca

SEQ ID NO: 96534 - DNA, 50 bp, homo sapien
ataaatattatagttttgagcatcarggaatacattttcagagtcatcaa

SEQ ID NO: 96535 - DNA, 50 bp, homo sapien
tctctaccttgatgccatgtctctayagtgtgttgtaattgcatgtccaa

SEQ ID NO: 96536 - DNA, 50 bp, homo sapien
tactatgttgatagagatggtaaaasaaagcatgattgtactatgtgtgg

SEQ ID NO: 96537 - DNA, 50 bp, homo sapien
ttataacggtgcaaaaagaaatggartacatggctgcttagaggctggga

SEQ ID NO: 96538 - DNA, 50 bp, homo sapien
ctgtaatgaaatgatggacataaagrctgctttgaaaagttgtatatgtc

SEQ ID NO: 96539 - DNA, 50 bp, homo sapien
ttaaacatgagagttgttgactacayggtttggagaaggaaaattaaagt

SEQ ID NO: 96540 - DNA, 50 bp, homo sapien
tataaaaaacaagaacttatcactamcctaaacacaattttagagcaagg

SEQ ID NO: 96541 - DNA, 50 bp, homo sapien
tgctcctgagtgacatcaccaagacrggtcagtcccattccagtgcgcct

SEQ ID NO: 96542 - DNA, 50 bp, homo sapien
ctgtttaaagggttataagtccaagscatggaagctagaaaacatagatc

SEQ ID NO: 96543 - DNA, 50 bp, homo sapien
aaataaatttggaaaatgtaatgcayggagtctttgaaagaactaaaatc

SEQ ID NO: 96544 - DNA, 50 bp, homo sapien
agtcctctggatttggtcagaagatraaggaaaatagtagagaaaaggga

SEQ ID NO: 96545 - DNA, 50 bp, homo sapien
gttttctctgatacctatatacctamcttagaaaatgcattctgtacaat

SEQ ID NO: 96546 - DNA, 50 bp, homo sapien
attttccagttttgcattgataaaawtgatgtataaatataacaaatgaa

SEQ ID NO: 96547 - DNA, 50 bp, homo sapien
tgatttatttgagtaagttgaaccayttttgcatcactgggataaatccc

SEQ ID NO: 96548 - DNA, 50 bp, homo sapien
tttaactttttcagatggtaattaaygcacatatgcgagagagaaccttc

SEQ ID NO: 96549 - DNA, 50 bp, homo sapien
aattgttttagtttaagacatcatawcatctagctagaaattatttattg

SEQ ID NO: 96550 - DNA, 50 bp, homo sapien
gccagagctgcagtggaactccatcragaaagtctggaagtcaatggccc

SEQ ID NO: 96551 - DNA, 50 bp, homo sapien
tggtatgaactgacattgagggaacraaagagtcaatgacttagaatttc

SEQ ID NO: 96552 - DNA, 50 bp, homo sapien
atgacctttggcagtggtaaatcccrataacaagggcaattcaacagatt

SEQ ID NO: 96553 - DNA, 50 bp, homo sapien
atagagcaaaaagtctttgtacctcyattgtattattggctaaaagcaga

SEQ ID NO: 96554 - DNA, 50 bp, homo sapien
caaattccttaaaagaaattgaaaaygaggatattaacccattaagctac

SEQ ID NO: 96555 - DNA, 50 bp, homo sapien
gcaaaacaaaaactctaaagagagcsaattatgttatcatcacctgtgta

SEQ ID NO: 96556 - DNA, 50 bp, homo sapien
gcttccatgcctgctgcttccagtaratgtagacacagcagtaacaaatt

SEQ ID NO: 96557 - DNA, 50 bp, homo sapien
tataggataacaaataaaatgcaggsatatcattaaaaataacatataaa

SEQ ID NO: 96558 - DNA, 50 bp, homo sapien
ttatgaaaaacaatatgcactaccartggtaataagtataatagtcacaa

SEQ ID NO: 96559 - DNA, 50 bp, homo sapien
ctcttacacatatgtttataaataayactagtctctatggtgtctgagtt

SEQ ID NO: 96560 - DNA, 50 bp, homo sapien
attactaaacatatgccttcccaaarataagttcctcctgacaaatatag

SEQ ID NO: 96561 - DNA, 50 bp, homo sapien
gtctgtctcctaattaatgactgcawgatccgtatttttccattcttttt

SEQ ID NO: 96562 - DNA, 50 bp, homo sapien
gacaactccagcacaaccaatacttkaagccatgaagttgtaacctatct

SEQ ID NO: 96563 - DNA, 50 bp, homo sapien
tatatgctacctgctagaacgtggcrgatcacattagaaaggcaaacaaa

SEQ ID NO: 96564 - DNA, 50 bp, homo sapien
acctatctcagaaggtatccggttarcattctgttgaaagcaaaggcaaa

SEQ ID NO: 96565 - DNA, 50 bp, homo sapien
acgcagaatcaagtaatgtatccacyggttatacagtatgcaatataagc

SEQ ID NO: 96566 - DNA, 50 bp, homo sapien
tcccttagtaataccaaaatcttcasttatttatcatattattcttatga

SEQ ID NO: 96567 - DNA, 50 bp, homo sapien
tcaaatcctagtatgtacctcataasttaagctagctcaaattaattaat

SEQ ID NO: 96568 - DNA, 50 bp, homo sapien
accttgattagattaaggctactcargatccattttattcaatgattaca

SEQ ID NO: 96569 - DNA, 50 bp, homo sapien
attcttaagggaggctattaggaacmcatttttgctcaagtaaatgataa

SEQ ID NO: 96570 - DNA, 50 bp, homo sapien
gaattgtctcttgagttatctttackcaacagcatcattttgaaacaaag

SEQ ID NO: 96571 - DNA, 50 bp, homo sapien
aaaaaaatacactttcaacatagacygtaagcatgggtagaagctggctt

SEQ ID NO: 96572 - DNA, 50 bp, homo sapien
tcttctgttctcatgggtacaaatamagtaacagttttgaaaatatgttt

SEQ ID NO: 96573 - DNA, 50 bp, homo sapien
ttgcaataatgccatgtcctcagtasgtacttgataaattctcaatgatg

SEQ ID NO: 96574 - DNA, 50 bp, homo sapien
ttgaagtgatattaagttatcttggycaggtagttcctgggttgcctgaa

SEQ ID NO: 96575 - DNA, 50 bp, homo sapien
acaagaaacaaaacagatttccaagkatttttgattacagcccaaaaggt

SEQ ID NO: 96576 - DNA, 50 bp, homo sapien
atccctattaaccaaaaaccttgaaytgctctgttgccatacactaaact

SEQ ID NO: 96577 - DNA, 50 bp, homo sapien
aagaagttttggagactgcatatcayaccctattttaaaggttcacattt

SEQ ID NO: 96578 - DNA, 50 bp, homo sapien
atattattacctccattatacaaacratagaagcttgaaatgaagggatt

SEQ ID NO: 96579 - DNA, 50 bp, homo sapien
ctttatttttagttactttattagamggctaatctcatttactctaaatc

SEQ ID NO: 96580 - DNA, 50 bp, homo sapien
tcagttacctctaataatggaataasaaaaacattaaataacaaagagtc

SEQ ID NO: 96581 - DNA, 50 bp, homo sapien
tgcttaaaacactatttcttttacaygtagttcaagatagcttttgggaa

SEQ ID NO: 96582 - DNA, 50 bp, homo sapien
aataatccttgagtgaagtgaaaaaytctataagccacttacttattcac

SEQ ID NO: 96583 - DNA, 50 bp, homo sapien
ctcccccatcaggttgtgacaactawaatgtctttggacattcccaaatg

SEQ ID NO: 96584 - DNA, 50 bp, homo sapien
tagcaaaatccctgatggaattaaartgttcagaaaccatatcatctgac

SEQ ID NO: 96585 - DNA, 50 bp, homo sapien
agggtctttcttctctagttttatarcatctacaatatctaatgacttag

SEQ ID NO: 96586 - DNA, 50 bp, homo sapien
ttgagtatgtgccattatggtggtgkaagaaaatagtgtttcaatgactc

SEQ ID NO: 96587 - DNA, 50 bp, homo sapien
cataatggcacatactcaaaacaaawtatttgcatagacattgtaacatg

SEQ ID NO: 96588 - DNA, 50 bp, homo sapien
ccagaagtccagtagagtagcatccrgagcagttttcacagctgggcaca

SEQ ID NO: 96589 - DNA, 50 bp, homo sapien
atttgggaggtaaaaagatatcataygtatttattgtgtcaatgacctat

SEQ ID NO: 96590 - DNA, 50 bp, homo sapien
atgtttaaagctttacagaagttgcrgattacaaatcacattgagaggat

SEQ ID NO: 96591 - DNA, 50 bp, homo sapien
atatgcaaaagaaggcaacttaaaayactcagtccccagaacaccaagga

SEQ ID NO: 96592 - DNA, 50 bp, homo sapien
tacatatgttctattctgtttcaaasttaaacacggcagacttttataga

SEQ ID NO: 96593 - DNA, 50 bp, homo sapien
ggataaagcttgttccaaccagtaartcaagattcttcaccaagaacctt

SEQ ID NO: 96594 - DNA, 50 bp, homo sapien
ctcgcaaagtaccatttctccatttyattctagttgctgggtcattccag

SEQ ID NO: 96595 - DNA, 50 bp, homo sapien
aagcatatcagttttaatcccgactstactcttttcctcttctgatgctt

SEQ ID NO: 96596 - DNA, 50 bp, homo sapien
tctttgaaccaatattgtcatcagtyacttggaggacaaattgagcccat

SEQ ID NO: 96597 - DNA, 50 bp, homo sapien
agttaatacatataaagtacttgaarccaggacctggaacttttattacc

SEQ ID NO: 96598 - DNA, 50 bp, homo sapien
attaaatgcaggaaatgagctgtccrcaccgagaactcctaaatccaaag

SEQ ID NO: 96599 - DNA, 50 bp, homo sapien
gctgttttaaatatcatctatcttayctggatagtcaatagtccttaagt

SEQ ID NO: 96600 - DNA, 50 bp, homo sapien
acaacacactattcttctttgcttaytaactgctgaacacacagcttaca

SEQ ID NO: 96601 - DNA, 50 bp, homo sapien
cctttagcctcaattacctctttacmcttaagtatcatactcctgaggaa

SEQ ID NO: 96602 - DNA, 50 bp, homo sapien
taactccatttatcaaacttcgccartattgctcatactcattcccttct

SEQ ID NO: 96603 - DNA, 50 bp, homo sapien
ctgttgcttgcaactgccactaattygagttttcatttaaaaaaagtcct

SEQ ID NO: 96604 - DNA, 50 bp, homo sapien
gttcagcaaaacatgtataattaacyagaagtccagtagagtagcatcca

SEQ ID NO: 96605 - DNA, 50 bp, homo sapien
taaccatttataaatcaaatccattkaaggccaataataaataggacaca

SEQ ID NO: 96606 - DNA, 50 bp, homo sapien
atgtaaggtatataaatatgagacayggtccttggtatgaagttgctaac

SEQ ID NO: 96607 - DNA, 50 bp, homo sapien
agaacagagctgatttaatacaggaygcaggctctgaaaaaatatgctga

SEQ ID NO: 96608 - DNA, 50 bp, homo sapien
aaaatatatatgaatgacagtctaaycaatatgaggttaaaaggagaaag

SEQ ID NO: 96609 - DNA, 50 bp, homo sapien
tttagtaaatgacattgaaggagcasattatctttaggaaactcttcctg

SEQ ID NO: 96610 - DNA, 50 bp, homo sapien
aagtgccttcccttttagaacagagmcattatttggtgatacttttgtca

SEQ ID NO: 96611 - DNA, 50 bp, homo sapien
ataagctgcatagagctctccatcamaataacaaaaaaggtttcagtgct

SEQ ID NO: 96612 - DNA, 50 bp, homo sapien
taaagaaagtgtttattgtctgtacmacccagcacatcatgcagtccctt

SEQ ID NO: 96613 - DNA, 50 bp, homo sapien
cacacaagtctcaaagaggggtttayatgcagtgacttttggtacaatcc

SEQ ID NO: 96614 - DNA, 50 bp, homo sapien
gacctacaagcagacaagtcttagaygacgccagagggtaaatgtgatac

SEQ ID NO: 96615 - DNA, 50 bp, homo sapien
tcaaccaagaaactatgtaacagagracgaaaaagatattggaactacaa

SEQ ID NO: 96616 - DNA, 50 bp, homo sapien
gctaaaacggaaggaaagaaacctaygaaaatgataaagaatgtactcta

SEQ ID NO: 96617 - DNA, 50 bp, homo sapien
gagcaccaaggaaatgctgaaaaatmtaaaaagtgttgtggatcaaatga

SEQ ID NO: 96618 - DNA, 50 bp, homo sapien
gaggggacatgtgaagcttttgctgraccagaattaatttctcctgcgtt

SEQ ID NO: 96619 - DNA, 50 bp, homo sapien
attattaaatgtcactcaagttaatmaatcagttctctatacctgccatg

SEQ ID NO: 96620 - DNA, 50 bp, homo sapien
atactctctatacctctaataaataygattagtcagcagtaggaccagat

SEQ ID NO: 96621 - DNA, 50 bp, homo sapien
agaaaatcatgatgccgtgcctcaaygcaggagaaattaattctggtcca

SEQ ID NO: 96622 - DNA, 50 bp, homo sapien
attaaacgcagcctagagactagaarggacatgaaataagaaggaagaat

SEQ ID NO: 96623 - DNA, 50 bp, homo sapien
gcccaagaagtatgattttttaatawgtaggcaagtccattaaacgcagc

SEQ ID NO: 96624 - DNA, 50 bp, homo sapien
caatcattaaaaagtcaggaaataaygtcttacttctctcttcagaagca

SEQ ID NO: 96625 - DNA, 50 bp, homo sapien
gaaattaatctagaaatgtgttaaaycgcttatagggctagagtgtgtct

SEQ ID NO: 96626 - DNA, 50 bp, homo sapien
attataatatgttccaataggattaygttctctttgggccaacaagtatt

SEQ ID NO: 96627 - DNA, 50 bp, homo sapien
taactttaaacatgttttagaattcrcctaaagatcaaaatatcatggat

SEQ ID NO: 96628 - DNA, 50 bp, homo sapien
cagaagagggtagcctgtgtcccaamgaaaggagaggtacaaagcaggca

SEQ ID NO: 96629 - DNA, 50 bp, homo sapien
tatgaagaattttctgaaatgaccastatatatctaaaagatttaaagac

SEQ ID NO: 96630 - DNA, 50 bp, homo sapien
tctattgtcacattgttcctcaaaawtatgccctttacactttcaattag

SEQ ID NO: 96631 - DNA, 50 bp, homo sapien
acttacagtttacatttttacactcratattttctaaaatagcatcagta

SEQ ID NO: 96632 - DNA, 50 bp, homo sapien
acttcaaagaattactagctgataaytgattactaatatcaaatgaggac

SEQ ID NO: 96633 - DNA, 50 bp, homo sapien
ctttgaaatacttgctatgtcttgayaggaataggagaagccagaattgg

SEQ ID NO: 96634 - DNA, 50 bp, homo sapien
cctcacatgctgacctaaaaaacatragatcattttaaaactgtttttag

SEQ ID NO: 96635 - DNA, 50 bp, homo sapien
tctaaaagatttaaagacccaatgtsaacttcaggcctatggttttactg

SEQ ID NO: 96636 - DNA, 50 bp, homo sapien
tgatatttttttcaaatatgagttargtttaggtttattacagaaggata

SEQ ID NO: 96637 - DNA, 50 bp, homo sapien
ctttctctaccacatccccaaaatasacacaatcctcaaatctaagatct

SEQ ID NO: 96638 - DNA, 50 bp, homo sapien
tagattgaccatttcaattgatcaarctatttgtcaaaattttcttccta

SEQ ID NO: 96639 - DNA, 50 bp, homo sapien
aatcatgttaatactaaaaggaagaraaattatgtacagagtacataatt

SEQ ID NO: 96640 - DNA, 50 bp, homo sapien
ggcatttaggaaagagttttgcatayattaagtgtgaaataaatactgga

SEQ ID NO: 96641 - DNA, 50 bp, homo sapien
aactaggcccctttgattcctagaayggttgtacaaagactgagactcag

SEQ ID NO: 96642 - DNA, 50 bp, homo sapien
tccacgagatcctggttccaattackcctaattatttgttatgtcctatt

SEQ ID NO: 96643 - DNA, 50 bp, homo sapien
tctgctccagagacaggccgtgatgraaattcaaatgatggctccactct

SEQ ID NO: 96644 - DNA, 50 bp, homo sapien
actctgctagacattacggtaaatgyatcaaaaaatgataagttatcctt

SEQ ID NO: 96645 - DNA, 50 bp, homo sapien
tggtgtttctcctactctattggcakagctttaatttgtttttctcattg

SEQ ID NO: 96646 - DNA, 50 bp, homo sapien
aactgctctgatggagagggtgaaarttgacaaggaaagccctccacttt

SEQ ID NO: 96647 - DNA, 50 bp, homo sapien
gctgagcaaattaataaagtaagcaygattgagacagaaaaacagttata

SEQ ID NO: 96648 - DNA, 50 bp, homo sapien
ccagacacctttaataggtaggctcragtcttttgaaaaagactaagctc

SEQ ID NO: 96649 - DNA, 50 bp, homo sapien
cagagtccattatcactcaaatgtgraatgtttggttacaacgggactct

SEQ ID NO: 96650 - DNA, 50 bp, homo sapien
ctactttgtcttagccttatctgaasagaggagaggtcaattagacaatt

SEQ ID NO: 96651 - DNA, 50 bp, homo sapien
agaatatttttcacacgctaatagaraaaaagccaaacaggaaatgctat

SEQ ID NO: 96652 - DNA, 50 bp, homo sapien
tatgaagtgttttaaagtgacttgtytgcttagcaagaatctgactgtta

SEQ ID NO: 96653 - DNA, 50 bp, homo sapien
taagcagtttatgagcaaagtactgyattaatttcaagttgacagaatct

SEQ ID NO: 96654 - DNA, 50 bp, homo sapien
taataatagtctaggaataagaaacsacagatggaaaagtatcagttggg

SEQ ID NO: 96655 - DNA, 50 bp, homo sapien
aaatagaatctggatgctaagcacartacttaatatgatgttaatagaca

SEQ ID NO: 96656 - DNA, 50 bp, homo sapien
acagattcctttctagttaactcgakgattttctattctctttaatgcat

SEQ ID NO: 96657 - DNA, 50 bp, homo sapien
aacaagataaactgtggagcacagaytccgaaatgctttggagagattgt

SEQ ID NO: 96658 - DNA, 50 bp, homo sapien
ggcagacagcacagtaataattatcrcaagcaagaatcatcaatgaatgc

SEQ ID NO: 96659 - DNA, 50 bp, homo sapien
tcttggttcaaatatgccattttctsaattctaatgtccgtctcatctta

SEQ ID NO: 96660 - DNA, 50 bp, homo sapien
aggttctcctgtacttgtaggagagraaaatccaggaggtgggacaaatg

SEQ ID NO: 96661 - DNA, 50 bp, homo sapien
catctgcataaaactaaatcttactraaaactctatatgcatctcaagta

SEQ ID NO: 96662 - DNA, 50 bp, homo sapien
tcagtgttgggagtctttctcattasagggttagctaaacatataagatt

SEQ ID NO: 96663 - DNA, 50 bp, homo sapien
cagtagttgcccatgatgtagtaccyagcaaaaccctagaactgaattca

SEQ ID NO: 96664 - DNA, 50 bp, homo sapien
cttaacacaggcaagtgtagaaatcwccataaatttgacagatttttttt

SEQ ID NO: 96665 - DNA, 50 bp, homo sapien
cccagtcacactgatttgatccttaygaattacatgaacatattaaatta

SEQ ID NO: 96666 - DNA, 50 bp, homo sapien
gcttcaagagttggggatccagtgamagctcgcactgcccaggaagaagc

SEQ ID NO: 96667 - DNA, 50 bp, homo sapien
gcactgcccaggaagaagcctggaartgggagttttagtgttgaagggat

SEQ ID NO: 96668 - DNA, 50 bp, homo sapien
gccaatatcataaaatgatgtacacyagatggttatttttaatgtgagta

SEQ ID NO: 96669 - DNA, 50 bp, homo sapien
tcagtttattcccacgtacaacatartagtaaactcctaaataataaagt

SEQ ID NO: 96670 - DNA, 50 bp, homo sapien
gaattatcaagtacatactaatgctrtgcttctattttggtctctagaat

SEQ ID NO: 96671 - DNA, 50 bp, homo sapien
aaaataagaatgtaaaagtaagtaawtcagaggaaaatgcattgcaagta

SEQ ID NO: 96672 - DNA, 50 bp, homo sapien
acactctgacctaaaagagaacaagrcccaatactacagaaattctgata

SEQ ID NO: 96673 - DNA, 50 bp, homo sapien
gaaattctgatatttctccttaagtwcaattggattttccagctggggag

SEQ ID NO: 96674 - DNA, 50 bp, homo sapien
ctccgaaatagaaaggctctgttacractctcctggggctcttccgtaaa

SEQ ID NO: 96675 - DNA, 50 bp, homo sapien
ttattatataatgggtttctatgtaygattgctctcatttttaatatatt

SEQ ID NO: 96676 - DNA, 50 bp, homo sapien
gctgaagtggggggatctcttgacastaggagttgagaccagcctgggta

SEQ ID NO: 96677 - DNA, 50 bp, homo sapien
agtactctaataagaaagttacagcrcaggccactagggtttggaataag

SEQ ID NO: 96678 - DNA, 50 bp, homo sapien
caaataaaaaatcactgggctgagasaaaccaaatcctgtagtaaaacga

SEQ ID NO: 96679 - DNA, 50 bp, homo sapien
ctacaaaccagtggactcaacctagratttctgtagcatattttcaagac

SEQ ID NO: 96680 - DNA, 50 bp, homo sapien
gtagaggaaaatagttgtaacaaaaytcatacaagctctgtcaattccta

SEQ ID NO: 96681 - DNA, 50 bp, homo sapien
ttgaaacaaaatattttcctagcacyctaaaagcgcaggaattataacca

SEQ ID NO: 96682 - DNA, 50 bp, homo sapien
aagccagaatgaaaaatttggaagartaagtgttaagatgggaagatgaa

SEQ ID NO: 96683 - DNA, 50 bp, homo sapien
gatagtgagaatagaaatggagacargtggtcaaatgagatttaggaaat

SEQ ID NO: 96684 - DNA, 50 bp, homo sapien
ctttcactggatttctactgatatamccttctgaatttctgttcacaaca

SEQ ID NO: 96685 - DNA, 50 bp, homo sapien
acagaaaaaattgctgtgattgagaygactgaggccgatgccagctagtc

SEQ ID NO: 96686 - DNA, 50 bp, homo sapien
ttatccaggataatctatattttgargtgtataaccttagttatatttgc

SEQ ID NO: 96687 - DNA, 50 bp, homo sapien
ttgtgtattttccataaaatatttcrctttcaagaaggggagagagtaga

SEQ ID NO: 96688 - DNA, 50 bp, homo sapien
tctagaaattttattagagtctttawccctgaatcagtttcagtattagc

SEQ ID NO: 96689 - DNA, 50 bp, homo sapien
aaacataattctcacatcaactaatsaaaaacattgtctcacatatgaac

SEQ ID NO: 96690 - DNA, 50 bp, homo sapien
cacaaaagtcaacataatttgacacsaatataattaaatgtaactctcag

SEQ ID NO: 96691 - DNA, 50 bp, homo sapien
tcctggagcacatttaaggttataaygactagagttaaagaggaggaaag

SEQ ID NO: 96692 - DNA, 50 bp, homo sapien
taataattaatgaatcacacaatgartaagttaagtagttgatatgaaat

SEQ ID NO: 96693 - DNA, 50 bp, homo sapien
tggagatcgtggtggatattttccgraagctgggactgaggcagtgcctt

SEQ ID NO: 96694 - DNA, 50 bp, homo sapien
acatcaaaaactatatagtttgatartacttggacaaattttgaaatgat

SEQ ID NO: 96695 - DNA, 50 bp, homo sapien
ttgccaatgaggtcagattaccataygctaacaaaataattccctatatt

SEQ ID NO: 96696 - DNA, 50 bp, homo sapien
catggtggaagcatttatgcctcagmaattagaaaatactatggatcacg

SEQ ID NO: 96697 - DNA, 50 bp, homo sapien
ctaaaatgtgtaagaaaaagtgtgtsaaattctaatacacttgctataaa

SEQ ID NO: 96698 - DNA, 50 bp, homo sapien
tgtaagcatccactttgattgatggstataatggcattttgggtccccag

SEQ ID NO: 96699 - DNA, 50 bp, homo sapien
aactgaggaagaatatattcataacygtgtggtgtaagactgtgatgctg

SEQ ID NO: 96700 - DNA, 50 bp, homo sapien
tacacattttagttttagagtaatayctgttcatgatagaaaatacataa

SEQ ID NO: 96701 - DNA, 50 bp, homo sapien
gaaagtcaatgtagagattctatcarttgccaagtgcctatctcaattat

SEQ ID NO: 96702 - DNA, 50 bp, homo sapien
tacaatttatattatacaagtatgaygataggacagaaatcattaaattt

SEQ ID NO: 96703 - DNA, 50 bp, homo sapien
gtcccaaaaccctggagcgaatgcgkactaagggagagcggccggcgcgt

SEQ ID NO: 96704 - DNA, 50 bp, homo sapien
gatccactgtacagcataacacctayagttgacgatacagaattttatac

SEQ ID NO: 96705 - DNA, 50 bp, homo sapien
gtaagccactcaatttgtggtaacarcaatagagaccttaacacagttaa

SEQ ID NO: 96706 - DNA, 50 bp, homo sapien
gaattatctgctcaaagaaatagacycgcttagaggaattgctattcttc

SEQ ID NO: 96707 - DNA, 50 bp, homo sapien
aattttttattttgaaagatgtgaakaattatataatgaacaccaacata

SEQ ID NO: 96708 - DNA, 50 bp, homo sapien
actacacattaaaccagttcgtcccraagttactttacagattgaaacac

SEQ ID NO: 96709 - DNA, 50 bp, homo sapien
ttttacagcatctgtttcttcagaaygagtaataagcttcttgggattat

SEQ ID NO: 96710 - DNA, 50 bp, homo sapien
taatatcctggaatctcttgataatkagaccacagatggaagggaatatc

SEQ ID NO: 96711 - DNA, 50 bp, homo sapien
tgctcttttgctcaaaaacctaccarggctcgtcagttcatactgtatta

SEQ ID NO: 96712 - DNA, 50 bp, homo sapien
taaaatatatatttgctttccctgayagagaattacaaagaggagaaagc

SEQ ID NO: 96713 - DNA, 50 bp, homo sapien
tgtcatttgttgaacacatactacayaccattagaagctagccaatatgt

SEQ ID NO: 96714 - DNA, 50 bp, homo sapien
gccaggactgccataaatctgaccarcttcaaatataaaatcatcctgac

SEQ ID NO: 96715 - DNA, 50 bp, homo sapien
ctgcataggacttttagcaatgttamataggtagtaaggagagtctatga

SEQ ID NO: 96716 - DNA, 50 bp, homo sapien
gatccaatgtgatccactgaatcccyaaacatgataaacctagcattatc

SEQ ID NO: 96717 - DNA, 50 bp, homo sapien
ctactgaggattattcctaatacaayctaatacaacctccatatctgcat

SEQ ID NO: 96718 - DNA, 50 bp, homo sapien
tcatactaattggctgtcttttatckcattacccaaagataatgactact

SEQ ID NO: 96719 - DNA, 50 bp, homo sapien
gtagagttgagataggtgagtattaygaatatttttaatggtttccatga

SEQ ID NO: 96720 - DNA, 50 bp, homo sapien
catggaggatgggaaatagcacaacratatatattacaagtagcagtagc

SEQ ID NO: 96721 - DNA, 50 bp, homo sapien
taatatttttggagactttgaggaawaaaacttggacaatcatttcttgt

SEQ ID NO: 96722 - DNA, 50 bp, homo sapien
gtcgttttctcaaaaaaatatcgtayaagtgactcatcctgtctgctaac

SEQ ID NO: 96723 - DNA, 50 bp, homo sapien
ttaaaatggacttgacattttcctgragaagttgccaaatatcatatcca

SEQ ID NO: 96724 - DNA, 50 bp, homo sapien
tggcaaaactgcattaaacaaaaaartttcatgttagtcttgtatgagct

SEQ ID NO: 96725 - DNA, 50 bp, homo sapien
tgctgaggtgacagaaacaatagccrctgtatgtagagaaagacagagtg

SEQ ID NO: 96726 - DNA, 50 bp, homo sapien
aatgatttggttattgtgaacatgawgataactatggtcaaattaaacat

SEQ ID NO: 96727 - DNA, 50 bp, homo sapien
aaaatttttggttgagatcttaaaawatttctaaataataatccctagta

SEQ ID NO: 96728 - DNA, 50 bp, homo sapien
gaaataatctacaattgctaaatctsttgcacaggtatctcagtgtgtgc

SEQ ID NO: 96729 - DNA, 50 bp, homo sapien
tatctttttcagtcatagttatggaraggaaactcagccaaaacctttat

SEQ ID NO: 96730 - DNA, 50 bp, homo sapien
gtatttgttaaagtgcatagtgtatyggtattgtgttaataaacatgata

SEQ ID NO: 96731 - DNA, 50 bp, homo sapien
ttattattggagctgatgactgctgrcaaagacttctataccagccaatc

SEQ ID NO: 96732 - DNA, 50 bp, homo sapien
atcatgtggtgttgtccactaaagayggcacagagttggttggtaggcat

SEQ ID NO: 96733 - DNA, 50 bp, homo sapien
tgaataaaattacatcagcactaaamtactggtgctagaaggggaatatg

SEQ ID NO: 96734 - DNA, 50 bp, homo sapien
tccttcacaattaatctgtcactaamtcgagctattcttgccttcacaat

SEQ ID NO: 96735 - DNA, 50 bp, homo sapien
gcccctgctgatcttcaacatgaaayacagtttgctggcaattttactca

SEQ ID NO: 96736 - DNA, 50 bp, homo sapien
aaagtgtagttttatgaccatctatrataaaaaaccatttggaatatttg

SEQ ID NO: 96737 - DNA, 50 bp, homo sapien
gaaggatgagagagataatattcccrcttacaacatgagcattaaaggat

SEQ ID NO: 96738 - DNA, 50 bp, homo sapien
aaataaattttactacccatactgayaggcaataaattctaatacttcat

SEQ ID NO: 96739 - DNA, 50 bp, homo sapien
ttaaatcatttcatgcccaatatagyaggagttgtatgtccctggagcta

SEQ ID NO: 96740 - DNA, 50 bp, homo sapien
tcattgaattatgatagtacgctcartattttagtattgtaaattatttt

SEQ ID NO: 96741 - DNA, 50 bp, homo sapien
attaaattggttgtaattaataatayctacttccaggatgagaatcaaat

SEQ ID NO: 96742 - DNA, 50 bp, homo sapien
cttagcccagcacattgggtccacaractaatggttttcatatactttat

SEQ ID NO: 96743 - DNA, 32 bp, homo sapien
gtttcatcatcccttgmatgaaggatcaaata

SEQ ID NO: 96744 - DNA, 50 bp, homo sapien
gtgtagcacatacgtagtataagaaytctgttgatataatgccgcagtca

SEQ ID NO: 96745 - DNA, 50 bp, homo sapien
ttagaattataagcaaatgactaaaktgggctctataaagttttaggtat

SEQ ID NO: 96746 - DNA, 50 bp, homo sapien
tataaattaatgagaatttccaagarcggagacaataatgataggaacaa

SEQ ID NO: 96747 - DNA, 50 bp, homo sapien
tcatgatgggaacaatgggaacaagygagacagagcctgtcttcaggctt

SEQ ID NO: 96748 - DNA, 50 bp, homo sapien
acttttgctgtgatttagatttcaayggagaattggcaggatcaatctca

SEQ ID NO: 96749 - DNA, 50 bp, homo sapien
atagtatgttattcctctagtgagawctgattaaaaatatgccagtgttc

SEQ ID NO: 96750 - DNA, 50 bp, homo sapien
aacttacctaacttgagctaaacaargaagataagcgctgaccaggtgga

SEQ ID NO: 96751 - DNA, 50 bp, homo sapien
aacagtgcaagctagattttagtgargagagaattatgtccgaaggatat

SEQ ID NO: 96752 - DNA, 50 bp, homo sapien
agactttgaatggtcagagctgggcyataaggaataatctggaaacagtg

SEQ ID NO: 96753 - DNA, 50 bp, homo sapien
gctttccactgtaaaaattaatcacrattgatgaaaaatgttccaaaatg

SEQ ID NO: 96754 - DNA, 50 bp, homo sapien
ttagtagatactgccagtattcctaygtagttttatgtttttacacttat

SEQ ID NO: 96755 - DNA, 50 bp, homo sapien
ggacactcctggaggacagataactkacttaatggatgctttgtaaacat

SEQ ID NO: 96756 - DNA, 50 bp, homo sapien
taaggattggcaatgtgtctaggaaycactctcgctccagttcaggcctt

SEQ ID NO: 96757 - DNA, 50 bp, homo sapien
atgcaaagggaattttgtagacatgrttaagagcatcttgattatccaga

SEQ ID NO: 96758 - DNA, 50 bp, homo sapien
gtaagttgttgtgaataatatcttgragaaacctacctgggttgtagagt

SEQ ID NO: 96759 - DNA, 50 bp, homo sapien
aatagaaacaacacaaatgaaaggayattaaagttaacaaggaataatga

SEQ ID NO: 96760 - DNA, 50 bp, homo sapien
tgttggtaactacggtatctggttaygctctttcaatcatctaaatatct

SEQ ID NO: 96761 - DNA, 50 bp, homo sapien
ccgggcatgaagtagagtattatgaygtaagaatggagagagaaaataat

SEQ ID NO: 96762 - DNA, 50 bp, homo sapien
gttgaccattgaggtcgctgagttawccttaatttcttgtcagcccttct

SEQ ID NO: 96763 - DNA, 50 bp, homo sapien
ccatattatcccagtatcctcttagmcatgatggacatgcttgagtagtg

SEQ ID NO: 96764 - DNA, 50 bp, homo sapien
gagcaatgcattttctttaaacagartaactggcttgtattcattcatca

SEQ ID NO: 96765 - DNA, 50 bp, homo sapien
tcactaatagttactcaagattagayagcatttagaaaattcagttaata

SEQ ID NO: 96766 - DNA, 50 bp, homo sapien
acagttagtctagataatctaaactraagcctctttcaagtgagtgtcat

SEQ ID NO: 96767 - DNA, 50 bp, homo sapien
aagataagagagagtaatgaagtcayatcactgagaaggaattatttcag

SEQ ID NO: 96768 - DNA, 50 bp, homo sapien
ctactgcacaattctttttacaggartatcttttttctgtaaatttaaaa

SEQ ID NO: 96769 - DNA, 50 bp, homo sapien
tgcctccatttgttgcttccatttgyaggtgataataatcagaagagatg

SEQ ID NO: 96770 - DNA, 50 bp, homo sapien
ccaaataagaacaagtaaggcataastgagtaagaaaatgaacattttta

SEQ ID NO: 96771 - DNA, 50 bp, homo sapien
gaagcaataatgtccattagcattaragaatcgtcactgggaaattgaca

SEQ ID NO: 96772 - DNA, 50 bp, homo sapien
cttccaaattcattctataaagtcawcattaactcaatatcaaaaccaga

SEQ ID NO: 96773 - DNA, 50 bp, homo sapien
gtaaaggtgctcttgctttcctgaartcaatcagaagccatttcttgagg

SEQ ID NO: 96774 - DNA, 50 bp, homo sapien
tatgaagttcaattttgggagcttarcagttcagataaatgagaattaca

SEQ ID NO: 96775 - DNA, 50 bp, homo sapien
tctgccattcttgtggctttctcackaggaacgcagaggatggaggtggg

SEQ ID NO: 96776 - DNA, 50 bp, homo sapien
agtgttaattaaatatgcatatttargattgtggcttaatgccttgtttt

SEQ ID NO: 96777 - DNA, 50 bp, homo sapien
cacttactttgctattaacacacgaytattttttagctaagggcagttcc

SEQ ID NO: 96778 - DNA, 50 bp, homo sapien
agatcagattgtaaaatcaggcttaraagaatcaaataccttactaacta

SEQ ID NO: 96779 - DNA, 50 bp, homo sapien
catggcagaatgcagatgacttcagrtacagaaatctttgtccctttgga

SEQ ID NO: 96780 - DNA, 50 bp, homo sapien
cataactttaatcttcctgaaactaycctttattcaaaaacgctaaagta

SEQ ID NO: 96781 - DNA, 50 bp, homo sapien
ttctgaaaaaaaagatggtttcacaytctgtttttgatttctagtaagaa

SEQ ID NO: 96782 - DNA, 50 bp, homo sapien
cttctttttctttgccacacttccaytctgtatctatgcatcagactaat

SEQ ID NO: 96783 - DNA, 50 bp, homo sapien
tggatttttctaccgtcctcagttamattagacctttggcttgtacaaaa

SEQ ID NO: 96784 - DNA, 50 bp, homo sapien
caaaaacctgagagcagttactggcraatggtagcactgaacctctcaag

SEQ ID NO: 96785 - DNA, 50 bp, homo sapien
atgataaaaacacttatacacaaaakaattgattagaacaataaaatttt

SEQ ID NO: 96786 - DNA, 50 bp, homo sapien
caacaatttgcctaatggagttgtamggtatttcaaggtatgtccaccta

SEQ ID NO: 96787 - DNA, 50 bp, homo sapien
aagtcagacagaacacttagaagagrccatatatgatttaattttaatta

SEQ ID NO: 96788 - DNA, 50 bp, homo sapien
taagatattccttgacctttacacargaattatgtttttttgattttttt

SEQ ID NO: 96789 - DNA, 50 bp, homo sapien
aactcctccaccagaaacactctccraacaaaaactgacggcctcaagaa

SEQ ID NO: 96790 - DNA, 50 bp, homo sapien
tctttgaatttttttttaatgtttayagcaaagttgcaaagatagtatat

SEQ ID NO: 96791 - DNA, 50 bp, homo sapien
gagtttcagacatgaaagcttcaaartgaacctattatataaccttgctt

SEQ ID NO: 96792 - DNA, 50 bp, homo sapien
cagagctgagagtggtagatggaacyattcttccaaagcatcatttcccc

SEQ ID NO: 96793 - DNA, 50 bp, homo sapien
ccaggctgggctggcccagacagtcraagagtaggaccagccacttctca

SEQ ID NO: 96794 - DNA, 50 bp, homo sapien
ttctatgtctgtaatttgtgattaamctgccattaaaaaagaactatata

SEQ ID NO: 96795 - DNA, 50 bp, homo sapien
aacaagcttagcagatgagtgagaargcaaggaaagagaatcagacttgg

SEQ ID NO: 96796 - DNA, 50 bp, homo sapien
gacttccgggtatagtaaagagtaayggcctaacaccaagaaaatggaaa

SEQ ID NO: 96797 - DNA, 50 bp, homo sapien
aaaaagaagtagctttatgagagtakattaattcagatcaagggagtgag

SEQ ID NO: 96798 - DNA, 50 bp, homo sapien
ctgttgattaatctttagattgtacyattatttaacattgtattaattta

SEQ ID NO: 96799 - DNA, 50 bp, homo sapien
aaatgacatgatgtccggaattgtamgtaaagtcacctagtaatgcggtg

SEQ ID NO: 96800 - DNA, 50 bp, homo sapien
taccaacataaattcaggtgctaaayggaaaaaacaaaaccaaaaataac

SEQ ID NO: 96801 - DNA, 50 bp, homo sapien
ttcaatttcactctactgaatattaygctatacctcaaggtttttataga

SEQ ID NO: 96802 - DNA, 50 bp, homo sapien
catttaagtacctcaataaattctayggcacatcagtctgtgaagctata

SEQ ID NO: 96803 - DNA, 50 bp, homo sapien
gtgtaccagctagaagtaactacaartataatgcttattgccaaagaaaa

SEQ ID NO: 96804 - DNA, 50 bp, homo sapien
atataaatcaaagaggattgctttayaggattgctgtcccatatgtgact

SEQ ID NO: 96805 - DNA, 50 bp, homo sapien
agtgactgaataagtgtgtcagtaaktaatttcaacatttggatattgaa

SEQ ID NO: 96806 - DNA, 50 bp, homo sapien
ccacaaattgagaaacactaactcasggtaaatgagttgatgctgacaac

SEQ ID NO: 96807 - DNA, 50 bp, homo sapien
taattctaacttagaaacctagagasacttcaaaaatactatggtttcat

SEQ ID NO: 96808 - DNA, 50 bp, homo sapien
ctctcatacttatttttgatattgcraattctgactcttactcttccttt

SEQ ID NO: 96809 - DNA, 50 bp, homo sapien
ttggtctcttataccatgaaaataasttacagataaattaaatctctaaa

SEQ ID NO: 96810 - DNA, 50 bp, homo sapien
taatcaggagacatagaaggtattawcagagtggaggaccctacacccaa

SEQ ID NO: 96811 - DNA, 50 bp, homo sapien
aagttaatacaatacactaatagcasaggtaggactaaaatcaagatatt

SEQ ID NO: 96812 - DNA, 50 bp, homo sapien
cccatgctatcacctctaccagtagyccccaaaaataaatagacataaaa

SEQ ID NO: 96813 - DNA, 50 bp, homo sapien
ctaacataactgttttggtgcactaygaacgacactcatataagacagcg

SEQ ID NO: 96814 - DNA, 50 bp, homo sapien
aattatttatattcattagagggtasagtagtttaggtgttaattgccag

SEQ ID NO: 96815 - DNA, 50 bp, homo sapien
aagaccctttttagccagggaaataygtgtagtgcatgtgagccctgaga

SEQ ID NO: 96816 - DNA, 50 bp, homo sapien
tttttagatatagtaggaccctttcragagaacaagaacaaataagtata

SEQ ID NO: 96817 - DNA, 50 bp, homo sapien
ttctttggaaaacaagccctgtggaraattccttccatcaagttgcttca

SEQ ID NO: 96818 - DNA, 50 bp, homo sapien
tttgccttcctaccatgttatttaaytactatcattgagttgctcaattc

SEQ ID NO: 96819 - DNA, 50 bp, homo sapien
ggaaaactgttttacttcattaagayggcatgtgtggcctctagagagac

SEQ ID NO: 96820 - DNA, 50 bp, homo sapien
ttcctgtcactcacttctgccttaaycgaagagctctttgagcgaaatca

SEQ ID NO: 96821 - DNA, 50 bp, homo sapien
cttgattgtcaccactgaattagatratcaataactgtaactgaagaaga

SEQ ID NO: 96822 - DNA, 50 bp, homo sapien
gaccaattaactcattaggtaaaacygattattagtgcactaaaaatgaa

SEQ ID NO: 96823 - DNA, 50 bp, homo sapien
taactcccttaaacatattgctagamcaaaatctggagtcgggggaagga

SEQ ID NO: 96824 - DNA, 50 bp, homo sapien
aaaatggtcatcaataatacctgaarctctctcaataatatggaataata

SEQ ID NO: 96825 - DNA, 50 bp, homo sapien
gagttgagacagggtaggagtatcawgtattgcttcacactggggccacc

SEQ ID NO: 96826 - DNA, 50 bp, homo sapien
ttaccctaaaatgtatatgaaaaggmaaacaaattaggatagctaaaatt

SEQ ID NO: 96827 - DNA, 50 bp, homo sapien
aaaggtgcatcttcttctcaacttgwacctttccagtttacttgggaccc

SEQ ID NO: 96828 - DNA, 50 bp, homo sapien
tattagaatctagaaatacatcgtargagcaattattcaataaccaagct

SEQ ID NO: 96829 - DNA, 50 bp, homo sapien
cccactgttatatattctgagaagtraaatgcacctttctcacattcatt

SEQ ID NO: 96830 - DNA, 50 bp, homo sapien
agggtgtgtaaattgtttcagatagycaaggaaaagtcacaccacagagg

SEQ ID NO: 96831 - DNA, 50 bp, homo sapien
tttgaataatagtcgttataatataygtgccatagtgcatccgtagcact

SEQ ID NO: 96832 - DNA, 50 bp, homo sapien
tagaaccaatccccttatgcaaaaayacgaatagcaacaatgatgtagag

SEQ ID NO: 96833 - DNA, 50 bp, homo sapien
acttacagatataagacaaacacgayctaaattacattaagctgtgtgtg

SEQ ID NO: 96834 - DNA, 50 bp, homo sapien
aacctattgaattgaataggttcaawaggttcaaacttccattttcaaac

SEQ ID NO: 96835 - DNA, 50 bp, homo sapien
tggaaaatatagaaattatagaagaycattacaagaaaattaaaacctcc

SEQ ID NO: 96836 - DNA, 50 bp, homo sapien
atctcactcaagatgggaagtctcaraagtaaccgagagccgtgttgttg

SEQ ID NO: 96837 - DNA, 50 bp, homo sapien
tctcatctctattagaattaatccaygtatagttttgccaaaacctcagc

SEQ ID NO: 96838 - DNA, 50 bp, homo sapien
acagacaaaggcatatgccacaagaraggaacagagtttcactgggttta

SEQ ID NO: 96839 - DNA, 50 bp, homo sapien
tatttggtcatttggtcttagatgtsaaaattattaatccaagaattatt

SEQ ID NO: 96840 - DNA, 50 bp, homo sapien
tcctttaaagtgctcaactaaagaaytgtcaactatatgagaaaaactca

SEQ ID NO: 96841 - DNA, 50 bp, homo sapien
ttatattttacctaaaagtattcatkaggaaacaattatttttaccattg

SEQ ID NO: 96842 - DNA, 50 bp, homo sapien
ttcttctcagactatagcttaactakgatgaggcccattatcggtgatgt

SEQ ID NO: 96843 - DNA, 50 bp, homo sapien
tattttcaggcagaaccattatgatragtagggtagagcatcacacttgg

SEQ ID NO: 96844 - DNA, 50 bp, homo sapien
attttttgtaggctttataatatcayctgagtctattattacctctgaca

SEQ ID NO: 96845 - DNA, 50 bp, homo sapien
tctctggagtcattgtataagataaygtaataagtgcaaaggcagtctgg

SEQ ID NO: 96846 - DNA, 50 bp, homo sapien
tgttcaccgaatttataataggcaaygcttttaatgaaattaatagcctg

SEQ ID NO: 96847 - DNA, 50 bp, homo sapien
agcaggatgtccagcaatagcatctraagacaatatatgaaaaaaaataa

SEQ ID NO: 96848 - DNA, 50 bp, homo sapien
atagtggtttccaagcattcttgcayattataatgacctaggaagctttt

SEQ ID NO: 96849 - DNA, 50 bp, homo sapien
ttaatcaatctttagcccatactaamaactgatgctcaagtatggaaaat

SEQ ID NO: 96850 - DNA, 50 bp, homo sapien
tatatgtttatgagttaaaatataaracactttgtatgggactcaaatta

SEQ ID NO: 96851 - DNA, 50 bp, homo sapien
tagtatctaagtgattacttgactamgccttcgatggagatatttcataa

SEQ ID NO: 96852 - DNA, 50 bp, homo sapien
catagagatgtattatgaagatatasatataaagccatttgtattttaca

SEQ ID NO: 96853 - DNA, 50 bp, homo sapien
caccaggacgttttagagggcatagkagaaagttatcctcatatttaatt

SEQ ID NO: 96854 - DNA, 50 bp, homo sapien
caattctaaaattttagaacaataaytgggtctttaaatatagatttggg

SEQ ID NO: 96855 - DNA, 50 bp, homo sapien
ctaacagatttgtgactaaaagttarggatattgaatgaatacagacaag

SEQ ID NO: 96856 - DNA, 50 bp, homo sapien
attgacattatgtcatcggtattacmaaaagataacatgtttgaaatctt

SEQ ID NO: 96857 - DNA, 50 bp, homo sapien
ctcaaagagaaagtcttctctaatgytcatatagtgcggacaagaaaaac

SEQ ID NO: 96858 - DNA, 50 bp, homo sapien
taaatcctttcaatgaaagaggtaasgtagagaaagactcaatatgggac

SEQ ID NO: 96859 - DNA, 50 bp, homo sapien
gacattttgaacatttgttttcccamtgcttaacggttatctccattttt

SEQ ID NO: 96860 - DNA, 50 bp, homo sapien
tgttacaatcatagcagactctgtcrgtgccttgccctatccctctgatc

SEQ ID NO: 96861 - DNA, 50 bp, homo sapien
caccattcctgtttaatttctacctmctcctgttacaatcatagcagact

SEQ ID NO: 96862 - DNA, 50 bp, homo sapien
tggtttaatctcttacttaaatacaktcatttgcatttgagtaactcgac

SEQ ID NO: 96863 - DNA, 50 bp, homo sapien
aatggttggaagcctaaggaatacawctcatctttagatcagaatctcct

SEQ ID NO: 96864 - DNA, 50 bp, homo sapien
taggggttggagaaaatgtgccctarctcaggcagatagcaaagatgctg

SEQ ID NO: 96865 - DNA, 50 bp, homo sapien
agcactgtagttaagttttgggccaytaatagctcaagtcacagcgattg

SEQ ID NO: 96866 - DNA, 50 bp, homo sapien
tgtttgccttttagctataaacaacygtgtgcatatctgtacaggaattc

SEQ ID NO: 96867 - DNA, 50 bp, homo sapien
aagacacatgtttgtgttgaactacygaatatgatttggactagtgctct

SEQ ID NO: 96868 - DNA, 50 bp, homo sapien
ttaggctagacatttttaacaagagracactcaattgtagaaggttggaa

SEQ ID NO: 96869 - DNA, 50 bp, homo sapien
tgaattataatacaagcgtatgaaasaagattcacaaacagatattaaaa

SEQ ID NO: 96870 - DNA, 50 bp, homo sapien
tgttctaaagatttatctgtttaccyacataattttttcctctttaagat

SEQ ID NO: 96871 - DNA, 50 bp, homo sapien
gcatgtgaagtgtaattgctacacakattaagtatcgtgataaaacctta

SEQ ID NO: 96872 - DNA, 50 bp, homo sapien
gtaatgagaagcaagaagtaggaagragcttagcctatacatcactcaac

SEQ ID NO: 96873 - DNA, 50 bp, homo sapien
agttaatgtggatacataaacttacraaaagatgataaattcaaaatagg

SEQ ID NO: 96874 - DNA, 50 bp, homo sapien
tcttgacagttgtttctttaacaatratgtataatccaataatgtataat

SEQ ID NO: 96875 - DNA, 50 bp, homo sapien
aaaaacagacaatgttaggtaaagayaggctgatagacaacatgtagaaa

SEQ ID NO: 96876 - DNA, 50 bp, homo sapien
tccttttcagctactgctgtaatatsctactcctcttctcactgaaattt

SEQ ID NO: 96877 - DNA, 50 bp, homo sapien
aagccatggactagaatagcagagawaatgaagaaatttgggttgctgat

SEQ ID NO: 96878 - DNA, 32 bp, homo sapien
ttttttcaaatccctaygttcagtgactctta

SEQ ID NO: 96879 - DNA, 50 bp, homo sapien
cagaaaacgctgtatgtaaaacacartcgaagctatcaatatcagacagg

SEQ ID NO: 96880 - DNA, 50 bp, homo sapien
tcataagttgaaacctaatccccaaygcagtcttgagatgatgaggtcat

SEQ ID NO: 96881 - DNA, 50 bp, homo sapien
aattgtttgtaaatagtgatttcaamagtctaaaatattatgtacagctt

SEQ ID NO: 96882 - DNA, 50 bp, homo sapien
atattctagaaatcaaacacaaagamgtacacagtctgacgaagacatca

SEQ ID NO: 96883 - DNA, 50 bp, homo sapien
atggtggacgggaaaggggtcataargagtgcaattacagaaatcaagag

SEQ ID NO: 96884 - DNA, 50 bp, homo sapien
attaattgggttcatgacctaagcakggaaaaaatgccaatagttgtgcc

SEQ ID NO: 96885 - DNA, 50 bp, homo sapien
tatcaggtttgaaaacaaactaaacygtgtgctaaacattagttttttgg

SEQ ID NO: 96886 - DNA, 50 bp, homo sapien
gacaaaggagggttccatttaatacracatataggtactgatatgcaaat

SEQ ID NO: 96887 - DNA, 50 bp, homo sapien
gatattcacttttagaccagctatcrcaagttttataccaatagattaat

SEQ ID NO: 96888 - DNA, 50 bp, homo sapien
taaagcccagctatgaattggctgaygagacccaccaaagaactgtaaaa

SEQ ID NO: 96889 - DNA, 50 bp, homo sapien
acttgcatacgaatttgggatatcasctatcatgtcatcctcaagtggtg

SEQ ID NO: 96890 - DNA, 50 bp, homo sapien
aagacaatttcattacctaagggacmaaaaactgatttttaaaactgatg

SEQ ID NO: 96891 - DNA, 50 bp, homo sapien
ttgaaaagaacttattattgtgagcrgtaggtcttgaaagtggtcttaaa

SEQ ID NO: 96892 - DNA, 50 bp, homo sapien
tgagcccatacatgcaaatatttacratgagaaaaggttgctgtgaggta

SEQ ID NO: 96893 - DNA, 50 bp, homo sapien
gaactaaccaatgaggaaatccttaygtattgctccctggcatgcctcta

SEQ ID NO: 96894 - DNA, 50 bp, homo sapien
aactctaatgtatttttgtagtcacratttactttttaaaaatatacata

SEQ ID NO: 96895 - DNA, 50 bp, homo sapien
cgactttggacttgaaaatataagcracattttggagatggaaaaatcca

SEQ ID NO: 96896 - DNA, 50 bp, homo sapien
agatgtacgaagccttgtgaaatcasctttaactgtgtcatcatttatgc

SEQ ID NO: 96897 - DNA, 50 bp, homo sapien
tttctcttaacttcttggcacccgayatgttcctactccgtaactcccca

SEQ ID NO: 96898 - DNA, 50 bp, homo sapien
tgaaacagttactttgtttaaatcayaaggcattattggtgctcatctag

SEQ ID NO: 96899 - DNA, 50 bp, homo sapien
tttcccctgcctgtcattgtggtcaraaaccacgagctacacttgtttct

SEQ ID NO: 96900 - DNA, 50 bp, homo sapien
ggccaggatggaagtgaaatctcaaycaggggaaataagaggagcaacct

SEQ ID NO: 96901 - DNA, 50 bp, homo sapien
gcatataattttcaatacgtttagayattaggactaaagagagctttaat

SEQ ID NO: 96902 - DNA, 50 bp, homo sapien
aggcacatatgtcatttgatgttaarctttagtccttttttctgttcttc

SEQ ID NO: 96903 - DNA, 50 bp, homo sapien
atatttcactgaacttcttttgatascatagattttgaaatgttgtaaag

SEQ ID NO: 96904 - DNA, 50 bp, homo sapien
attttgaaatgttgtaaagctcttarcatagaacaaacaggtaagaacta

SEQ ID NO: 96905 - DNA, 50 bp, homo sapien
aggaaaacattatacctagagaattsaaggagagtggccatccatgagtg

SEQ ID NO: 96906 - DNA, 50 bp, homo sapien
ttgctagtcacatgtaagaaaaacargtattatgggccttcctaagacaa

SEQ ID NO: 96907 - DNA, 50 bp, homo sapien
gtgtctttcggatgttaatcttcaaygattccaacacacgtggtgttttc

SEQ ID NO: 96908 - DNA, 50 bp, homo sapien
gagagtacattttgagaattcgtggwaaataaatacatggagcagagaat

SEQ ID NO: 96909 - DNA, 50 bp, homo sapien
tggtgacaaagataagataggaaggmaccaggtaagcatgactaattttg

SEQ ID NO: 96910 - DNA, 50 bp, homo sapien
cgccagtgctgtattgtgcaactaayggaatggaaatgattttgaggatg

SEQ ID NO: 96911 - DNA, 50 bp, homo sapien
aacctgctagggaacttgactttacyggtaggcaatgaaccatcacttaa

SEQ ID NO: 96912 - DNA, 50 bp, homo sapien
gccagaatagtgaatgagattgctcraagagagaacatagggagattttt

SEQ ID NO: 96913 - DNA, 50 bp, homo sapien
aaaggaaaggattacacataaagcaktatcttttaatcctcagcctctag

SEQ ID NO: 96914 - DNA, 50 bp, homo sapien
tctctgaggattattgatgacaacarctatctattacatattgatttctg

SEQ ID NO: 96915 - DNA, 50 bp, homo sapien
cttgctgtgcaacgttattgggatgmccccttgaataagtctcaaaggtc

SEQ ID NO: 96916 - DNA, 50 bp, homo sapien
ctcccatagcagtgagacattacgaraaaacggtttctatggtgttcgtc

SEQ ID NO: 96917 - DNA, 50 bp, homo sapien
gctaagatgtctaaaaagctatattyctacatttcatttctgactctttt

SEQ ID NO: 96918 - DNA, 50 bp, homo sapien
atttcttttacttagcttgtcctacwctgatatttgtttgtcttactcac

SEQ ID NO: 96919 - DNA, 50 bp, homo sapien
aatatgtaaggttaggcttaactgaygtatcttattgttaaatattggtt

SEQ ID NO: 96920 - DNA, 50 bp, homo sapien
gctcaaggtgagagatgttagcactsagagaagcagacccgtggaaattg

SEQ ID NO: 96921 - DNA, 50 bp, homo sapien
aagagattaactaaggacttgatgtraatagaaaagagaagctgcctaag

SEQ ID NO: 96922 - DNA, 50 bp, homo sapien
actgcttcctgttaaccaaacctacmatatcatcactctaatggatgaat

SEQ ID NO: 96923 - DNA, 50 bp, homo sapien
ccttttggtagacttttggaaaaggwaaacactcataatttgctttcttc

SEQ ID NO: 96924 - DNA, 50 bp, homo sapien
tatatttttcctgtgtaggctaagcytctgtttggtattcccatgttagg

SEQ ID NO: 96925 - DNA, 50 bp, homo sapien
tatgacactctgaggtctgatagcaygataggaattaactccctactatg

SEQ ID NO: 96926 - DNA, 50 bp, homo sapien
actatgacaggaactttgctatgatwagagctgcaagtagttaaaggttg

SEQ ID NO: 96927 - DNA, 50 bp, homo sapien
agaggaatttacaaccctaggagtcrcacttcaactgtccagtaagcacc

SEQ ID NO: 96928 - DNA, 50 bp, homo sapien
tgaaagtttcttttttgattaaacartagcatgtacttgtttattacata

SEQ ID NO: 96929 - DNA, 50 bp, homo sapien
tagttttttcatcactcagaacaaayggtgatgatagcacagtgtagatg

SEQ ID NO: 96930 - DNA, 50 bp, homo sapien
atttcgaaactttgttgtattctcayattttcctgtgccattgaatagac

SEQ ID NO: 96931 - DNA, 50 bp, homo sapien
tggtgtgttttataaaaaactaggakatcttgaggtgaaataagtattaa

SEQ ID NO: 96932 - DNA, 50 bp, homo sapien
ttcactcttcagatattaaggaaagracagactagctacacagagttaac

SEQ ID NO: 96933 - DNA, 50 bp, homo sapien
accaagtagactgaatatgtgaacargaactataaatttcctttaatcag

SEQ ID NO: 96934 - DNA, 50 bp, homo sapien
tttgtttcaggggtatcaaccataartcttacaatgagtgagttaaaata

SEQ ID NO: 96935 - DNA, 50 bp, homo sapien
tttaaattctatattatttctgtgayggaaagttattgatcttatagcta

SEQ ID NO: 96936 - DNA, 50 bp, homo sapien
acaattcatgttatagaaaattggaraatcaaggaccttaatgtaaatcc

SEQ ID NO: 96937 - DNA, 50 bp, homo sapien
aaaatgatgtaaatattccattgtasaggaagacctgcaattatcatcca

SEQ ID NO: 96938 - DNA, 50 bp, homo sapien
agatcctacataaagacagtatttaratttcaaatgtagacttgcgaaat

SEQ ID NO: 96939 - DNA, 50 bp, homo sapien
tttgtgtagcaggaccataagcaaayagcacctgtgaaggaatgacattt

SEQ ID NO: 96940 - DNA, 50 bp, homo sapien
aaatgtgtatagctttctttatatcrctttttcaattcagctttccttgg

SEQ ID NO: 96941 - DNA, 50 bp, homo sapien
caggattcttgaaaacaaagatcackagaaagagttcaccacaaaccaca

SEQ ID NO: 96942 - DNA, 50 bp, homo sapien
caactgtttctagaacattttgccawatcttacgagaaaatacgtaaatg

SEQ ID NO: 96943 - DNA, 50 bp, homo sapien
tcttcagacattttttgtgtgtgtamgattatttttatcttgaaagatga

SEQ ID NO: 96944 - DNA, 50 bp, homo sapien
gagcatatacctcttacctcttaaaygatgtaattgaattttcaaggagc

SEQ ID NO: 96945 - DNA, 50 bp, homo sapien
ttcttatattttttggcataagtagkatgtttttacaaggtgagtaaaat

SEQ ID NO: 96946 - DNA, 50 bp, homo sapien
agttagtaataaatgcatcttcatawggaaaactgtgtttgtattacttg

SEQ ID NO: 96947 - DNA, 50 bp, homo sapien
caatccattgtccatgacttccaatmaataatttgtcttaaaataatgtt

SEQ ID NO: 96948 - DNA, 50 bp, homo sapien
ttgatttttcccaaagccatcttgtyaagtagtggaagtcatggacaatg

SEQ ID NO: 96949 - DNA, 50 bp, homo sapien
aacaaaagcaaaggccttatattctmaacctaaaattaatgctaaactat

SEQ ID NO: 96950 - DNA, 50 bp, homo sapien
ttgactctgacttcaagaatgtaaastgttcatacatacattcatttatt

SEQ ID NO: 96951 - DNA, 50 bp, homo sapien
atgatgtatagttagaaatgcctgaygaaggagttcctctatacacacac

SEQ ID NO: 96952 - DNA, 50 bp, homo sapien
gagacgttcttaggaaaggtgagtayagcagtgacatacagaatgcattg

SEQ ID NO: 96953 - DNA, 50 bp, homo sapien
acttcactcattctgatacctgcaamgtatccagacaagtgagaatgtac

SEQ ID NO: 96954 - DNA, 50 bp, homo sapien
tctgcttatattatctggacaactayccttttcaggaaagtgagagagtt

SEQ ID NO: 96955 - DNA, 50 bp, homo sapien
gtgtatacaagtcagttcctcagtaycatttcaacaagccttgtgtagtt

SEQ ID NO: 96956 - DNA, 50 bp, homo sapien
gagttcctggccccatctacccagcrattttgaggatagttacttttata

SEQ ID NO: 96957 - DNA, 50 bp, homo sapien
cacatgaacaggtgtgttttacccaytattacagcctcttatctcagtgg

SEQ ID NO: 96958 - DNA, 50 bp, homo sapien
tagataaatcactggcaagaataaasctatggaaaaaaataaagcacaaa

SEQ ID NO: 96959 - DNA, 50 bp, homo sapien
gacataaacatactcacatgcacaaytgatggcgtaagccaagctccatc

SEQ ID NO: 96960 - DNA, 50 bp, homo sapien
gatctcctttgattccaatatagaargagttcttaacactggatatctat

SEQ ID NO: 96961 - DNA, 50 bp, homo sapien
gaatctgcttcaccagagtggaccasaaaaataaaaaaccactccagctc

SEQ ID NO: 96962 - DNA, 50 bp, homo sapien
ggccacagatgatcatacacttgctkttgtctctgtgcatttctccaata

SEQ ID NO: 96963 - DNA, 50 bp, homo sapien
tatctctcaacttaatggtgtaaaayttagcgtcatatgaaataataagc

SEQ ID NO: 96964 - DNA, 50 bp, homo sapien
agttgagagataagcctaggtcatgraagaataaaatcaagcagactgag

SEQ ID NO: 96965 - DNA, 50 bp, homo sapien
gacgacttggtcatctggagttgaarcagtagcgtccatatagtattgag

SEQ ID NO: 96966 - DNA, 50 bp, homo sapien
gaaaacattgtgaaatactcccagamtgttctgtataaagcagacctagt

SEQ ID NO: 96967 - DNA, 50 bp, homo sapien
tcaccagagaacctaggttgtaattygtatcactgcattttcattctaaa

SEQ ID NO: 96968 - DNA, 50 bp, homo sapien
aagacctttttttagaggactcttakgaggattaattggaaaatattcac

SEQ ID NO: 96969 - DNA, 50 bp, homo sapien
gagctttctcctgattatatcccaargaggagatttctttcttcctttta

SEQ ID NO: 96970 - DNA, 50 bp, homo sapien
ctaggaatactttaccttcttaatakatctttatatgcagacacacatat

SEQ ID NO: 96971 - DNA, 50 bp, homo sapien
ctgccactcagttctctgtggagatkatagcaattcatgggactcagagt

SEQ ID NO: 96972 - DNA, 50 bp, homo sapien
gagagaaaaagttgctcagcttctaygtaccacgctcaaataaaaggaat

SEQ ID NO: 96973 - DNA, 50 bp, homo sapien
tcactctaaacttttcatcactgaawtcccttccccatgcttttaatgat

SEQ ID NO: 96974 - DNA, 50 bp, homo sapien
tgaattagcatttattagaaagagakaaaaagttgctcagcttctatgta

SEQ ID NO: 96975 - DNA, 50 bp, homo sapien
catatttgaataccagttgtcactargttagtagttagtattatggatct

SEQ ID NO: 96976 - DNA, 50 bp, homo sapien
tctcttatgggactgcgtaaaattakttttattttgagaggagaagtttt

SEQ ID NO: 96977 - DNA, 50 bp, homo sapien
tatgctatttgtattctccttttcartaactttccagatttgtaatgtgc

SEQ ID NO: 96978 - DNA, 50 bp, homo sapien
agaacaggagataagtctcaaatccwtttccttgacccactaaaatttgg

SEQ ID NO: 96979 - DNA, 50 bp, homo sapien
cagtatgacaataattcacagcatarataattaccatggcagcagagttg

SEQ ID NO: 96980 - DNA, 50 bp, homo sapien
gcacatttgcacctctgatgtttaargaaaccttgccgtcttgatgcttg

SEQ ID NO: 96981 - DNA, 50 bp, homo sapien
atccatacagaaatatgaagctaaartaggaagcacagctagataaggaa

SEQ ID NO: 96982 - DNA, 50 bp, homo sapien
tatcacttatatagagaatatgaaayaaagtgaaagacaattttctgcca

SEQ ID NO: 96983 - DNA, 50 bp, homo sapien
tgacagttgaaccagtgtggatgaaygaaagaaaagtcattaaatcaggt

SEQ ID NO: 96984 - DNA, 50 bp, homo sapien
atgaacgaaagaaaagtcattaaatsaggtaaagaggccaaaaatgagag

SEQ ID NO: 96985 - DNA, 50 bp, homo sapien
tctttttctggagacaaaaagtataycagttttatcagggcacaagaccc

SEQ ID NO: 96986 - DNA, 50 bp, homo sapien
aagttaagtggtgaggattttcaacrccctataagcattcaaagtattta

SEQ ID NO: 96987 - DNA, 50 bp, homo sapien
gtgtattctttacaaccatagtcaaygtaagaaaaaaatctacaaattgc

SEQ ID NO: 96988 - DNA, 50 bp, homo sapien
attcattgttaaaaggctttgggaaygtattagacaaggcagccagtggc

SEQ ID NO: 96989 - DNA, 50 bp, homo sapien
cgtaagaaaaaaatctacaaattgcycagggaaggtattttggctcatat

SEQ ID NO: 96990 - DNA, 50 bp, homo sapien
ttactaccataatagtaatttaccaycatctagttcttttgtgggcatcg

SEQ ID NO: 96991 - DNA, 50 bp, homo sapien
aagtgccagttacaaataacggaccrataaataactgtttaaatcaggtc

SEQ ID NO: 96992 - DNA, 50 bp, homo sapien
aattatttacagcacatttattctayggtctaaagaaatatatgcccccc

SEQ ID NO: 96993 - DNA, 50 bp, homo sapien
ggagagaaggatggaaggaggataartggagtgaagagataatgagagag

SEQ ID NO: 96994 - DNA, 50 bp, homo sapien
aaccgttttatttgctcatggttgtwctggagagcaatttgtcctgggct

SEQ ID NO: 96995 - DNA, 50 bp, homo sapien
cctacatggctcctaaacttcaaatsatggaaaccagttgcttaggaatg

SEQ ID NO: 96996 - DNA, 50 bp, homo sapien
ccctgttccttttgacattgtatcakggtactttaagtaactttttatct

SEQ ID NO: 96997 - DNA, 50 bp, homo sapien
ctatcaggacacaatgaaatatttasattctgggataacaatgtactaat

SEQ ID NO: 96998 - DNA, 50 bp, homo sapien
cactgtccagtgaagctatgagtatragaagagagtcactgtgctccagc

SEQ ID NO: 96999 - DNA, 50 bp, homo sapien
atgtcagagtagagagacaataagtyacatcctgaaggctaattgaagat

SEQ ID NO: 97000 - DNA, 50 bp, homo sapien
ttttatcttaacagcttttacatgartcatattagaacactccactttct

SEQ ID NO: 97001 - DNA, 50 bp, homo sapien
aaagccaatcctttttaaacattctraactgttcttttttctttgtattc

SEQ ID NO: 97002 - DNA, 50 bp, homo sapien
cataaggcatgattgtaccaaattawgtgctaagaacctcaaatacactt

SEQ ID NO: 97003 - DNA, 50 bp, homo sapien
tatatgtgaaaatattcaacagtatwaaaaggtatgattctagaattgta

SEQ ID NO: 97004 - DNA, 50 bp, homo sapien
cctcatgagggccagtagtgagcaaygaagaaggcgagaaagcagggatg

SEQ ID NO: 97005 - DNA, 50 bp, homo sapien
tctctgtatacatttattgctatcayaaacctccccaatattttcctgct

SEQ ID NO: 97006 - DNA, 50 bp, homo sapien
tttgcatgtgctcttactttattccyagcaatggagtagagactaacaca

SEQ ID NO: 97007 - DNA, 50 bp, homo sapien
gatggggatgccatcatttctgagaktcaattcagttatagcagaagaca

SEQ ID NO: 97008 - DNA, 50 bp, homo sapien
tatctcaatgtggacaaaatagataygcagctccaattaataaatgatga

SEQ ID NO: 97009 - DNA, 50 bp, homo sapien
aaagaatcagagatagggccagagaygaaaagatatgaaaccttccgtaa

SEQ ID NO: 97010 - DNA, 50 bp, homo sapien
attactttgattagcatctgcttaaytgatcaaagtaggaactagaaatg

SEQ ID NO: 97011 - DNA, 50 bp, homo sapien
acaaagacagagtacaacatctaagrcgaagagacagaaatatgaacagc

SEQ ID NO: 97012 - DNA, 50 bp, homo sapien
tggctttacattattatagacaccargtatagtgcttagcagataggtcc

SEQ ID NO: 97013 - DNA, 50 bp, homo sapien
ttaaatatttgaaatgcttctggaartgttaaattatcttcaggtgggca

SEQ ID NO: 97014 - DNA, 50 bp, homo sapien
tgagatgtatatttggactggtctaygtgtgataataaaatggaagagct

SEQ ID NO: 97015 - DNA, 50 bp, homo sapien
tagagaaaattaataaagctaaaatrtgtctcattccaaacatcaataaa

SEQ ID NO: 97016 - DNA, 50 bp, homo sapien
gtaaaatagaaaacagataaaccatrgagaaaattaataaagctaaaatg

SEQ ID NO: 97017 - DNA, 50 bp, homo sapien
atgattaagaaatggcaacttttgargagtcagctctgcatcaacctcaa

SEQ ID NO: 97018 - DNA, 50 bp, homo sapien
ctcctaccttatcagaccactagtamggtttgagcttgacaaacagtgtt

SEQ ID NO: 97019 - DNA, 50 bp, homo sapien
gagccagagaggaagaaattacacayccttgttccagaatacctcattat

SEQ ID NO: 97020 - DNA, 50 bp, homo sapien
tttagactgaactcaccatcaggtayaggaaaatggcaagtctagggtca

SEQ ID NO: 97021 - DNA, 50 bp, homo sapien
gttttgcctcccactggtgatcctgraagatggtaaaaatgaggtcttac

SEQ ID NO: 97022 - DNA, 50 bp, homo sapien
tgattacatttaacatgatgaagtgyactcccaccactattgggggattt

SEQ ID NO: 97023 - DNA, 50 bp, homo sapien
tttaagaattttttatcagaatatckaatggaaaggtagctcctgtaaaa

SEQ ID NO: 97024 - DNA, 50 bp, homo sapien
aaatacagaaaggatagcctaaaaargacttgaagtggccagcaagatat

SEQ ID NO: 97025 - DNA, 50 bp, homo sapien
gattcctcttcgaaatcacttctgcycttgtgtatgttctagtatatagc

SEQ ID NO: 97026 - DNA, 50 bp, homo sapien
tagttatattctattttatatccaarcaagtcaagctagaactgaaatat

SEQ ID NO: 97027 - DNA, 50 bp, homo sapien
gggtaattagtttatattttaagcakgcgagccattttgcaaactgatct

SEQ ID NO: 97028 - DNA, 50 bp, homo sapien
tttgattagccactgaggagatttaygtgcacttatgttttccaaattct

SEQ ID NO: 97029 - DNA, 50 bp, homo sapien
atacaataattataagacatcccagwaacattaagttgtgaaaaaacaca

SEQ ID NO: 97030 - DNA, 50 bp, homo sapien
actattacttttacttgatgaatgayggaaacaccatttctctagtgaat

SEQ ID NO: 97031 - DNA, 50 bp, homo sapien
aacatgtacttggccaatttttgaaygttgtaggaaggaatttattcttt

SEQ ID NO: 97032 - DNA, 50 bp, homo sapien
catcatttgcttttaacatttaacaytcaaggcagaaatataaggtagat

SEQ ID NO: 97033 - DNA, 50 bp, homo sapien
gaaaatttatttatatgaatttttaygacaatgtttactgagttttttaa

SEQ ID NO: 97034 - DNA, 50 bp, homo sapien
cccaaaaatcttgtatggcatctaawggtcaggtggcctatgagcttatg

SEQ ID NO: 97035 - DNA, 50 bp, homo sapien
ctgcctggttgatattgaacgtagcyagtacaatagtgatgcaaattaaa

SEQ ID NO: 97036 - DNA, 50 bp, homo sapien
atttgtgcacaatagctcttgtaaastccctgtctgccacttcctgtatc

SEQ ID NO: 97037 - DNA, 50 bp, homo sapien
gattaagaatggctttcctgccagaygtttaaaaatttctgtgcaaaaga

SEQ ID NO: 97038 - DNA, 50 bp, homo sapien
ttctctgatgtgtgactccttgaatyataggatgataaaacagactttct

SEQ ID NO: 97039 - DNA, 50 bp, homo sapien
tgacttttgacacaagatgatcggayatttgtgcggtggattttcaaagg

SEQ ID NO: 97040 - DNA, 50 bp, homo sapien
acgtgattgagccccaactgatatayactaactccaaaacatcatgctag

SEQ ID NO: 97041 - DNA, 50 bp, homo sapien
ttgtggttgcatcagccgtagtttcktcatttcatattgaatgtgcaggg

SEQ ID NO: 97042 - DNA, 50 bp, homo sapien
tttaaaacagtaactagaaatgtgayaatctccaacaaagtggatgtgga

SEQ ID NO: 97043 - DNA, 50 bp, homo sapien
gcagaactgcatttgtattggtaatsacttattcacacacaaaattaaag

SEQ ID NO: 97044 - DNA, 50 bp, homo sapien
ggtgtgccttctccatcaagcatcarcctttaggtactccatcatctact

SEQ ID NO: 97045 - DNA, 50 bp, homo sapien
caccatttaccagaatttctcccacrtgattaagctgttgtcatccactg

SEQ ID NO: 97046 - DNA, 50 bp, homo sapien
ttttacctctagtaattctactcatratatcccttcaaggtggtaaatat

SEQ ID NO: 97047 - DNA, 50 bp, homo sapien
agttcactttggaaaactagccattrattttagaaagagctttgtaatct

SEQ ID NO: 97048 - DNA, 50 bp, homo sapien
agtcaggaggattccagtaatacaamcttgtccaagctgatacactctca

SEQ ID NO: 97049 - DNA, 50 bp, homo sapien
aacaatgaatgcttaataaaactacmaccatagctggcttttgccattca

SEQ ID NO: 97050 - DNA, 50 bp, homo sapien
ggaaggatgcggttaccatggaactsaaaagacagcttccagaaagaaat

SEQ ID NO: 97051 - DNA, 50 bp, homo sapien
actctccttcagctggctttccaaaygcaagtcagcttctgccacttgta

SEQ ID NO: 97052 - DNA, 50 bp, homo sapien
gcatttgttagctactacttgcttcstggacttgccatttacattcttcc

SEQ ID NO: 97053 - DNA, 50 bp, homo sapien
gactaccatatcttgcttcaccttcygagaaatgctcgcccttaatagcc

SEQ ID NO: 97054 - DNA, 50 bp, homo sapien
aatcgttgaataatcaggagattatmagaaagaatcagaagaaacacatt

SEQ ID NO: 97055 - DNA, 50 bp, homo sapien
gaaactacatagctttctcataatayctactcatttggcggcagtcaaat

SEQ ID NO: 97056 - DNA, 50 bp, homo sapien
aagattggacacccctacctagagayataagataagagacctgggaaata

SEQ ID NO: 97057 - DNA, 50 bp, homo sapien
tttccccaaattacaaatttgaaacwattctaaccaaatccctgcagaca

SEQ ID NO: 97058 - DNA, 50 bp, homo sapien
ggcagcacataaaaaattaattcaaytccctaagtagacaatggttcaat

SEQ ID NO: 97059 - DNA, 50 bp, homo sapien
atacagcaataaaataaatgaattargttggttcctcactgttttttcct

SEQ ID NO: 97060 - DNA, 50 bp, homo sapien
tgaattggagctaagttactctatakaaaacatggaagacagattttaag

SEQ ID NO: 97061 - DNA, 50 bp, homo sapien
tttcaaggtacacagagaggtaaaartgttcataaaatgcaaataggccc

SEQ ID NO: 97062 - DNA, 50 bp, homo sapien
gaagtacaattattcacatatcagcyagagtggataaaacctccgtttga

SEQ ID NO: 97063 - DNA, 50 bp, homo sapien
ttcaatcagtgttagacatactgttyggatctgccaaagtctctctcact

SEQ ID NO: 97064 - DNA, 50 bp, homo sapien
aggagacactttcttttaataagtcmataaaacagtaagtggatttttcc

SEQ ID NO: 97065 - DNA, 50 bp, homo sapien
gataaatgcagatgtttaagggtcaytttgtaaattatccttctacaatg

SEQ ID NO: 97066 - DNA, 50 bp, homo sapien
taatgatagttttcaaacagggctcrcaattcagtaggggctagtaaaac

SEQ ID NO: 97067 - DNA, 50 bp, homo sapien
ctctctgctgctactacaataaactsaggtcaggtgctcattacctcctg

SEQ ID NO: 97068 - DNA, 50 bp, homo sapien
aaatgaatggacatgcattttttaasgcctcaagtggaaagaaccactat

SEQ ID NO: 97069 - DNA, 50 bp, homo sapien
gcttagtgttagggtaaatatctgayaatcaccgtgtaagggaagctgat

SEQ ID NO: 97070 - DNA, 50 bp, homo sapien
ataacacaacttgaggaagtcatagraacaactatatattgcactagttt

SEQ ID NO: 97071 - DNA, 50 bp, homo sapien
agtgcactgtaatagtttcctaagayatccttctagttctcctctccact

SEQ ID NO: 97072 - DNA, 50 bp, homo sapien
cctattcattaggggtccagttacayatatattaggtctcttgaaatacc

SEQ ID NO: 97073 - DNA, 50 bp, homo sapien
aggccagaagttcatgtcattcccgragcctatttgaatttgtcagtggt

SEQ ID NO: 97074 - DNA, 50 bp, homo sapien
cctcggaactcaaagttaggagatcraggccagaagttcatgtcattccc

SEQ ID NO: 97075 - DNA, 50 bp, homo sapien
ttaggagctgcagaggaaaagtcccrcgcagagaggaaaatccacacgaa

SEQ ID NO: 97076 - DNA, 50 bp, homo sapien
ggagagccaggccattgagcatgaamaataaggggactctagagctttgc

SEQ ID NO: 97077 - DNA, 50 bp, homo sapien
ctcagtaatccaaagaaaatggtaasatgactccaatgaaagaaagttta

SEQ ID NO: 97078 - DNA, 50 bp, homo sapien
gaaactataaaatgctggatagcacrcaatataaaagatgtgattaaact

SEQ ID NO: 97079 - DNA, 50 bp, homo sapien
tttattgttttaataatggtagaaamgtatatagagtataaaaaaatcaa

SEQ ID NO: 97080 - DNA, 50 bp, homo sapien
atccgtcaacctctggggagaaaacrggcatttaaatctcgatagtaaat

SEQ ID NO: 97081 - DNA, 50 bp, homo sapien
ttgcatagaaaagcatgtggaatcaygaacgcacaatgtccggctcttac

SEQ ID NO: 97082 - DNA, 50 bp, homo sapien
aataaaaacctgtcaagactgccaartatcttatgtccagaaaagcatgt

SEQ ID NO: 97083 - DNA, 50 bp, homo sapien
agcctgtgctccccaatctgtagcaygtaacttaaaaagcagatgatagt

SEQ ID NO: 97084 - DNA, 50 bp, homo sapien
gccagtgagtgagggatgaaaagaaytaaaggacataacatctcttcaat

SEQ ID NO: 97085 - DNA, 50 bp, homo sapien
aggaacgtggctgcggctgagcctaygagagactctagggaggtatgtga

SEQ ID NO: 97086 - DNA, 50 bp, homo sapien
atgtttcatctgctctaagactaaamatatcacccttgatagattggcag

SEQ ID NO: 97087 - DNA, 50 bp, homo sapien
acagctaggaaagatttctgattccraaaagtaagtaatacagtcaaaga

SEQ ID NO: 97088 - DNA, 50 bp, homo sapien
tgagagccaaatattgggaagaacayggattcatatgtgagaagtctctg

SEQ ID NO: 97089 - DNA, 50 bp, homo sapien
ggtaatacaaaagaagttgtttaaaycaccagagtactggattactcacc

SEQ ID NO: 97090 - DNA, 50 bp, homo sapien
cacacacaaaaaaaattcttctaaamgagtaatacaaaatagataggatc

SEQ ID NO: 97091 - DNA, 50 bp, homo sapien
agtttctcaaaatacaaactcagtargcataggcagatgtctatttttta

SEQ ID NO: 97092 - DNA, 50 bp, homo sapien
ccctgaggcgacatggtgtgtggtasgttttctattttagcacccctgct

SEQ ID NO: 97093 - DNA, 50 bp, homo sapien
cccagggtaaaaaggataccagaaaygaggctactgtggaatcccaggat

SEQ ID NO: 97094 - DNA, 50 bp, homo sapien
ggaccagctttgcattttatgtgacrgaggaggtactgatttccatgaag

SEQ ID NO: 97095 - DNA, 50 bp, homo sapien
agatccaagtccttgattagattcakataatttttgtcttttgggtacat

SEQ ID NO: 97096 - DNA, 50 bp, homo sapien
acgggccttcataagatcacacagcratagaaaggtggctcctcacccac

SEQ ID NO: 97097 - DNA, 50 bp, homo sapien
agataatcaaaagccagaacaaacartgtcctaagtgaaatgaaagatca

SEQ ID NO: 97098 - DNA, 50 bp, homo sapien
ctaactctcgtaagagcataagatcrtttttcagtagttccttgggtcag

SEQ ID NO: 97099 - DNA, 50 bp, homo sapien
ggtagatgagatgacgtttagaagtkgtccatgtataacaaaagccctct

SEQ ID NO: 97100 - DNA, 50 bp, homo sapien
ctttcccagacaggtccataatataytcaacaagtggcagatcctttgct

SEQ ID NO: 97101 - DNA, 50 bp, homo sapien
ccaggtgtaaaacaaagtcagtccaraggagaaacacatagttagaatgg

SEQ ID NO: 97102 - DNA, 50 bp, homo sapien
gtatttgtgatccactagatgaaatyataagggaatactagacagaaaag

SEQ ID NO: 97103 - DNA, 50 bp, homo sapien
cccaaggctcctagcttctgtgttaycatttgtgacttttccattaagaa

SEQ ID NO: 97104 - DNA, 50 bp, homo sapien
ttcttcaatctgacctaagcctcacyatgatgtttctgaaaccactgaaa

SEQ ID NO: 97105 - DNA, 50 bp, homo sapien
aagttttttaccagcatctacacttmaaaagaatagctaaagaaagttta

SEQ ID NO: 97106 - DNA, 50 bp, homo sapien
ccattgagaaaacctgaaaatatggmaaatagtctaattagttgatttgt

SEQ ID NO: 97107 - DNA, 50 bp, homo sapien
gaagagaaacaatttgacagaacaaygaaatgcatgctaaataatgattt

SEQ ID NO: 97108 - DNA, 50 bp, homo sapien
ggtaatggattgtttcacaagtaaaktcctaagtgttcagctatttcagc

SEQ ID NO: 97109 - DNA, 50 bp, homo sapien
tgagcacaggacaccaagcaactacwatgacctggccatgatggcatttc

SEQ ID NO: 97110 - DNA, 50 bp, homo sapien
gagagctacttccccgcgtgactaamgtgtgcctagggcagaaggcagag

SEQ ID NO: 97111 - DNA, 50 bp, homo sapien
gagaagaaaagctgatgacgcatgaragaggagagaattacgggggttca

SEQ ID NO: 97112 - DNA, 50 bp, homo sapien
aattatttaaatttttcagtattaamataggctggaaattaaatccttta

SEQ ID NO: 97113 - DNA, 50 bp, homo sapien
accctgagactacttagttcagagtygctctttgaccatctattcctctc

SEQ ID NO: 97114 - DNA, 50 bp, homo sapien
tattgtcctaagcccgtttcaccagkataattgagcagctatggctgggc

SEQ ID NO: 97115 - DNA, 50 bp, homo sapien
cttgatcctttaggctcttacattawctatgtgactacaaactagcatca

SEQ ID NO: 97116 - DNA, 50 bp, homo sapien
tgaaatcagttttgctttagagacarcataagtaggtcacctgttttacc

SEQ ID NO: 97117 - DNA, 50 bp, homo sapien
tctaaagcaaaactgatttcacatgragtagatcccatcccctcttattg

SEQ ID NO: 97118 - DNA, 50 bp, homo sapien
cttgatatctccccacttccagcatraatctgagtctcagagccacagtg

SEQ ID NO: 97119 - DNA, 50 bp, homo sapien
aatgctgtgtgtgtgttaactgaacyaactaggaggaaaatgtaaggaag

SEQ ID NO: 97120 - DNA, 50 bp, homo sapien
acattttattttttagtaaatatcaytggttctcccctttaaatatatta

SEQ ID NO: 97121 - DNA, 50 bp, homo sapien
tatgaggacccacaattcttagaaasagcgtgaggtaacttcctttaaat

SEQ ID NO: 97122 - DNA, 50 bp, homo sapien
aagaccaaattcatcacaagggaatraaaatatttgtcaatatgaaaggg

SEQ ID NO: 97123 - DNA, 50 bp, homo sapien
agtatcaaaagtcttactcaaaatcycattttttatttttaattatttgt

SEQ ID NO: 97124 - DNA, 50 bp, homo sapien
tgtgcttttaattgatgcatttaacygtaagaaaaatgaactatatgttc

SEQ ID NO: 97125 - DNA, 50 bp, homo sapien
catgtctccttcattatggttctacraatttcaacaacttggtatgtaga

SEQ ID NO: 97126 - DNA, 50 bp, homo sapien
cttaccctcaaagtgatttgaagccrgagagtaaacatgttgcttcttcc

SEQ ID NO: 97127 - DNA, 50 bp, homo sapien
gaatccaattacgataccattattaygaatacattttccttttattaaat

SEQ ID NO: 97128 - DNA, 50 bp, homo sapien
gaaatgagagaaatgacatcactacrgagtcttcaggtgtttaaattata

SEQ ID NO: 97129 - DNA, 50 bp, homo sapien
atgtaagaaacacagtgcaagaacaygaatgggaaagcagctagacctct

SEQ ID NO: 97130 - DNA, 50 bp, homo sapien
catatcagttgaccgagtttcagaayggagaaaagtagaaaacgtaattc

SEQ ID NO: 97131 - DNA, 50 bp, homo sapien
gtagttcaggaaatatcaccacctamgaaaggcatgtattttttagcaga

SEQ ID NO: 97132 - DNA, 50 bp, homo sapien
gaaacacagcaggccagttttctaaygatgtttttcaaaatcacaatttc

SEQ ID NO: 97133 - DNA, 50 bp, homo sapien
ctgtcggagaaagtatttaggtcacygtccaaaatacttcttaggagctg

SEQ ID NO: 97134 - DNA, 50 bp, homo sapien
catgcccaatctaatacctgatgacstaatctttttattgcttgtggttc

SEQ ID NO: 97135 - DNA, 50 bp, homo sapien
tcagtctgcctggttatggcttttgrcaacatcagccagaggaaatttgt

SEQ ID NO: 97136 - DNA, 32 bp, homo sapien
agagatcttcaactgayaccaaagtcctttgg

SEQ ID NO: 97137 - DNA, 50 bp, homo sapien
ccacatctagaaaagttgcaaaatgyagcccttccttgtaaatggagcct

SEQ ID NO: 97138 - DNA, 50 bp, homo sapien
ccttaagttaatatctgtcactacayaataactcacgataaataaatgtg

SEQ ID NO: 97139 - DNA, 50 bp, homo sapien
gcatatttgaagtgcaatcaaaataygaccatgacagtaagcacacgaaa

SEQ ID NO: 97140 - DNA, 50 bp, homo sapien
ttgccacacggggaaagtccattcaytaagagcctgtgaggtgtgatgtt

SEQ ID NO: 97141 - DNA, 50 bp, homo sapien
attttgtccatgtttttgctagtgayggtttatacagtagccagaaggcg

SEQ ID NO: 97142 - DNA, 50 bp, homo sapien
cacctaagtgtcaaagcataaagaamaagtagcacattggatgaaactct

SEQ ID NO: 97143 - DNA, 50 bp, homo sapien
ctgaactcatttgcatttgtttacaytctaacacatttacttttgtgaga

SEQ ID NO: 97144 - DNA, 50 bp, homo sapien
cccagtgcctcagaatgggaccttayatttacagaactaatcaagttaaa

SEQ ID NO: 97145 - DNA, 50 bp, homo sapien
gctgactggaaatcaagtcaattgcrccaagaaaagtctttctggggaat

SEQ ID NO: 97146 - DNA, 50 bp, homo sapien
acaggagtctgacaattacaggcttrtttttagagacaggtgatatgtgt

SEQ ID NO: 97147 - DNA, 50 bp, homo sapien
agctgaagactgagatctctttctaytgtggatgaaggaagatactgtgt

SEQ ID NO: 97148 - DNA, 32 bp, homo sapien
tggcacgcagagattargaagtgactgtccat

SEQ ID NO: 97149 - DNA, 50 bp, homo sapien
tcagcactgacatagactatcaccaygaaagctctactggacagtctggt

SEQ ID NO: 97150 - DNA, 50 bp, homo sapien
taattaacaaggttatggtgcctaartcatttggtcaaatacgagtctag

SEQ ID NO: 97151 - DNA, 50 bp, homo sapien
aataaagacatctgataacatgacakctaaggctccttctaggtataaaa

SEQ ID NO: 97152 - DNA, 50 bp, homo sapien
gtacttctgttaattttcacctttartcaacagcatacattgatgataga

SEQ ID NO: 97153 - DNA, 50 bp, homo sapien
gggctgggctttgtgctcgtggagaygctggtggtttgtagagagagaag

SEQ ID NO: 97154 - DNA, 50 bp, homo sapien
tcaggatgtggtcaggtctccttacyggcaagtgtttgtagcaagatttg

SEQ ID NO: 97155 - DNA, 50 bp, homo sapien
ttgctagaaaggttcttaaattggcrcaccattgtggagcatcagagtta

SEQ ID NO: 97156 - DNA, 50 bp, homo sapien
gacttctccaaaattaacttaaatcracattcagctagtcagtatacaat

SEQ ID NO: 97157 - DNA, 50 bp, homo sapien
ataccgagccattgaataacagtgartaagtaaagaagcaaaggattgat

SEQ ID NO: 97158 - DNA, 50 bp, homo sapien
agtgatgatctgcctgagatgctcaygtaataacctagaacattcctggg

SEQ ID NO: 97159 - DNA, 50 bp, homo sapien
aaatgaaataagtcacatgtctgaamctctcgtacccagctctggtcaca

SEQ ID NO: 97160 - DNA, 50 bp, homo sapien
tgagagcatttacgtggaatcctcaycttatcctaggagacaggagacct

SEQ ID NO: 97161 - DNA, 50 bp, homo sapien
caatcatttccttgcttttctttagkaatacatgcttgggtgacaaaatg

SEQ ID NO: 97162 - DNA, 50 bp, homo sapien
tgaggtgaaagtcacatctataaaaygctgaactcttaaatctaaccagg

SEQ ID NO: 97163 - DNA, 50 bp, homo sapien
aatctattgagtctgattgaatgcarctaactattcaattctacaatatt

SEQ ID NO: 97164 - DNA, 50 bp, homo sapien
catggcaaccagaccactccatagaragaattccagtgcaggagagttgt

SEQ ID NO: 97165 - DNA, 32 bp, homo sapien
tccccaggtctgatttractcacctttctccc

SEQ ID NO: 97166 - DNA, 50 bp, homo sapien
aagctgccttaccctgcttgtaaagractgttgccgtaaaggacaaatga

SEQ ID NO: 97167 - DNA, 50 bp, homo sapien
agctatctagaaccattctataaatyagccttttatttgccagccataca

SEQ ID NO: 97168 - DNA, 50 bp, homo sapien
ttgtaatttaactgagcctttactcraatacatctgttaatgatagagcc

SEQ ID NO: 97169 - DNA, 50 bp, homo sapien
tcctttctaaattttttccaaaacgygtaaatcatctattgataagatca

SEQ ID NO: 97170 - DNA, 50 bp, homo sapien
tgctgacaatgtctaaccatggctgyttttaaggcattatttgccgtcat

SEQ ID NO: 97171 - DNA, 50 bp, homo sapien
taatatcatctaggtgtgtctcagtygaatggccaaatcattaatagtag

SEQ ID NO: 97172 - DNA, 50 bp, homo sapien
ggtagcaatgtcagggtgcaattacmacctctaggactggggagacaaag

SEQ ID NO: 97173 - DNA, 50 bp, homo sapien
gcagaggagcgaagtgtgacttagayagcagagtgaaaatgtgtggtcaa

SEQ ID NO: 97174 - DNA, 50 bp, homo sapien
atgggtcaggtactggagtagacacmctaacacataaattgacactgtaa

SEQ ID NO: 97175 - DNA, 50 bp, homo sapien
gagggatgcaggtagattcttagctsggccataagccccccactctagcg

SEQ ID NO: 97176 - DNA, 50 bp, homo sapien
ttattgatgtaatccatattcatacytatagcccactttacttacttaaa

SEQ ID NO: 97177 - DNA, 50 bp, homo sapien
tatatctaatactcccaaaaggactyacaacttgaaaatagaaaacttag

SEQ ID NO: 97178 - DNA, 50 bp, homo sapien
tcttatttgcatatgctaaaaacacygcaatatttaacatggtacaactg

SEQ ID NO: 97179 - DNA, 50 bp, homo sapien
gtgatgtgccattccaaacccgataygcaggacatggggaatgcacccct

SEQ ID NO: 97180 - DNA, 50 bp, homo sapien
agacacagatttgtaacccaaagaartccataaatcacagagggaggaaa

SEQ ID NO: 97181 - DNA, 50 bp, homo sapien
tgcaatccaaagactgcaccagtgckacttgaaggggtaagagagctaaa

SEQ ID NO: 97182 - DNA, 50 bp, homo sapien
acaaattggaaacaaatgagtccaarttaactgattatacaaatatacat

SEQ ID NO: 97183 - DNA, 50 bp, homo sapien
tagatcccgtgacctcttctattcaygcacttcaggaacagctattggcc

SEQ ID NO: 97184 - DNA, 50 bp, homo sapien
aaatgtaacaaaatgactaatatggractaacataaaaaacactttagtc

SEQ ID NO: 97185 - DNA, 50 bp, homo sapien
tttggacatggaaatttagagatcgratagcttactcactcagatgttca

SEQ ID NO: 97186 - DNA, 50 bp, homo sapien
tatgataaggatgacttgagtggatrtaacctgtgagcctcacataacaa

SEQ ID NO: 97187 - DNA, 50 bp, homo sapien
cccttccagtcctgtacttcttaaartattactatgcaaagtttttctaa

SEQ ID NO: 97188 - DNA, 50 bp, homo sapien
cctgtgatcatctcgtggtgcggggycatcttcccttctaaatgagcccc

SEQ ID NO: 97189 - DNA, 50 bp, homo sapien
aaagaaacatttttgattgaactggraactaattcttatttgaatctgtt

SEQ ID NO: 97190 - DNA, 50 bp, homo sapien
gaatgccctaatgtgtaagcagattrtcatcatcagaatgaaagatgtac

SEQ ID NO: 97191 - DNA, 50 bp, homo sapien
agcttcagcctccgtaaagaggtccyagttcagagtaattatcattagta

SEQ ID NO: 97192 - DNA, 50 bp, homo sapien
gctaagtatacaccttattcttccayaaaatattttcacataactacctt

SEQ ID NO: 97193 - DNA, 50 bp, homo sapien
tgctgaataagcgttaattatgatcyaggcatgttctagcaatcctgaca

SEQ ID NO: 97194 - DNA, 50 bp, homo sapien
tgatggcctgctggcaaggctggackaagaaaagcttatggtctccttcc

SEQ ID NO: 97195 - DNA, 50 bp, homo sapien
tttaagagctgccggtctaaggcaaygctgctttgttaggaaaagttgat

SEQ ID NO: 97196 - DNA, 50 bp, homo sapien
ctgtgcttccacctgcgtttgaaacmagaatatatttctgccacagtctg

SEQ ID NO: 97197 - DNA, 50 bp, homo sapien
aaattccctctttttgtaagaatacsagtcttatcagattaagacccatt

SEQ ID NO: 97198 - DNA, 50 bp, homo sapien
ccttagtgagtctccaggctcagaaytaatagtgacatttcttttcaaca

SEQ ID NO: 97199 - DNA, 50 bp, homo sapien
cacgcctcatgctatgttccgtaaayacgttctcagagtaacactgaata

SEQ ID NO: 97200 - DNA, 50 bp, homo sapien
tcatgaaagcttattaagctgattaygcaataggcttaacatgcactatc

SEQ ID NO: 97201 - DNA, 50 bp, homo sapien
atattaacttggtatccagatcatakcccagaaaacagactgacttttct

SEQ ID NO: 97202 - DNA, 50 bp, homo sapien
aaaaatctctaaaagcaatgacttaraaaatgacaagactctagatatca

SEQ ID NO: 97203 - DNA, 50 bp, homo sapien
tacaaatactttggaatgaggctaasatgtgtatctgcttaagttcccca

SEQ ID NO: 97204 - DNA, 50 bp, homo sapien
tagtgtcaaaagtgttatacccttasgcaatttaatagggccggaatttg

SEQ ID NO: 97205 - DNA, 50 bp, homo sapien
ggaggagacaagcaataactacatamaatgagcacaataattgaagtgat

SEQ ID NO: 97206 - DNA, 50 bp, homo sapien
tgaactttttctgtaaatctgctggygggattaaagtattagatagagta

SEQ ID NO: 97207 - DNA, 50 bp, homo sapien
ggaagctccccatttgtgtttttcasggtcttttagatgacaagtctaga

SEQ ID NO: 97208 - DNA, 50 bp, homo sapien
cacatttcacttaacacgctaacaaygtaaacggctcaacagccccaaaa

SEQ ID NO: 97209 - DNA, 50 bp, homo sapien
gcaagagggatggagactggctcccrctatgtaaaggctgatctaccttt

SEQ ID NO: 97210 - DNA, 50 bp, homo sapien
taaaagactcatataaatgctaagaytctcaacataacaattcatctctg

SEQ ID NO: 97211 - DNA, 50 bp, homo sapien
tcctgttttgaagccattacagaaaygtgtttagcactgctgtgtatgca

SEQ ID NO: 97212 - DNA, 50 bp, homo sapien
atacagaagagagagcggcttcccarcttattttgtaaagctgagagtgc

SEQ ID NO: 97213 - DNA, 50 bp, homo sapien
tgaaaatcaattaatgtaattcaccractgacgcggaatggtctgtctac

SEQ ID NO: 97214 - DNA, 50 bp, homo sapien
ggctgtgagtgtcatggagctagtgsagtagacagaccattccgcgtcag

SEQ ID NO: 97215 - DNA, 50 bp, homo sapien
gctgctggtcagcaggcgatctccaytctctcattatagccagtgagtcc

SEQ ID NO: 97216 - DNA, 50 bp, homo sapien
ccaggagaatacaagtggatggaaakaataacaaagaggaggagaaagac

SEQ ID NO: 97217 - DNA, 50 bp, homo sapien
gaccaggaccaacatcgatttctaamgtcctgcagctcccgaccacagac

SEQ ID NO: 97218 - DNA, 50 bp, homo sapien
agttcttaccttctgaatggcaataygtagccttttggaaacaaagcact

SEQ ID NO: 97219 - DNA, 50 bp, homo sapien
cttatataacaaccaaaccaggaccrcagaaataaaaattgtgtgaagga

SEQ ID NO: 97220 - DNA, 50 bp, homo sapien
atagaaactccagaaataaactcacrtatacggaaatgtattaagtgcaa

SEQ ID NO: 97221 - DNA, 50 bp, homo sapien
gcacgactaaatcctaaacacatackatgaggcaaagagaaatatccagt

SEQ ID NO: 97222 - DNA, 50 bp, homo sapien
catagaaaatactataataataatgygtatgaagcgatttctgaagaaat

SEQ ID NO: 97223 - DNA, 50 bp, homo sapien
ttaaactatgctgtccaatcacaccrtattgtttctgatgtatagaaagt

SEQ ID NO: 97224 - DNA, 50 bp, homo sapien
gcaaataagtcaatttcgggaaaaaygtagcctactgcaaaggtctaagc

SEQ ID NO: 97225 - DNA, 50 bp, homo sapien
aacagttttcattaacaaaagttaayatacagaactcctacaacagaaag

SEQ ID NO: 97226 - DNA, 50 bp, homo sapien
gaagtttttgacaaaacaagcctgawgatataaagcaaaagacagaaata

SEQ ID NO: 97227 - DNA, 50 bp, homo sapien
gtgccatatgcagcttttattccaaygaagttaaacctgagaaagaggcc

SEQ ID NO: 97228 - DNA, 50 bp, homo sapien
ggtttgagcacaggtatttacaccarcgagcaactctataggaggaacgt

SEQ ID NO: 97229 - DNA, 50 bp, homo sapien
aagtttctgcttttctgatcaaaggkatagccaagagcagagaagcctca

SEQ ID NO: 97230 - DNA, 50 bp, homo sapien
tcagagaagtgtgcacgtttctacaytgctggacagctcaatgctcatgt

SEQ ID NO: 97231 - DNA, 50 bp, homo sapien
tatgtctgatcaaattcactacaacrgattttttcacttccagatttaca

SEQ ID NO: 97232 - DNA, 50 bp, homo sapien
tttgtcattatttcctactgctgtcmattagactgtgcattccttggaag

SEQ ID NO: 97233 - DNA, 50 bp, homo sapien
tgagatcaaagtccatcatgtatgcmgacagcgttaattttgaagaaagc

SEQ ID NO: 97234 - DNA, 50 bp, homo sapien
tctgacctgacagactttgggcacaygcaacttttcaaagcctcagtttc

SEQ ID NO: 97235 - DNA, 50 bp, homo sapien
acacctcctggatgctcttaagtcaygttaattcctttgactcctcgtgg

SEQ ID NO: 97236 - DNA, 50 bp, homo sapien
tctaacaataaacgccaatgccaaamatatgctctcaaagggagatggca

SEQ ID NO: 97237 - DNA, 50 bp, homo sapien
cctgaccaggaaagaagctgttacawcgtcacttgataagcactgagggg

SEQ ID NO: 97238 - DNA, 50 bp, homo sapien
cctgcctgccacgctgtggttattcrcctttctatgtgttcatgctttgg

SEQ ID NO: 97239 - DNA, 50 bp, homo sapien
cgtatcctatacctttgtggttctgkatttcctagatgatttatatcata

SEQ ID NO: 97240 - DNA, 50 bp, homo sapien
cgggtctgcagctataagaacctaaycgtagaagatcagctcctccgtgg

SEQ ID NO: 97241 - DNA, 50 bp, homo sapien
cagctgtagggacctcaaattagaaygtcacctcctcccagagtcttcag

SEQ ID NO: 97242 - DNA, 50 bp, homo sapien
tagaaattaggacatcttaacagctwaaatgtgagctagaagataaactg

SEQ ID NO: 97243 - DNA, 50 bp, homo sapien
acccctgaatctaaaatgaaagtcgmaattattcaaaaaaagaaaagaaa

SEQ ID NO: 97244 - DNA, 50 bp, homo sapien
ttactgaagatctaaaaattcttackctgtctaatagtatgatctcaaag

SEQ ID NO: 97245 - DNA, 50 bp, homo sapien
tgaaaccccgtctctactaaaaatcygaaacaattagccagatgtggtgg

SEQ ID NO: 97246 - DNA, 50 bp, homo sapien
cacggcttccaaagcacctgcctgasagaataataaacatgcacacgcgg

SEQ ID NO: 97247 - DNA, 50 bp, homo sapien
agaacggacacaagggcattaaacartatcaaaactacattccacgtatt

SEQ ID NO: 97248 - DNA, 50 bp, homo sapien
tctcctaaattgtactcactaagaaraggaatccatagatcatttgacca

SEQ ID NO: 97249 - DNA, 50 bp, homo sapien
tctgagggtgaagaaagtaaagacaytgattaactttaggacttacgttt

SEQ ID NO: 97250 - DNA, 50 bp, homo sapien
agatgttgatgttaatgtcaagatarataaatatagattctgttgtcaat

SEQ ID NO: 97251 - DNA, 50 bp, homo sapien
tctttcattaattttccataatttcyagcctttattacctcacacactgc

SEQ ID NO: 97252 - DNA, 50 bp, homo sapien
gttattaagattaaatgagttcataygtgaaagagccaaaacagtctcta

SEQ ID NO: 97253 - DNA, 50 bp, homo sapien
agtcgtaaatgttataatacttaaayctgtctgttgccccttaaatgtag

SEQ ID NO: 97254 - DNA, 50 bp, homo sapien
atgcaaagctgccaataattgcacartgctacgaggaagctgatattcct

SEQ ID NO: 97255 - DNA, 50 bp, homo sapien
atatggctgatataggaagcctgagragtaaacagatttaccagcagtag

SEQ ID NO: 97256 - DNA, 50 bp, homo sapien
cccagaatggggtgtcacaaaccacyggagaagctctgggtgctaaagcc

SEQ ID NO: 97257 - DNA, 50 bp, homo sapien
gctcctcagcacagagaaaataaaaygagttagacgacgttaaagcaacc

SEQ ID NO: 97258 - DNA, 50 bp, homo sapien
taaagatctgaaagaaatggcataaycttaaaacttggtaagtttttgtg

SEQ ID NO: 97259 - DNA, 50 bp, homo sapien
actgtggtttcatattcctgtctgaygatccatgaagaaagtggggagga

SEQ ID NO: 97260 - DNA, 50 bp, homo sapien
cttagtggttaacctacatagactgmaacttgcttaaataatccagtatt

SEQ ID NO: 97261 - DNA, 50 bp, homo sapien
aaggagaagtgtcctgataatagacrctaccggcattttagcacagagtg

SEQ ID NO: 97262 - DNA, 50 bp, homo sapien
agttcagaatttccatttgggatgaytaaaaagttttggaaatactaatg

SEQ ID NO: 97263 - DNA, 50 bp, homo sapien
ggctgttcaaagctagctctgacaaytctcttgtgaccaatgcccctgca

SEQ ID NO: 97264 - DNA, 50 bp, homo sapien
agtgcaggaggagatgttatggagasaacagaatgtgatctttgtgggag

SEQ ID NO: 97265 - DNA, 50 bp, homo sapien
gcttcttagatggactatgaatcacygagtgtgtctcactacatttggtg

SEQ ID NO: 97266 - DNA, 50 bp, homo sapien
tttatttcattgaaggttcatgaatratgtcattaaatatttgcttcact

SEQ ID NO: 97267 - DNA, 50 bp, homo sapien
aaaactgaccaggttcagtaaattcyataagctcctgaatacatttcaca

SEQ ID NO: 97268 - DNA, 50 bp, homo sapien
tgaactgagtgggtcaactaccacaytgtggacatgttctagaatgttac

SEQ ID NO: 97269 - DNA, 50 bp, homo sapien
taaagaaaaagctaaattctactgaytttttcctacccttacagctttag

SEQ ID NO: 97270 - DNA, 50 bp, homo sapien
accatagttcttccctccgtcttctsagaacatctcacacagatctccca

SEQ ID NO: 97271 - DNA, 50 bp, homo sapien
agctgtcaggaaagacatgtaaggaragatctaagctaaaactcaaacca

SEQ ID NO: 97272 - DNA, 50 bp, homo sapien
cttttgaagaaacacattctactcartaccttcccccatggattggcaca

SEQ ID NO: 97273 - DNA, 50 bp, homo sapien
gataatttcagatggcacctttttaygcatgaagagagaaaaatctgggg

SEQ ID NO: 97274 - DNA, 50 bp, homo sapien
tataaatcactttatttaattctcamacaatgctatggggtagcagctac

SEQ ID NO: 97275 - DNA, 50 bp, homo sapien
caaatcttcctgtgaatagtaattayggcattggctacaggaaaatatga

SEQ ID NO: 97276 - DNA, 50 bp, homo sapien
ttgctcagttgacatcagttttatgyacaaggagagtctggtttacttag

SEQ ID NO: 97277 - DNA, 50 bp, homo sapien
ctaaagatgagaaattgtattcattkgttttcattgttagttcagcagct

SEQ ID NO: 97278 - DNA, 50 bp, homo sapien
agcaatgtaaattattttgagagagycctattccacttagcaatcaaaga

SEQ ID NO: 97279 - DNA, 50 bp, homo sapien
acatgcagggccacagggtagtcccragtgttcgtccaagatagggaaga

SEQ ID NO: 97280 - DNA, 50 bp, homo sapien
aaagaaaaaaaaaaagccattcgtcrgacagtgtcaataggccagtgagt

SEQ ID NO: 97281 - DNA, 50 bp, homo sapien
aggtggcatgggctgtaaagcagaaktattaatttgaccctctagagaaa

SEQ ID NO: 97282 - DNA, 50 bp, homo sapien
gcagctgatctggttgcccctgagayacggaacctgcaaacttacacgga

SEQ ID NO: 97283 - DNA, 50 bp, homo sapien
aattggtttaggtcagtttagaaaaygtatccatcattattctccagacg

SEQ ID NO: 97284 - DNA, 50 bp, homo sapien
agtgtgaaattaaagctatccaagayatgggtattggtgaaaatatttta

SEQ ID NO: 97285 - DNA, 50 bp, homo sapien
gttataactagcttcttagtgtgaarttaaagctatccaagatatgggta

SEQ ID NO: 97286 - DNA, 50 bp, homo sapien
actcaacacaacttgctcctcaagtyggcattccttcttgtattcttcta

SEQ ID NO: 97287 - DNA, 50 bp, homo sapien
ctgctgcctcaggtcatccaaccctktaagccagcaggtgaagaagcaga

SEQ ID NO: 97288 - DNA, 50 bp, homo sapien
gaagcaaagcttagttaacttgaagwcaacaatagaaactacccaaatta

SEQ ID NO: 97289 - DNA, 50 bp, homo sapien
ggtcttcaagtattatgtttttaaargtgttatcaacttaaaagtatggg

SEQ ID NO: 97290 - DNA, 50 bp, homo sapien
ccgtacattgggtgacttctgacatsatgggaatttgcaacactaaacaa

SEQ ID NO: 97291 - DNA, 50 bp, homo sapien
tgagttacctgacagacttccaaaasatcccctgtgaggttggatcagga

SEQ ID NO: 97292 - DNA, 50 bp, homo sapien
tcccatcatgtcagaagtcacccaawgtacggaatctatacttttagaga

SEQ ID NO: 97293 - DNA, 50 bp, homo sapien
aagaaaaggaggatcagaggtcttaygaatcagaaagctgtccgatactg

SEQ ID NO: 97294 - DNA, 50 bp, homo sapien
taagacacagttccttaaagagcgayggttacttgggtttttgcaatcaa

SEQ ID NO: 97295 - DNA, 50 bp, homo sapien
tacttacagttttccaaatggctcayggttggagtctgttttctttcagt

SEQ ID NO: 97296 - DNA, 50 bp, homo sapien
tttaatggcacgagagatatttaccraagggattctttattaaatgttct

SEQ ID NO: 97297 - DNA, 50 bp, homo sapien
atctagaaataattccacatatttaycaagaacatttaataaagaatccc

SEQ ID NO: 97298 - DNA, 50 bp, homo sapien
aggtctagaacatgaccttgagaatragaaggcttaaagctggaatcagt

SEQ ID NO: 97299 - DNA, 50 bp, homo sapien
ccaactagagcaagaactgaagacakatcgataaataagttatagcaatt

SEQ ID NO: 97300 - DNA, 50 bp, homo sapien
cgtgccttctctcccgaatgctatgragttctacagtgtgccagcatctg

SEQ ID NO: 97301 - DNA, 50 bp, homo sapien
gtatatttgagtttaaaaatttgaamgcagaaagagaaagtgatctctgg

SEQ ID NO: 97302 - DNA, 50 bp, homo sapien
ttgacagggctgcttgattagctcaytaagttgtaaatgttctctccact

SEQ ID NO: 97303 - DNA, 50 bp, homo sapien
aaggcatttctagataccagttgcamacaaggatgacatctctaatattt

SEQ ID NO: 97304 - DNA, 50 bp, homo sapien
ttagatgtgtttttgtagtaagaacmaacaaagaaggtcaagctcaagta

SEQ ID NO: 97305 - DNA, 50 bp, homo sapien
cagagttatgttatggatttacatawctttgttttcaaaatttctaaatc

SEQ ID NO: 97306 - DNA, 50 bp, homo sapien
agagtttatgttatcattagtataawtaccttcatattaattcttgcaaa

SEQ ID NO: 97307 - DNA, 50 bp, homo sapien
cttatccagctatttcacacgtttcyaattaacaaaccatgttaaaattt

SEQ ID NO: 97308 - DNA, 50 bp, homo sapien
agacacaaagaatgatcttcaacagscctcattttgatcttgatttcttt

SEQ ID NO: 97309 - DNA, 50 bp, homo sapien
gattttaaaggtccttaacccgtcaygctgaatctatttgtctatttggt

SEQ ID NO: 97310 - DNA, 50 bp, homo sapien
aaaactagctggtaaagcagcccacratggttttttcggttgaggttttt

SEQ ID NO: 97311 - DNA, 50 bp, homo sapien
ttaagtttacaataatatagccttaraatcaatatagtaccttggatctg

SEQ ID NO: 97312 - DNA, 50 bp, homo sapien
gttagacatagttcctttggttccckctttttgcttctgcttatacttct

SEQ ID NO: 97313 - DNA, 50 bp, homo sapien
actaatgacctgtcttttaacaggastatacaaatccagtcagcctccca

SEQ ID NO: 97314 - DNA, 50 bp, homo sapien
tgcaaaatgggattaagaataatacrtaccacatgcttggctaagcttct

SEQ ID NO: 97315 - DNA, 50 bp, homo sapien
cttcttcaccattgtgagcacaaatkaatataacctccaggtaatgggaa

SEQ ID NO: 97316 - DNA, 50 bp, homo sapien
gatgagctcaggaataaaacagatarctaaggataagtcattttcatcca

SEQ ID NO: 97317 - DNA, 50 bp, homo sapien
tacaaatctatttcccttcctcttaygtgcatgccccaattccgtaatga

SEQ ID NO: 97318 - DNA, 50 bp, homo sapien
tgaaacttctttacatgagttataayaggcatgtggctagaaactagaca

SEQ ID NO: 97319 - DNA, 50 bp, homo sapien
tggatcgggtaaaaggaggatcagargagtcacaaaatctaaggagcttg

SEQ ID NO: 97320 - DNA, 50 bp, homo sapien
gttcaaggtcatgggccaaggtctartttttcacacatacaaaaattgca

SEQ ID NO: 97321 - DNA, 50 bp, homo sapien
gcagtggtcatttagtaaaatgatgraccagttagaaccaatcagaggca

SEQ ID NO: 97322 - DNA, 50 bp, homo sapien
agttgtatcaacagacttaaagacartatggacaagggataaaggacaaa

SEQ ID NO: 97323 - DNA, 50 bp, homo sapien
agtagcttaggattttgaccaggtayagcctcatttgtgtttgtcatgga

SEQ ID NO: 97324 - DNA, 50 bp, homo sapien
ccaggtagtggggccagtaagtccayaggccatagggaatgtgtctgctt

SEQ ID NO: 97325 - DNA, 50 bp, homo sapien
gaagaacccatataccagtggagtaygcccaacatccagctcagactctc

SEQ ID NO: 97326 - DNA, 50 bp, homo sapien
tttatgtaattcatagctcaataaartggactaaaaaaaacctagtctag

SEQ ID NO: 97327 - DNA, 50 bp, homo sapien
tacgttgttatatgacctatggccarcggagcaaggtagcatgtacggtg

SEQ ID NO: 97328 - DNA, 50 bp, homo sapien
agttctggaacacctcaagaaagcaygaacctgagcgtactactgcgcag

SEQ ID NO: 97329 - DNA, 50 bp, homo sapien
agcatacctgtcctctatgctatgayaaatatgcctggaatctagaaaag

SEQ ID NO: 97330 - DNA, 50 bp, homo sapien
gaacaccaggtctcacttctatctaygtctgtatctgtacccattaatca

SEQ ID NO: 97331 - DNA, 50 bp, homo sapien
cattggccctctggcctctacctttycaagtgtatggctctttctcattc

SEQ ID NO: 97332 - DNA, 50 bp, homo sapien
tatcagcactcagcatttttcaaagrcctgatggatataaatacttcaca

SEQ ID NO: 97333 - DNA, 50 bp, homo sapien
tgggccttcccttctctctcggcagrtgtttactttgattttttatagtg

SEQ ID NO: 97334 - DNA, 50 bp, homo sapien
gttgtcagaacagacaatcccggtasagttctcggagcgtcttggcccat

SEQ ID NO: 97335 - DNA, 50 bp, homo sapien
gtggtaaataattcagcaaattacayctcttgccctgtctagtctacaag

SEQ ID NO: 97336 - DNA, 50 bp, homo sapien
ttagctatgactgtattgttaccatsaaacattatgaacagggaaacagc

SEQ ID NO: 97337 - DNA, 50 bp, homo sapien
tattagtatatactatatattctacmaaaaaaggacagtctatgttcctt

SEQ ID NO: 97338 - DNA, 50 bp, homo sapien
ctattttgctaagtcttctcacatayggaattttctgccaaaaaatgaga

SEQ ID NO: 97339 - DNA, 50 bp, homo sapien
caaattctggcttaaactgactaaayttacctgggtctccatgcaatgtt

SEQ ID NO: 97340 - DNA, 50 bp, homo sapien
gaaggaaagagaaaatgaggaatgaygttggtagtaagaacctatgtaac

SEQ ID NO: 97341 - DNA, 50 bp, homo sapien
agcgagaattgttttcacaaacaacygaccaagcccatgactccagcttg

SEQ ID NO: 97342 - DNA, 50 bp, homo sapien
ctctagaagatagatgtaaagcttcrttttttttcctcagaatttttgaa

SEQ ID NO: 97343 - DNA, 50 bp, homo sapien
ggacaagtatgagcacctaaatgaamggagggaagtggagctgtgatgat

SEQ ID NO: 97344 - DNA, 50 bp, homo sapien
cacgagaagtatcaactgtccaaacsaaaaacatcaggagtcattcttaa

SEQ ID NO: 97345 - DNA, 50 bp, homo sapien
ccctgtggccaggacatgttgctacrctgagaaggacagcattgggccag

SEQ ID NO: 97346 - DNA, 50 bp, homo sapien
caaaaactccagtgtcttcttttcarcaaaggccacgagaagtatcaact

SEQ ID NO: 97347 - DNA, 50 bp, homo sapien
ttagttggactcttagagaaaaaaarcagagatttctacgtatcttacta

SEQ ID NO: 97348 - DNA, 50 bp, homo sapien
atacaagctactaccttttactgtaycagaagttgtaattaaatacatat

SEQ ID NO: 97349 - DNA, 50 bp, homo sapien
tgaatgcttgttattatcccagagarctgagaaaatgtttactggtcttt

SEQ ID NO: 97350 - DNA, 50 bp, homo sapien
aatctgtttttattatattcaaacayacagagagagacaatcaatatgta

SEQ ID NO: 97351 - DNA, 50 bp, homo sapien
atggtgtctcccttgggagtttcagkaacatagtctttgcgggaagtaaa

SEQ ID NO: 97352 - DNA, 50 bp, homo sapien
gtcattaagcagtcctgtcttataayagtgtaacaggttgtaaatggatg

SEQ ID NO: 97353 - DNA, 50 bp, homo sapien
ttacccaggtggctcactctctcatyaaacactttttgttactattttta

SEQ ID NO: 97354 - DNA, 50 bp, homo sapien
atctcctcttctcattttactcgcawctaagactcctctgtgggaaagaa

SEQ ID NO: 97355 - DNA, 50 bp, homo sapien
aggaaaggcaggaggttcatacatayactcagggagacagagtaggagtt

SEQ ID NO: 97356 - DNA, 50 bp, homo sapien
gacatatgacccatgcagctatcaaygttcaatagatacagagttgagat

SEQ ID NO: 97357 - DNA, 50 bp, homo sapien
aggaagacccaggcattcgatttcaygattaacttaaaccggagtgtgac

SEQ ID NO: 97358 - DNA, 50 bp, homo sapien
ggtatgagttacacaataaatgtgcraaagttaattttctatttactaac

SEQ ID NO: 97359 - DNA, 50 bp, homo sapien
atcacattatgttgttatatatgaaygagcaattgttagtaaatagaaaa

SEQ ID NO: 97360 - DNA, 50 bp, homo sapien
tataaagcatgcctgccatagctacmgaggttttgcagtctctctataaa

SEQ ID NO: 97361 - DNA, 50 bp, homo sapien
ttcagttgtgttcaatgagcccttgycaaattgtatcattttgagcacat

SEQ ID NO: 97362 - DNA, 50 bp, homo sapien
tgtgctatccagcccagatattcctyacctatggtttttgtaactgcaga

SEQ ID NO: 97363 - DNA, 50 bp, homo sapien
cctgtgttttgcagtggtgttaaatsagtctcctggcctccagatgttct

SEQ ID NO: 97364 - DNA, 50 bp, homo sapien
agctgctgctgtgtgagagctgcttsagaactgtgtgtcatgttctgggc

SEQ ID NO: 97365 - DNA, 50 bp, homo sapien
gcatgatacattacttagtaacagtsactattatgtctttatctttcatg

SEQ ID NO: 97366 - DNA, 50 bp, homo sapien
gagagaaccaaatgttcaatggtaaytagaatgcgtcacaagtagttgct

SEQ ID NO: 97367 - DNA, 50 bp, homo sapien
tgtctctgtgttgaatctcctcttcyttttcttataaggacacaggtcat

SEQ ID NO: 97368 - DNA, 50 bp, homo sapien
atcaaaattaatttatggtaagagakacttttctaacaatatgaaagact

SEQ ID NO: 97369 - DNA, 50 bp, homo sapien
taaatgtgtgattaggctcacaaaamgataaggaaaaacctcaaaagaag

SEQ ID NO: 97370 - DNA, 50 bp, homo sapien
gtggccattaccaccttcatggagamctaagatcaaggaaacgcgggtgt

SEQ ID NO: 97371 - DNA, 50 bp, homo sapien
cttaatcttcacaataaccctaaaargcatttactactattatcatttta

SEQ ID NO: 97372 - DNA, 50 bp, homo sapien
aagttcctgtgttcataacatttacrctatgaagattggatttggaggaa

SEQ ID NO: 97373 - DNA, 50 bp, homo sapien
tagtgtatgttacttttcttcccatracttgtgatagtgttttgttttgt

SEQ ID NO: 97374 - DNA, 50 bp, homo sapien
ctgcaatttcctctgttaagatgagscaggtttctttctgtctttcagga

SEQ ID NO: 97375 - DNA, 50 bp, homo sapien
cctgaaatgataggattagagccaakatgttatagtttcataaatttgct

SEQ ID NO: 97376 - DNA, 50 bp, homo sapien
aagggctggcccagaagaaagcgtcrcaggttatgtatgggcctcagcgg

SEQ ID NO: 97377 - DNA, 50 bp, homo sapien
cgacatacacatgcatatatatgcawgatttattatttagttatcacaga

SEQ ID NO: 97378 - DNA, 50 bp, homo sapien
tatgatctttttttatttttgaaatyatgtaaggtccagggcagatgata

SEQ ID NO: 97379 - DNA, 50 bp, homo sapien
cttaatttgaccaatttaccacaaasgaatagagacacttctgcatgaac

SEQ ID NO: 97380 - DNA, 50 bp, homo sapien
ctttgtacatttatttatttatttayggctgtcccttggtatccccagag

SEQ ID NO: 97381 - DNA, 50 bp, homo sapien
ttctattggttatgtcgactctaacyagtaacacgttattggaaagggaa

SEQ ID NO: 97382 - DNA, 50 bp, homo sapien
tctaatgcttgaaaggtgtacaaaasaatagaaaagtgggccaattacac

SEQ ID NO: 97383 - DNA, 50 bp, homo sapien
ctccaaaataaagtaactgcaacgaratacaacttgcgcacaaccttagg

SEQ ID NO: 97384 - DNA, 50 bp, homo sapien
aaaaggaatagtcatttctaaagtayggtgccattagtgttaatttgatc

SEQ ID NO: 97385 - DNA, 50 bp, homo sapien
cacataagaatgtatattttggtccygaaagaaaacaaagaaatcaattt

SEQ ID NO: 97386 - DNA, 50 bp, homo sapien
tgcaaacatctaaggagagtcttggratacttactcagaatagatggtga

SEQ ID NO: 97387 - DNA, 50 bp, homo sapien
cacccagaataaaatctggcatttckcccattattcccattccaccactc

SEQ ID NO: 97388 - DNA, 50 bp, homo sapien
aggcttagccagaacctgacaatgtracactattctgtctttagacaatt

SEQ ID NO: 97389 - DNA, 50 bp, homo sapien
tgtacaaataaacacgcataaaaccygaagtagaaatattcaatacctgg

SEQ ID NO: 97390 - DNA, 50 bp, homo sapien
attggtacaatatccactgcctagargaaagcttgagaaactggacagag

SEQ ID NO: 97391 - DNA, 50 bp, homo sapien
aatgatgcccttgtctatggtcacaragataagataatttctcagcatcc

SEQ ID NO: 97392 - DNA, 50 bp, homo sapien
aataataaaggcatttaaatttaaamctcactagcacttcttcttaatca

SEQ ID NO: 97393 - DNA, 50 bp, homo sapien
acccagcaatcccactcctatgtctrtatctaagagaaagaaaatatctg

SEQ ID NO: 97394 - DNA, 50 bp, homo sapien
ggtgtgagttcggctcaatattctamaccttgttacatcacacagattta

SEQ ID NO: 97395 - DNA, 50 bp, homo sapien
agcaggcaaatccttatttatggaaygttttcttcagaatattcctgatg

SEQ ID NO: 97396 - DNA, 50 bp, homo sapien
acaaaataacttgggaagaagacaastagcagcaggtctaacttgggtgt

SEQ ID NO: 97397 - DNA, 50 bp, homo sapien
caaatgtctctcagacacctcggggratgaccaaataacattggagatcc

SEQ ID NO: 97398 - DNA, 50 bp, homo sapien
ttatttctttaggcttattattccgratggtcacatcttactcctgaaat

SEQ ID NO: 97399 - DNA, 50 bp, homo sapien
ggggcatttcacaggctctgaatgayaagacgagatgtagtcattaagat

SEQ ID NO: 97400 - DNA, 50 bp, homo sapien
aatgattcttatatgaagtttctggyaagctgctatgtgatactatgtac

SEQ ID NO: 97401 - DNA, 50 bp, homo sapien
agggaataccagggccttggataccyagaatgagatcaagaaagtcaggt

SEQ ID NO: 97402 - DNA, 50 bp, homo sapien
actgtaacctatttagcatacttagratttgtccagttatccgcttaata

SEQ ID NO: 97403 - DNA, 50 bp, homo sapien
tttaatttgaagttgtgaggattggmatagaatatgggcatctgtgccaa

SEQ ID NO: 97404 - DNA, 50 bp, homo sapien
aaaacagtcccacatctatcctaaaycatcaggcactttcagatttcttc

SEQ ID NO: 97405 - DNA, 50 bp, homo sapien
ttcacatgttagtataacactgtgaygtattggcattttaattgagaggt

SEQ ID NO: 97406 - DNA, 50 bp, homo sapien
aaaaggcgcatagtctatggactagraagtactgggatgtttcacatgaa

SEQ ID NO: 97407 - DNA, 50 bp, homo sapien
ccaatatggaaagatttcaacccaasatgtcataaactaaatatgaatga

SEQ ID NO: 97408 - DNA, 50 bp, homo sapien
ctctcttctttatttgctgtaaattyctttcagggtcatgccagctagcc

SEQ ID NO: 97409 - DNA, 50 bp, homo sapien
cgtaactatatacatgtttttgtatwaccattccctgtaggatatatttg

SEQ ID NO: 97410 - DNA, 50 bp, homo sapien
gctttcactgtttttcttcagactakgtggttccccaataagactttctt

SEQ ID NO: 97411 - DNA, 50 bp, homo sapien
attaatgttaaaaagcacaacacagkattagcacataaaaaggagaaaca

SEQ ID NO: 97412 - DNA, 50 bp, homo sapien
ctacctagctacgattctcaatttayggatagcgttcactggggagggag

SEQ ID NO: 97413 - DNA, 50 bp, homo sapien
gctgttaactccttcagcctcctaastgggtcatatattcttgggggtgg

SEQ ID NO: 97414 - DNA, 50 bp, homo sapien
atagtccctttctgaaatttgtcgtmgtctggaactattttgggtttgaa

SEQ ID NO: 97415 - DNA, 50 bp, homo sapien
ttttaaaatcatggtaatatagacaygagaaccacctggatttcctccct

SEQ ID NO: 97416 - DNA, 50 bp, homo sapien
aatttgctgtattaacaatactaacmaagaataccagcccatctatatca

SEQ ID NO: 97417 - DNA, 50 bp, homo sapien
gccccatttgagaagtttttaattaygccatttctttcttaattcctttg

SEQ ID NO: 97418 - DNA, 50 bp, homo sapien
cctcagccttcacatccacccgcatragtgtgcaccaataagcaatgttc

SEQ ID NO: 97419 - DNA, 50 bp, homo sapien
cctgtctttattgaaaaatttgataycttgctcctcatggattgttttcc

SEQ ID NO: 97420 - DNA, 50 bp, homo sapien
atttccatgtttgacatcttctaaaygccactgttgcttctgcttcagtt

SEQ ID NO: 97421 - DNA, 50 bp, homo sapien
cagtaccagttatttcttagactaaygctagtgcttcttgctattttttt

SEQ ID NO: 97422 - DNA, 50 bp, homo sapien
gaaaaataaaatcctcattggacaayaattagtatcagcaagttttgagt

SEQ ID NO: 97423 - DNA, 50 bp, homo sapien
cataaatggacatgtaatttattccraagctggtactgcagtgttgtaaa

SEQ ID NO: 97424 - DNA, 50 bp, homo sapien
aaatcaaaaactagaagcagattccratgaatttcacaaaattaaacatg

SEQ ID NO: 97425 - DNA, 50 bp, homo sapien
tttacctggaattcttgttgatgacrgtctccaggcccactgcagacctc

SEQ ID NO: 97426 - DNA, 50 bp, homo sapien
agaccaaagtactttcaagagttctraattcttacttatactttttagag

SEQ ID NO: 97427 - DNA, 50 bp, homo sapien
caggaggagagccctaaatacagcaragtggttcccaggctttatgacta

SEQ ID NO: 97428 - DNA, 50 bp, homo sapien
tcatgcctgggaagtcaatctttgcrctcagggttgaaatttatctttca

SEQ ID NO: 97429 - DNA, 50 bp, homo sapien
attttcataagaaaagcactgtttckaattttaatctacaaacaactcat

SEQ ID NO: 97430 - DNA, 50 bp, homo sapien
cagagtcacttgtatgagaagatccraaacatgtggacgatggtgtgcat

SEQ ID NO: 97431 - DNA, 50 bp, homo sapien
tcatggctactttcccatatacatayttttttctgttgcacttttcataa

SEQ ID NO: 97432 - DNA, 50 bp, homo sapien
aacatatctagattctactgaaatayggcagaacatcccttcataaattt

SEQ ID NO: 97433 - DNA, 50 bp, homo sapien
gcttaaaaagaatcaagtctctgccmaagacagaaagagccagctctttg

SEQ ID NO: 97434 - DNA, 50 bp, homo sapien
ctcaatactcatgacttaccattgcyatttaattcagcatccctgaaggt

SEQ ID NO: 97435 - DNA, 50 bp, homo sapien
gaatatcattggctaagagcatagamgtgggatagccaagctaaaggagc

SEQ ID NO: 97436 - DNA, 50 bp, homo sapien
accttggaaagtaaaggagagacccrgcttctatctgtgacacttggagg

SEQ ID NO: 97437 - DNA, 50 bp, homo sapien
atatttgatctatcatttagctctcraactgataagaaatgtgcccaaat

SEQ ID NO: 97438 - DNA, 50 bp, homo sapien
cctttaaactctttaactctgtaaayggtaatataacaacaataataaca

SEQ ID NO: 97439 - DNA, 50 bp, homo sapien
agaacttatatatagatctatgagasagaatgagagagcacctgatgcgt

SEQ ID NO: 97440 - DNA, 50 bp, homo sapien
atataaaaatacttatctcaaagggyttttgtgagcactacagaacttat

SEQ ID NO: 97441 - DNA, 50 bp, homo sapien
ccttcagttctacttccctcttggakattcataaggtacaactttagcag

SEQ ID NO: 97442 - DNA, 50 bp, homo sapien
actataaattagaggacaactaaaaygcacagtgctaaatgtacatttaa

SEQ ID NO: 97443 - DNA, 50 bp, homo sapien
atccagccagtgacatcaactcgtayatatagtttcactgtcacaatctc

SEQ ID NO: 97444 - DNA, 50 bp, homo sapien
tttttccacctaacatatgattagcraacacattagtcctctattttcac

SEQ ID NO: 97445 - DNA, 50 bp, homo sapien
agtggagtaatgggatggagaagaaygttatatactgctgggaagtattt

SEQ ID NO: 97446 - DNA, 50 bp, homo sapien
atctcttttacttccttacaatttayctggattttgagaattgcattctc

SEQ ID NO: 97447 - DNA, 50 bp, homo sapien
ttttcacagttgactcaagataaaayttcctgttgactaaaagatacagg

SEQ ID NO: 97448 - DNA, 50 bp, homo sapien
ccgaggacctggacggactcttaagmtgcagtggcgaaagcagtgggaca

SEQ ID NO: 97449 - DNA, 50 bp, homo sapien
cctcagtgatgtgaagaacgtaactraagaatataatgtaaaaagaacat

SEQ ID NO: 97450 - DNA, 50 bp, homo sapien
tggcctctcttctcacaccccagaartggatttggactttcccacaagct

SEQ ID NO: 97451 - DNA, 50 bp, homo sapien
aaaaagatttaagcgcaaagtaaaamtgctacactcaagaaaaacaagac

SEQ ID NO: 97452 - DNA, 50 bp, homo sapien
acatcagccatgataatcaggttagyaatgttttaaggatgagttagaat

SEQ ID NO: 97453 - DNA, 50 bp, homo sapien
aaagaaagaaaaactggattcacaartattaaggattttactgaaatgcc

SEQ ID NO: 97454 - DNA, 50 bp, homo sapien
agaagataagcagttttgtcatacaytaactgaaattctcttaatatatt

SEQ ID NO: 97455 - DNA, 50 bp, homo sapien
ggacctaattcaaaatgaagacaaaygctttacacacacacacacacaca

SEQ ID NO: 97456 - DNA, 50 bp, homo sapien
gatatcattgggagacagttaaatcrcaaaatacactagatatcattagg

SEQ ID NO: 97457 - DNA, 50 bp, homo sapien
ttctagaattagctcttccataaacratgtctggccttgggcaactgagt

SEQ ID NO: 97458 - DNA, 50 bp, homo sapien
gagtagatggcaaggaatatacagcratagacatttggcattaaaattca

SEQ ID NO: 97459 - DNA, 50 bp, homo sapien
ggaaatagggagatagacagctatayggagaatcagcaagagggtggcca

SEQ ID NO: 97460 - DNA, 50 bp, homo sapien
ccctttactaattacatatatataawcctttgatttgtaatagtttttct

SEQ ID NO: 97461 - DNA, 50 bp, homo sapien
tatagcgaatgaaaaacaaggactgragtttatggtatattgaaggaatg

SEQ ID NO: 97462 - DNA, 50 bp, homo sapien
tgaagtacatgcacaatgaggagacrcaatttaataaaaagagatatata

SEQ ID NO: 97463 - DNA, 50 bp, homo sapien
gatttaaataaaagacagtgactgaktaactaaaataaatggaaccaggt

SEQ ID NO: 97464 - DNA, 50 bp, homo sapien
aagattttagtatttgcaggccatayggtttccggcacaactactcaact

SEQ ID NO: 97465 - DNA, 50 bp, homo sapien
aaccctgtaattttcagcaaaatgaytacataaagagctacctataattt

SEQ ID NO: 97466 - DNA, 50 bp, homo sapien
tctcataaagatgtgcaaacggttaygcaatggttgtttgggaagaattc

SEQ ID NO: 97467 - DNA, 50 bp, homo sapien
aggtgattgcacagcttgtattagaygtaactgagttagagaccctgttt

SEQ ID NO: 97468 - DNA, 50 bp, homo sapien
gggcattggagtgttccaaacagaakattatttgctgggcattttaaaca

SEQ ID NO: 97469 - DNA, 50 bp, homo sapien
ctctaaatcatttaagagctttaaaytcaagggaaattctccttatttac

SEQ ID NO: 97470 - DNA, 50 bp, homo sapien
tagaatcaacttttcttgctgggtasaaataaatcaaaaacagacacttc

SEQ ID NO: 97471 - DNA, 50 bp, homo sapien
ttcgaatcttctaccaggattgtacwcagtcacccatccacgttctctgg

SEQ ID NO: 97472 - DNA, 50 bp, homo sapien
cccaagggaagcaggttctgacttaygttgttggaaaatgacccatgagt

SEQ ID NO: 97473 - DNA, 50 bp, homo sapien
tatctgttttcacttttcaagtaaawccctacatggtgatcataaaaaca

SEQ ID NO: 97474 - DNA, 50 bp, homo sapien
gacagtaaggctagaatctgtatcaygaaggaaacatacttaatgacatt

SEQ ID NO: 97475 - DNA, 50 bp, homo sapien
agaacacacgacatgaaattaggaaygacagtaaggctagaatctgtatc

SEQ ID NO: 97476 - DNA, 50 bp, homo sapien
tgtatttcaaagtgaacctacataarctgttgcaaaaatttagagcaagt

SEQ ID NO: 97477 - DNA, 50 bp, homo sapien
catatttcagtatttctgataattayatgtatggcttaaacatttttttc

SEQ ID NO: 97478 - DNA, 50 bp, homo sapien
tgagccttaattaactgaaactggartcataaacttggcttcatttaagg

SEQ ID NO: 97479 - DNA, 50 bp, homo sapien
aaggacttgacagcattggaagttaygggattcatgctactcacagtgta

SEQ ID NO: 97480 - DNA, 50 bp, homo sapien
ttatctataaattctatccagtaacraccaaatatatatcccagccactt

SEQ ID NO: 97481 - DNA, 32 bp, homo sapien
tttgtcctagatctgayaacccatgtagaatt

SEQ ID NO: 97482 - DNA, 50 bp, homo sapien
agacagcaagggccattgtccttgasagccactctaaatgctttcatcta

SEQ ID NO: 97483 - DNA, 50 bp, homo sapien
actgtcctttgttcatatgcacagaygaattaatggagctattttaccaa

SEQ ID NO: 97484 - DNA, 50 bp, homo sapien
ggcattgttctcttaagtttggacawgtatttgagtataagcagtgacat

SEQ ID NO: 97485 - DNA, 50 bp, homo sapien
ccccttttcctgtcttattcttctcyattgcactgtcatttggccacgat

SEQ ID NO: 97486 - DNA, 50 bp, homo sapien
gaaatgacatgtctgctgcatacgaygtattctcgtttgaaaataaaaac

SEQ ID NO: 97487 - DNA, 50 bp, homo sapien
gctaaatgtaagtattggatgcttaygtaatttttagttaattacatggc

SEQ ID NO: 97488 - DNA, 50 bp, homo sapien
gagtttcataattagtcaaaataaarttgaaccatattaattctacatgg

SEQ ID NO: 97489 - DNA, 50 bp, homo sapien
taaaattatagatcattgttttaagrccatcttatgtaaatagcaaaggt

SEQ ID NO: 97490 - DNA, 50 bp, homo sapien
taggacatgagggcagagttatcagraatgggattaacccccttataaaa

SEQ ID NO: 97491 - DNA, 50 bp, homo sapien
tatttcatttttaaggcaccataaaygactctaatgaatcaccccaggtg

SEQ ID NO: 97492 - DNA, 50 bp, homo sapien
acaagtatattaaatataagtctccrctgaaataattgggcaaataaagc

SEQ ID NO: 97493 - DNA, 50 bp, homo sapien
gctgcattctgttattgtatcccctmacttgaagcaagatattctctaaa

SEQ ID NO: 97494 - DNA, 50 bp, homo sapien
ctgggctgtgacagaaatggagaaayggctggaagatcacagcaccggga

SEQ ID NO: 97495 - DNA, 50 bp, homo sapien
gaaaagatttggtgaaacataattcygaaaacaaatttgcaagcgaggga

SEQ ID NO: 97496 - DNA, 50 bp, homo sapien
tccgggaagctcgccttccttcagaytcgtgtttttgatttgcttattta

SEQ ID NO: 97497 - DNA, 50 bp, homo sapien
tattttaaaggtgaaatctaatgccrcataatatttaactttgctaaaat

SEQ ID NO: 97498 - DNA, 50 bp, homo sapien
taattcacggagtgatctttcatgaygttagggtggtaacacactctagg

SEQ ID NO: 97499 - DNA, 50 bp, homo sapien
atacatacagttgggatcatatagtktgtaacctttgcagactggcttat

SEQ ID NO: 97500 - DNA, 50 bp, homo sapien
tcttcagctgttcagggaggattaamaagcactggtctaaaatgaaaaca

SEQ ID NO: 97501 - DNA, 50 bp, homo sapien
gcagtgtcaggatgcagtcaatacaraacaataacaacaagaaaaccaca

SEQ ID NO: 97502 - DNA, 50 bp, homo sapien
ctaggaaggaacatttaagacgacamaaaatctgacgtaaaggttactcc

SEQ ID NO: 97503 - DNA, 50 bp, homo sapien
ctcaaacaatcagccggcttcctacyggtaacattagagcattcactttc

SEQ ID NO: 97504 - DNA, 50 bp, homo sapien
tcaaaatgatcagtgatcaaacaacmcagtataaagagccagatgaatag

SEQ ID NO: 97505 - DNA, 50 bp, homo sapien
tgccagcacagcctgagaaggaataygagacaactccaataaagttagaa

SEQ ID NO: 97506 - DNA, 50 bp, homo sapien
tgagaagcctaacatgtattagatayggtttcagatgtggtcctgctcgg

SEQ ID NO: 97507 - DNA, 50 bp, homo sapien
tcttatgctaatgttttaacatttcraacaagtggtcctagatctcattc

SEQ ID NO: 97508 - DNA, 50 bp, homo sapien
aagctatactgcaatggtccctttamcacattcgtctcctaagcagagaa

SEQ ID NO: 97509 - DNA, 50 bp, homo sapien
aaaaagacaggatggtcaaccccttsaagagacagacgtgtttctggtta

SEQ ID NO: 97510 - DNA, 50 bp, homo sapien
tccattatcctcactgcttttcaaayggttcttcccttctttggaaatcc

SEQ ID NO: 97511 - DNA, 50 bp, homo sapien
aatatatattttaacattcagccagraagatcatgatgaggggtagaagg

SEQ ID NO: 97512 - DNA, 50 bp, homo sapien
ccaaagtgcagaacactaaatcttcrctttaacaagcctcattatatgga

SEQ ID NO: 97513 - DNA, 50 bp, homo sapien
aaattttactaaatagattgttttayagtgaaggaagggaaatctgataa

SEQ ID NO: 97514 - DNA, 50 bp, homo sapien
aaattttcccaatattgctagaggastcaagatgaaactataggaaattc

SEQ ID NO: 97515 - DNA, 50 bp, homo sapien
tgtactgcattccaagagtgttctcwacatatttaaaaaactggagacaa

SEQ ID NO: 97516 - DNA, 50 bp, homo sapien
tcaggaaccaaatctcattcacttaygtttcctcatttcccaggaccact

SEQ ID NO: 97517 - DNA, 50 bp, homo sapien
taagcaaacctttacatgatgaagaygaacttgtgaggataaagacacaa

SEQ ID NO: 97518 - DNA, 50 bp, homo sapien
ccaagagagatttgtggaatggatargttttgcacatacagttacattcc

SEQ ID NO: 97519 - DNA, 50 bp, homo sapien
gattgattacgcattgatgttaagartcagaatcagtactgaatagtgta

SEQ ID NO: 97520 - DNA, 50 bp, homo sapien
tgaaacagtcagactctcttgaacayggttacaatttgctagatttataa

SEQ ID NO: 97521 - DNA, 50 bp, homo sapien
cgctgggtgggagcagtttgatcacrgaggaaggcgaatagttaatcctt

SEQ ID NO: 97522 - DNA, 50 bp, homo sapien
gtctgaaatcagcatttcgtgttacyggttattaagagtattggggaata

SEQ ID NO: 97523 - DNA, 50 bp, homo sapien
atccactgttattaactataatcgcyatgttattcattggatcccttgga

SEQ ID NO: 97524 - DNA, 50 bp, homo sapien
cagcttcagttctctgggctcgttgwaactctgttctcagtggtcattta

SEQ ID NO: 97525 - DNA, 50 bp, homo sapien
agatctgccaaagttttcacatctaygtcatgactgttctagaacaagta

SEQ ID NO: 97526 - DNA, 50 bp, homo sapien
atcctattatgacttctacaggataytatatttgttaaggtacatcctgg

SEQ ID NO: 97527 - DNA, 50 bp, homo sapien
cacagaattcccagcagctctatcayggctagttttatgtttactgtaat

SEQ ID NO: 97528 - DNA, 50 bp, homo sapien
gaaaaccatgattctaaggttggcawataggtataacatacaggtaatgc

SEQ ID NO: 97529 - DNA, 50 bp, homo sapien
tgacatttttctggggaaatgactayggtttgggcacactgtccttcccc

SEQ ID NO: 97530 - DNA, 50 bp, homo sapien
tggaacttcttttttatttgttcaartacatgctaataacatactttctt

SEQ ID NO: 97531 - DNA, 50 bp, homo sapien
ggatagatggcatagtctcctcttaygctctcaagaagaatagatgttct

SEQ ID NO: 97532 - DNA, 50 bp, homo sapien
ccacacctagttgtttctaacaacamgtaagacaagagggacacggagac

SEQ ID NO: 97533 - DNA, 50 bp, homo sapien
tgtaatataaggaaattatactacaygttcagggacctttttaaacaaaa

SEQ ID NO: 97534 - DNA, 50 bp, homo sapien
caattcacacactttttgccttgtckcgttaatgggagtatgaaacaaaa

SEQ ID NO: 97535 - DNA, 50 bp, homo sapien
tttatgaaatcttgtttttgaaaggycaggtaaattacagctaatacagt

SEQ ID NO: 97536 - DNA, 50 bp, homo sapien
aacaaaggggaattatccatctaagkagtccagcaagaagtgaatgctaa

SEQ ID NO: 97537 - DNA, 50 bp, homo sapien
ttctcctacgactgcactataaacasagtgggttatgaatagggttacta

SEQ ID NO: 97538 - DNA, 50 bp, homo sapien
aggatattatataatgataaagggayacatttcaccaaaagatataacca

SEQ ID NO: 97539 - DNA, 50 bp, homo sapien
aatcacttatgcttgagggttaaatsataggccttcatagaaaacagcta

SEQ ID NO: 97540 - DNA, 50 bp, homo sapien
gtctattaatcaaccttaaatgtcamcaatttaaattcctcaattaaaag

SEQ ID NO: 97541 - DNA, 50 bp, homo sapien
taatttcaaattaggtttcacagagragatttttttaatgaaccataatt

SEQ ID NO: 97542 - DNA, 50 bp, homo sapien
ttctgaaagagagtcatggaagagasaaagtgttaaagagtttatagaat

SEQ ID NO: 97543 - DNA, 50 bp, homo sapien
gtttactgtatcattattctgcacaycttaattttgcatatagtagaaat

SEQ ID NO: 97544 - DNA, 50 bp, homo sapien
gctgtcgccttcacttaagaaaataragttgatacctttcttgttccctt

SEQ ID NO: 97545 - DNA, 50 bp, homo sapien
ggatgggaggaagttggtagggtagraaaatgtgctattaccactattga

SEQ ID NO: 97546 - DNA, 50 bp, homo sapien
gaataagttactttgtttgtttcaasctctacgtttttggtggatttaca

SEQ ID NO: 97547 - DNA, 50 bp, homo sapien
aactaacattctgtagctctctattmaaggagtcagaacattttctcttt

SEQ ID NO: 97548 - DNA, 50 bp, homo sapien
gtgaagaagactcattctttccttaytgcaggacttcagttttctggagt

SEQ ID NO: 97549 - DNA, 50 bp, homo sapien
gaatgttagtatcataaaattgactmtggtaggagaatttatactttgta

SEQ ID NO: 97550 - DNA, 50 bp, homo sapien
actagaatagaacactgatctataaytgcattttgttagaactatatgca

SEQ ID NO: 97551 - DNA, 50 bp, homo sapien
cctgaggcttttctcagtattaaaaytaaattcaaaataaatgaacagaa

SEQ ID NO: 97552 - DNA, 50 bp, homo sapien
atctttgaaactacctaaattgtagyacctagttgactgtattttaatta

SEQ ID NO: 97553 - DNA, 50 bp, homo sapien
ctctgggtttactcaggtaggctagsaaattagacaaaaacatacttaat

SEQ ID NO: 97554 - DNA, 50 bp, homo sapien
ttgttcttgatttgaactgttgaaargcgttcagtgagaaattcccagtt

SEQ ID NO: 97555 - DNA, 50 bp, homo sapien
cacaaccatgaagtaatttactatgsaaggaagaccaagttgagtttgaa

SEQ ID NO: 97556 - DNA, 50 bp, homo sapien
tacaagctatttagagagaagaacargaaagtgaatttgtaaaacctgta

SEQ ID NO: 97557 - DNA, 50 bp, homo sapien
tagtggccatgtcttccagcccttcrattgtggaatcttgcaggactgaa

SEQ ID NO: 97558 - DNA, 50 bp, homo sapien
ttaaagtgctctctaggacaaattgragaagttttagaaagatttgtgtg

SEQ ID NO: 97559 - DNA, 50 bp, homo sapien
aaagactaattatcatggaacgttayactcaggatctaattaatttggtt

SEQ ID NO: 97560 - DNA, 50 bp, homo sapien
atgctgagtgtaaaatatagtaaggraatctaacttgtaaaataaaatac

SEQ ID NO: 97561 - DNA, 50 bp, homo sapien
ttactaaaaaaagaaaaatagattcmgcattaaaatacaggaaacaatga

SEQ ID NO: 97562 - DNA, 50 bp, homo sapien
tcaagatggggctaaactagtggagwaataatatctcaaaattttgcatg

SEQ ID NO: 97563 - DNA, 50 bp, homo sapien
gcaggttctgaaggattttaatcaasgggtatgatacagtttgtatattt

SEQ ID NO: 97564 - DNA, 50 bp, homo sapien
aaccagccatggtattgcagagaaaygacataagtttattgagaatgtta

SEQ ID NO: 97565 - DNA, 50 bp, homo sapien
ctctggagtcacaagcaaagggcacrgattgctactggaggtgttcaggt

SEQ ID NO: 97566 - DNA, 50 bp, homo sapien
ttcacttttattctttgttatgtacyaaaatcaaatgacatcattaaaga

SEQ ID NO: 97567 - DNA, 50 bp, homo sapien
agggactctaaacaaagaattgcctratatcataaaaacagtgaagaaga

SEQ ID NO: 97568 - DNA, 50 bp, homo sapien
aaggtttcttacaacttagtctcagragtgacaacttttccttccacata

SEQ ID NO: 97569 - DNA, 50 bp, homo sapien
agacctgaaagatgaaatggactgaytaattatgtgaaaagtgctaggga

SEQ ID NO: 97570 - DNA, 50 bp, homo sapien
cccaatgctttatcactctagcctckccaaaaatgctaccatcctttaaa

SEQ ID NO: 97571 - DNA, 50 bp, homo sapien
agattcagaaacaaacaacaaagacyaattggcaaacaaggaaatgctgg

SEQ ID NO: 97572 - DNA, 50 bp, homo sapien
caaaatctgccaaaaagagccccaaytgattgttttcatgtttataatct

SEQ ID NO: 97573 - DNA, 50 bp, homo sapien
aggcctcctacctcagagtgatgtckaactatccagcaatatccattgcc

SEQ ID NO: 97574 - DNA, 50 bp, homo sapien
ttcaaggacagtcctttgacctaagyatagtatccggttctttggttcca

SEQ ID NO: 97575 - DNA, 50 bp, homo sapien
tggtatacaggactggactatgcaasatgggaaattggaggaatatgtgg

SEQ ID NO: 97576 - DNA, 50 bp, homo sapien
agttgaaatggaaatggaacttcagsattacatcatctgagcacttagtt

SEQ ID NO: 97577 - DNA, 50 bp, homo sapien
ggagtggggagaatgagagggtcaargatcttggaatgttatatgaaagg

SEQ ID NO: 97578 - DNA, 50 bp, homo sapien
ccttcctcttctctcacagaatcaayttccatatatattacctatgtttt

SEQ ID NO: 97579 - DNA, 50 bp, homo sapien
ttctttctttcttgttgtcatgaccraaaccttatatgaaatagtggtgg

SEQ ID NO: 97580 - DNA, 50 bp, homo sapien
aaaggggtataaaattgcgtctaaayctgtaatatcttttcctaaaccat

SEQ ID NO: 97581 - DNA, 50 bp, homo sapien
agctggaaaaagaaaaccttcgtgaygcaacagcaggaagtttagtaaca

SEQ ID NO: 97582 - DNA, 50 bp, homo sapien
cactgattttatttaaattatagaayggataagtgaatatgactgcagtt

SEQ ID NO: 97583 - DNA, 50 bp, homo sapien
atcactatgtcaattggagaaactargaatgaaaatcagttttattttca

SEQ ID NO: 97584 - DNA, 50 bp, homo sapien
ggccactagtgtttttatgcttttgrtccttcccatataaaatcaaggtg

SEQ ID NO: 97585 - DNA, 50 bp, homo sapien
ccaattgacatagtgattgctaaaawtaagaaatggtttctggaagatat

SEQ ID NO: 97586 - DNA, 50 bp, homo sapien
gtaaatagggattataaaacaatacyatcctatagacaaggtaactaaca

SEQ ID NO: 97587 - DNA, 50 bp, homo sapien
actatgttgtcctgacagtgccctgmatttgatatcttccagaaaccatt

SEQ ID NO: 97588 - DNA, 50 bp, homo sapien
acatgaattccgaaatttcttctaaytggctcttaagggttgggggtgca

SEQ ID NO: 97589 - DNA, 50 bp, homo sapien
taaagcagactaaactgtattgtcasagctattaattttacacaaaatga

SEQ ID NO: 97590 - DNA, 50 bp, homo sapien
ctaccaatcttatgttatcccctacratctagttacatcacagaaagaag

SEQ ID NO: 97591 - DNA, 50 bp, homo sapien
aaataagggattggttatgtctaagycatggtgaagcatgcgacctgtcc

SEQ ID NO: 97592 - DNA, 50 bp, homo sapien
ccacacaaagaaacttgagtttgtcrttattgtggtgactggtcacttag

SEQ ID NO: 97593 - DNA, 50 bp, homo sapien
cacattctattggaaatggtttagaygtaggagaactacttaatctgaga

SEQ ID NO: 97594 - DNA, 50 bp, homo sapien
cagccttgtctggggaaatccattaycaagcacaaagttctcaaagatgg

SEQ ID NO: 97595 - DNA, 50 bp, homo sapien
tggaagttggcccattgtacatccamctcgttgttttccatggtctctgg

SEQ ID NO: 97596 - DNA, 50 bp, homo sapien
ctaaatgctttagagaaaagggtcaytgaaacagacagactcaaaccaag

SEQ ID NO: 97597 - DNA, 50 bp, homo sapien
ttctaagccctggctaaggaaaacaygaattccgaaatttcttctaactg

SEQ ID NO: 97598 - DNA, 50 bp, homo sapien
tctgtattagtttgcacataatgtcratttatattcttttctcttgccat

SEQ ID NO: 97599 - DNA, 50 bp, homo sapien
gcctccactcccctgaagaccatggraagtcctattctctagtggatgct

SEQ ID NO: 97600 - DNA, 50 bp, homo sapien
tggtgaatacaaaactggtaagcaartagttttatgactgaggatcacag

SEQ ID NO: 97601 - DNA, 50 bp, homo sapien
acggaatccagtctgtcttttctgcrcagttaatatgggctctatataac

SEQ ID NO: 97602 - DNA, 50 bp, homo sapien
gagatgtctgctttggaaatcaggaraaaacaacatgttaaggagatcct

SEQ ID NO: 97603 - DNA, 50 bp, homo sapien
gaccatttgagctgttgaacaaaatkaactgatgcgattctaaactggct

SEQ ID NO: 97604 - DNA, 50 bp, homo sapien
atggacagcttaaatggaaagatcastacttcgtgcttaagaactggacc

SEQ ID NO: 97605 - DNA, 50 bp, homo sapien
tttgcctaatgccagaataaagaacrcattcgtctacctgtctgtgcatg

SEQ ID NO: 97606 - DNA, 50 bp, homo sapien
gtgaagtctggcactttagtgtaacyataactggaataatgtacactgta

SEQ ID NO: 97607 - DNA, 50 bp, homo sapien
tactcacacaagaatgtactttcagsagatgaggatatttctgtgatagt

SEQ ID NO: 97608 - DNA, 50 bp, homo sapien
cctctcccccaaattctaacaaccamaaatctttccaggtgttgtcgagt

SEQ ID NO: 97609 - DNA, 50 bp, homo sapien
actgggaagaacaaagtccattatayaagattgtggtttttaaaaaatta

SEQ ID NO: 97610 - DNA, 50 bp, homo sapien
ctgaatgaaactttttacccttcaaytaatctctcacactctgtaattaa

SEQ ID NO: 97611 - DNA, 50 bp, homo sapien
tctcctggtgcaagataacaaataartcatcaccattctgattcttaaat

SEQ ID NO: 97612 - DNA, 50 bp, homo sapien
ctgtattagtctgactatgggagaawcagtaacatgtactagtcactgag

SEQ ID NO: 97613 - DNA, 50 bp, homo sapien
atgtgtacaagggtgaactcatcaayatcctttgcaaaacaaaagttccg

SEQ ID NO: 97614 - DNA, 50 bp, homo sapien
gagaaattgctataggccagttatayctgattacaccgggactgccctct

SEQ ID NO: 97615 - DNA, 50 bp, homo sapien
gcagtggagagagaagggaaacagaygtgaaatccatagccagtcaaagt

SEQ ID NO: 97616 - DNA, 50 bp, homo sapien
atcttcttggatcaccactaaactaygtccttagaaaaataaggaaaaga

SEQ ID NO: 97617 - DNA, 50 bp, homo sapien
tcatcagatcttgtgagacccattcrctagagtacagcatgagaaagacc

SEQ ID NO: 97618 - DNA, 50 bp, homo sapien
ttttctttccactggtggttctgtastaaatttctattgaaaggctgttt

SEQ ID NO: 97619 - DNA, 50 bp, homo sapien
atacataccaggattggagataaaaygtggataaattactatgcttattt

SEQ ID NO: 97620 - DNA, 50 bp, homo sapien
gcatgtcctagctcttgtgaatctayacctgtccctcacatctctaagat

SEQ ID NO: 97621 - DNA, 50 bp, homo sapien
tagatctatttgggaagtttcatgastaacataatgggttggaagcaaat

SEQ ID NO: 97622 - DNA, 50 bp, homo sapien
gtttttgtactctggaaatgatggaygattcaactctgcacttgagtgca

SEQ ID NO: 97623 - DNA, 50 bp, homo sapien
ctcttagctgcaagtatagaaattamaaaggaagttaatgttttatctga

SEQ ID NO: 97624 - DNA, 50 bp, homo sapien
ttgagaaaccctgctctattagggckctttttcttccattcactatgcac

SEQ ID NO: 97625 - DNA, 50 bp, homo sapien
gaataaataaatagtaaatatagtaygtcacacggtgacaaacctcaggc

SEQ ID NO: 97626 - DNA, 50 bp, homo sapien
atgtgtgagcaataaaattctctackctttctaacggactgcttcttcat

SEQ ID NO: 97627 - DNA, 50 bp, homo sapien
caggcatccccaagagaggagcagayggcttcttgttttgaccaaatttg

SEQ ID NO: 97628 - DNA, 50 bp, homo sapien
atgctgcattctcttttatcattcayctaaagacccactcattttattaa

SEQ ID NO: 97629 - DNA, 50 bp, homo sapien
aaatggagggggaaattaaggtaaarttgtgcctggatatttcttccaat

SEQ ID NO: 97630 - DNA, 50 bp, homo sapien
ttggtaacagacacttatgatagccygcactattgactagaacacactgg

SEQ ID NO: 97631 - DNA, 50 bp, homo sapien
agcaggtttgtcctctctcaaagtamcgtgttggctcttagaataaatcc

SEQ ID NO: 97632 - DNA, 50 bp, homo sapien
gaaagagaggaaggcaagaggacatrgtaggtacacaatatatagtatga

SEQ ID NO: 97633 - DNA, 50 bp, homo sapien
gagcctctaaacccaggggctttaastcaggatgctacgttttactatgg

SEQ ID NO: 97634 - DNA, 50 bp, homo sapien
tgtaggatttgaattggagctatcartaagtgggagatcatgatctgata

SEQ ID NO: 97635 - DNA, 50 bp, homo sapien
atgaatttatactaaagttctgaaargagaaaaacaatacaatgtagatc

SEQ ID NO: 97636 - DNA, 50 bp, homo sapien
tgagttgaagatctaacgtcaattcraagttctctattgaagttgaagat

SEQ ID NO: 97637 - DNA, 50 bp, homo sapien
tttattataatgggatcatatttacmgatcattttacacacaaattgtat

SEQ ID NO: 97638 - DNA, 50 bp, homo sapien
ttgaagagtaaattgatttttgaaamcttgcacctatcacagcatctggc

SEQ ID NO: 97639 - DNA, 50 bp, homo sapien
tatattccaatttcttgaattcttarccatcatataaagatgcaaatcat

SEQ ID NO: 97640 - DNA, 50 bp, homo sapien
atttgtaacaatatcagatgtaggamctgccttacccacaattgaggttt

SEQ ID NO: 97641 - DNA, 50 bp, homo sapien
catttgcattcagggtctcacataawccaaaacttacacattgctttgca

SEQ ID NO: 97642 - DNA, 50 bp, homo sapien
cccacctcattctcaaaaccacaacraaagtgatgcttttaaagtaagtc

SEQ ID NO: 97643 - DNA, 50 bp, homo sapien
caaaggtttctcttcatttgagtatyagaaacgtgaaacttagaaactct

SEQ ID NO: 97644 - DNA, 50 bp, homo sapien
ttctaaatgtttatggttgaattccyggaaatatgtagaaattacaagta

SEQ ID NO: 97645 - DNA, 50 bp, homo sapien
acagcatacccaaatcaaatagagartaactattaggcattttaaaaaac

SEQ ID NO: 97646 - DNA, 50 bp, homo sapien
tggcaaatgaataatcagctatccawattggctcaaggacgatcaagggg

SEQ ID NO: 97647 - DNA, 50 bp, homo sapien
agcacatgaaaagtgaacatgaagarataaacagaggtgatttggagagg

SEQ ID NO: 97648 - DNA, 50 bp, homo sapien
ctgagaaaacacaagatatagtgacratgattaaaaatgtgaaatagagg

SEQ ID NO: 97649 - DNA, 50 bp, homo sapien
taatagagggagacatctggtagcaytgaagatatccccggcaaggatga

SEQ ID NO: 97650 - DNA, 50 bp, homo sapien
atataaagatataaggacaacagaaygaaagcaaagccagatgtctgggc

SEQ ID NO: 97651 - DNA, 50 bp, homo sapien
ttagaattattagacctgcgaggatraaccatctggatagttgtctctta

SEQ ID NO: 97652 - DNA, 50 bp, homo sapien
ttttacacatatggatccattatgcraaggaaactctcttaaaaataaat

SEQ ID NO: 97653 - DNA, 50 bp, homo sapien
tcttgaaggattcactagttattaayctgtgcatatgtaaagtgaaattc

SEQ ID NO: 97654 - DNA, 50 bp, homo sapien
aacagagtcccacaaattcatatggmaaaagtcagctacatatccaaaca

SEQ ID NO: 97655 - DNA, 50 bp, homo sapien
atcatgtgatttttcactctattaaycagtgatcagatcaattatgtacc

SEQ ID NO: 97656 - DNA, 50 bp, homo sapien
ttcaatgtattgttttttcttttgarcgcacatttcaaaggggaaagtac

SEQ ID NO: 97657 - DNA, 50 bp, homo sapien
tagattagcgctgaatcaacaaataygaaatgacactgatggtaggaatg

SEQ ID NO: 97658 - DNA, 50 bp, homo sapien
gactgttcctggagttgtaggtcacygggtgcagaaccagtcttagaaac

SEQ ID NO: 97659 - DNA, 50 bp, homo sapien
tcttttggatttgaataggtcttacygcatatttgtccttttcacttcat

SEQ ID NO: 97660 - DNA, 50 bp, homo sapien
atgctgactccagtatccagaaaaaygttcaacttcctcccttcaacctc

SEQ ID NO: 97661 - DNA, 50 bp, homo sapien
tttaaaaaatatatgatgcataaatwagagacagcatatatattttttga

SEQ ID NO: 97662 - DNA, 50 bp, homo sapien
ccatgaaatatcctgtccagagaccrctaacagcaaatgaattacatacc

SEQ ID NO: 97663 - DNA, 50 bp, homo sapien
tcctggaatattggttcattgtagaygggcttacctagagggaagtatat

SEQ ID NO: 97664 - DNA, 50 bp, homo sapien
tcaatggggacacaattttcttttcracagtgagtgctgggacgaacaga

SEQ ID NO: 97665 - DNA, 50 bp, homo sapien
tgcataaccagtgagtatttttttargtaggaattctacgtatgtctttg

SEQ ID NO: 97666 - DNA, 50 bp, homo sapien
tcactggattaagcctaatgatcaasctaagtgacagattggacaaaaag

SEQ ID NO: 97667 - DNA, 50 bp, homo sapien
ccttcttcattagttgatcaaaatgwattctccatgaggtcatggtgtga

SEQ ID NO: 97668 - DNA, 50 bp, homo sapien
tctttctgttctaattcaatattcaycaggaactttatgattataatgtg

SEQ ID NO: 97669 - DNA, 50 bp, homo sapien
ttgacaaggatgacccttatagtggrcaccaattttcgttttccttggcc

SEQ ID NO: 97670 - DNA, 50 bp, homo sapien
atatacttgccacatatgtgagtatytacttcctttttagaatcaagggt

SEQ ID NO: 97671 - DNA, 50 bp, homo sapien
gggtcatccttgtcaacagcatgcarggtctgaatcaactaagagaaaaa

SEQ ID NO: 97672 - DNA, 50 bp, homo sapien
tcccatctttaggtggataaagaacygaaagagaggctccatttctttag

SEQ ID NO: 97673 - DNA, 50 bp, homo sapien
ttcagggcccaaggttcttccgttarcatgagatgaatgctgccaggtct

SEQ ID NO: 97674 - DNA, 50 bp, homo sapien
tttatggatgtatgtgtttaataacrataaaatgcatgcatagaagtgat

SEQ ID NO: 97675 - DNA, 50 bp, homo sapien
agaaggttttctgtggcttttggaartgaagacaaatttcaagatgtgaa

SEQ ID NO: 97676 - DNA, 50 bp, homo sapien
ttctatggtggcatttaatttgaaarctaaagaatatgtataaactggcc

SEQ ID NO: 97677 - DNA, 50 bp, homo sapien
tgataaaattccaaagacagaaatgmaaagtagtcaaaggggaaatatta

SEQ ID NO: 97678 - DNA, 50 bp, homo sapien
gtagttagaatagctctccacaataytaactaactaactaaataaataaa

SEQ ID NO: 97679 - DNA, 50 bp, homo sapien
ttcatagagaaattgctatatttcasgctctaaacttggcagacagcaag

SEQ ID NO: 97680 - DNA, 50 bp, homo sapien
ataggtacatggtatctttttgctcyaattgaattgttggagatgaagca

SEQ ID NO: 97681 - DNA, 50 bp, homo sapien
gttttctattttatttcagtcagaaktattaaaagtactactatcagtat

SEQ ID NO: 97682 - DNA, 50 bp, homo sapien
aatacataatactgaatgcttttaaygacaccaaagtcacctcttgaaca

SEQ ID NO: 97683 - DNA, 50 bp, homo sapien
agttgatcatataaatgctaagatakattgatgagtatatatgaactatt

SEQ ID NO: 97684 - DNA, 50 bp, homo sapien
aattagtgagttttattttggttggycagcttatttcttgatctacaaaa

SEQ ID NO: 97685 - DNA, 50 bp, homo sapien
attgtataattctgtcttccatagtmaaatcaatacaacaaaattaaatc

SEQ ID NO: 97686 - DNA, 50 bp, homo sapien
ataatattaatggggcattagcaaamtataggcctcagatatcactaagt

SEQ ID NO: 97687 - DNA, 50 bp, homo sapien
ttttaaccttcagttgaatcttaagraggagaatttctggtaaaatgtca

SEQ ID NO: 97688 - DNA, 50 bp, homo sapien
tttagttctgtaaacattcattaaargcttactctgtaccaaacaatatt

SEQ ID NO: 97689 - DNA, 50 bp, homo sapien
tgctactgctactggaactaattacrcttttagaccattttttcttggtc

SEQ ID NO: 97690 - DNA, 50 bp, homo sapien
tctagatgtagttcccttaaaaggckgatctgtaaagcgaagtgctatgg

SEQ ID NO: 97691 - DNA, 50 bp, homo sapien
aatttttggattggtctgatccttasgtacattgttagattgtttatttg

SEQ ID NO: 97692 - DNA, 50 bp, homo sapien
taaatataaagtaaatatagaagcayggataagtgaatataaaaatgcaa

SEQ ID NO: 97693 - DNA, 50 bp, homo sapien
tctgaatcagaattttctaccatctsaatgtccttcaaaaacttaccctc

SEQ ID NO: 97694 - DNA, 50 bp, homo sapien
ccaaaaatgtcatggaatagcatacrccataacatatatatttttgatta

SEQ ID NO: 97695 - DNA, 50 bp, homo sapien
acaacttgttattggtcacagactawtaagttgaagtaaggctctgtcta

SEQ ID NO: 97696 - DNA, 50 bp, homo sapien
tgcagagctaatcatataaaataacwggtaaaaaatgtttaaaatatttt

SEQ ID NO: 97697 - DNA, 50 bp, homo sapien
ccaaatacccattttccatgaacackatatttttgtaacctctgacattt

SEQ ID NO: 97698 - DNA, 50 bp, homo sapien
gttcaaatatatacatatactgttaygatacctactagagtgctggagtc

SEQ ID NO: 97699 - DNA, 50 bp, homo sapien
acagagtaattccacagccagttgcrgaagattcactttaacatttggca

SEQ ID NO: 97700 - DNA, 50 bp, homo sapien
aagcgaccagatcaaaatgaagttcwctatacgctgagcagattaaatac

SEQ ID NO: 97701 - DNA, 50 bp, homo sapien
gtctctcctcctacgagctattcttygtacatatggtaaaatttggcttt

SEQ ID NO: 97702 - DNA, 50 bp, homo sapien
tgatgagtagataaaaattatgaggycaatttgtttataagaatgtaagt

SEQ ID NO: 97703 - DNA, 50 bp, homo sapien
gtgttatgatgtaagatttaatatgytgttactgtaagcttaagagtttc

SEQ ID NO: 97704 - DNA, 50 bp, homo sapien
aatataaaccgttaataataacttaratgcttatatgtatgtgtgtttgc

SEQ ID NO: 97705 - DNA, 50 bp, homo sapien
ctaatgaattattttgtttatattcycaggtataatgttccccagctcta

SEQ ID NO: 97706 - DNA, 50 bp, homo sapien
tcccttaagtttcctgcgactcccargtggtaaaggagagccgaaggttc

SEQ ID NO: 97707 - DNA, 50 bp, homo sapien
aaggcaaagacatcaaccatagtaaraaagctctgcagaattgattatat

SEQ ID NO: 97708 - DNA, 50 bp, homo sapien
actacaaatatgtgtttaataagaasccgctactggatgaatccaattca

SEQ ID NO: 97709 - DNA, 50 bp, homo sapien
gacttctatagtctggaaaatcttaygttatactttgtacttttcataca

SEQ ID NO: 97710 - DNA, 50 bp, homo sapien
ttgagtcttgctttgcattcaatatmgccatttatgaaaagtttaatgtt

SEQ ID NO: 97711 - DNA, 50 bp, homo sapien
agctcccagtccataactctaaatakcacatgggcacctattactccata

SEQ ID NO: 97712 - DNA, 50 bp, homo sapien
acatcataccaatgagtttggctaawgggaaagatccatttttggtttct

SEQ ID NO: 97713 - DNA, 50 bp, homo sapien
ttcagacttctattcctgatcaaacrcacttgctaaacatgtagctcaga

SEQ ID NO: 97714 - DNA, 50 bp, homo sapien
atgacaaactaattatgatggtagaygcattgccctgacaaaggttattc

SEQ ID NO: 97715 - DNA, 50 bp, homo sapien
gaagttctatagaaaggcattatgayatgactcatgctgcatctcaaact

SEQ ID NO: 97716 - DNA, 50 bp, homo sapien
acacagaaaggaatcctttaaatcaygaaaagcccacttggtgagtaaaa

SEQ ID NO: 97717 - DNA, 50 bp, homo sapien
aatcaatacttctcaaatctaaaaayaggagtaaatatggaagtcttgat

SEQ ID NO: 97718 - DNA, 50 bp, homo sapien
tttcttcatctgtaatataggaatargactaaatgtgtgaattcttgtga

SEQ ID NO: 97719 - DNA, 50 bp, homo sapien
tattattgatactttatattccacaytaattcgtcttttgctttatctga

SEQ ID NO: 97720 - DNA, 50 bp, homo sapien
taaaaaaaaatgccccaagctcagaygaaagataatttgcatagagatag

SEQ ID NO: 97721 - DNA, 50 bp, homo sapien
tagcacaagctaaaattatattccaygagccttgtttatacatcctcgaa

SEQ ID NO: 97722 - DNA, 50 bp, homo sapien
acaagcagttggtggttggtgaacakgagtgtaatgaaaatgattttgtt

SEQ ID NO: 97723 - DNA, 50 bp, homo sapien
tacaattacacttattctttaatcayggaggcttttagttgcaagtttcc

SEQ ID NO: 97724 - DNA, 50 bp, homo sapien
agtaaactttacctattaaaaaaaawcattagcaattgagaaaacagtcc

SEQ ID NO: 97725 - DNA, 50 bp, homo sapien
taaaagagagagaattttatgtctgraacaacataacgtgaaataggaca

SEQ ID NO: 97726 - DNA, 50 bp, homo sapien
ttccatttctagcactcctcagttarcagtaaaccacatttcattaaata

SEQ ID NO: 97727 - DNA, 50 bp, homo sapien
ataatttatttagcactaggcattgmaacatagcttacagcataaaagaa

SEQ ID NO: 97728 - DNA, 50 bp, homo sapien
tccaatgtgaattaagctcataatayactgcaaggacttctgtgatttta

SEQ ID NO: 97729 - DNA, 50 bp, homo sapien
gggtggatgtgaaaagtaagttccasactcaggttcattggaaagatttg

SEQ ID NO: 97730 - DNA, 50 bp, homo sapien
cctcacagcaggattttttcactaayggctacttctactgtttttgaaat

SEQ ID NO: 97731 - DNA, 50 bp, homo sapien
agagttttggtacagggaatctccartaataaatccaaatccataaaaaa

SEQ ID NO: 97732 - DNA, 50 bp, homo sapien
tactgtgaaaaactcttaatgcacayggattattgttttcttgttagagc

SEQ ID NO: 97733 - DNA, 50 bp, homo sapien
tattaattataatgactcctgcaaartttgatggagtttgaaaaaaggtc

SEQ ID NO: 97734 - DNA, 50 bp, homo sapien
ccaagatactcgaattgatttaacamgtacaggcaaagtatttttgaaga

SEQ ID NO: 97735 - DNA, 50 bp, homo sapien
tgtagtgtttcatttttatttcacaygctgttaccatcttgcataaattc

SEQ ID NO: 97736 - DNA, 50 bp, homo sapien
tctagatttctgagccatataaactragaggtgatactctcacaaacaat

SEQ ID NO: 97737 - DNA, 50 bp, homo sapien
aaaaattcctctctctcatcccagtrgaatatgtagcaattctgtatgac

SEQ ID NO: 97738 - DNA, 50 bp, homo sapien
taagaaaattcagagacaattagtastaaatagtttcaatacaaagaaat

SEQ ID NO: 97739 - DNA, 50 bp, homo sapien
aaacatttgaaccatattcactttcyggtcttgttatatttagcatttga

SEQ ID NO: 97740 - DNA, 50 bp, homo sapien
cgagcttacattgtttagtttagcayagatcttgcaatgaagaaaagaga

SEQ ID NO: 97741 - DNA, 50 bp, homo sapien
caattggtatcagggttgggattcaytcacctcaagtatgtaagaaaggc

SEQ ID NO: 97742 - DNA, 50 bp, homo sapien
attggtccagtactcttggaagttaygctcttttcatccatattgtccat

SEQ ID NO: 97743 - DNA, 50 bp, homo sapien
ggtgattgttaaggatatgtacttaygttaattctacaggtactaaatat

SEQ ID NO: 97744 - DNA, 50 bp, homo sapien
atttagtaattagaatgttcaatccratatattaatttcaactctgaatt

SEQ ID NO: 97745 - DNA, 50 bp, homo sapien
gtcacaccccacattgtagagaagawtcaagaaagagagagcttaaataa

SEQ ID NO: 97746 - DNA, 50 bp, homo sapien
caaatagtttatttcaatacaataarcaactcatagaaaattccatttaa

SEQ ID NO: 97747 - DNA, 50 bp, homo sapien
ttcaattaattattgtattctaaaakgataatagttgatatttgcataat

SEQ ID NO: 97748 - DNA, 50 bp, homo sapien
ccctcagatgatataataactacatsaaattgcatgaataattttattgt

SEQ ID NO: 97749 - DNA, 50 bp, homo sapien
catcacttccaactccattccattamcagagcttaggtgaatgcatgtgc

SEQ ID NO: 97750 - DNA, 50 bp, homo sapien
gtgatattcaaaaacatcatttccakaaagctatttagttcagtccctaa

SEQ ID NO: 97751 - DNA, 50 bp, homo sapien
gatacatagggatttaagccaatatraagtcacaagggaaaatactttct

SEQ ID NO: 97752 - DNA, 50 bp, homo sapien
gagagatttgattaaatatcaaaaayttcaacagtaaagacaaatatcta

SEQ ID NO: 97753 - DNA, 50 bp, homo sapien
ggaggaatttcttaaaactaatagamtaaatcttacagtggacaaaggcc

SEQ ID NO: 97754 - DNA, 50 bp, homo sapien
cagcgtctgttaacattctgctatgsacattttaataagtacactttaaa

SEQ ID NO: 97755 - DNA, 50 bp, homo sapien
gaatattaaaagtctacttcacaatyagttggtcttttgcttattccagt

SEQ ID NO: 97756 - DNA, 50 bp, homo sapien
tagggtctctttctcttttatcaagracatctgtctattatactaaggct

SEQ ID NO: 97757 - DNA, 50 bp, homo sapien
agcaagatccaaaaccataaaatgartaagagcctactgttcgtttaaag

SEQ ID NO: 97758 - DNA, 50 bp, homo sapien
ttatcttccaatttccaggatgaaamgtctaaaatagaaaggcaaagact

SEQ ID NO: 97759 - DNA, 50 bp, homo sapien
cattttgccttttcccatatacacartgtctaaaatctacacattcaatc

SEQ ID NO: 97760 - DNA, 50 bp, homo sapien
tagagttgacttcagcctagtcctcragaacagtggtccccaaacgtttt

SEQ ID NO: 97761 - DNA, 50 bp, homo sapien
ttcaaatgactaggcttacatactayaatgagacatgtctgataatctta

SEQ ID NO: 97762 - DNA, 50 bp, homo sapien
tttaatgcaatcacatcctaaaatcsactcacaaatatgacttttatgca

SEQ ID NO: 97763 - DNA, 50 bp, homo sapien
tcaaaaccaaagtcatcttatttcayagtgagtgctagttggaaaacatt

SEQ ID NO: 97764 - DNA, 50 bp, homo sapien
tctcatgttgtatgagcctgtgtcaygttagatgaaaaatgcatacatat

SEQ ID NO: 97765 - DNA, 50 bp, homo sapien
agatgaaaaatgcatacatatacatracaaatggaaattgccccttgact

SEQ ID NO: 97766 - DNA, 50 bp, homo sapien
gtctgtttaaaactttgagcaattcmcgtaatcaaatatctttcttaaag

SEQ ID NO: 97767 - DNA, 50 bp, homo sapien
cagagaagataataaactttgtcaayacagtacaattgattccatttgcc

SEQ ID NO: 97768 - DNA, 50 bp, homo sapien
tgttagatgcttttgttaatgtaccygatactgtcttttctagatgcttt

SEQ ID NO: 97769 - DNA, 50 bp, homo sapien
taactatgtaatgagaggtaataagmaaatcttctccaaggtctgaacaa

SEQ ID NO: 97770 - DNA, 50 bp, homo sapien
acataggagacacagaactatttaasgactgaaccatcagtatagtcaca

SEQ ID NO: 97771 - DNA, 50 bp, homo sapien
tcctgccaacggaaatatcatgcackaagagtcttcatctgttttatttt

SEQ ID NO: 97772 - DNA, 50 bp, homo sapien
actaggaaaaatccttaaactttgamaatcaaatgagcaagcaccaatgt

SEQ ID NO: 97773 - DNA, 50 bp, homo sapien
tgtgcacacgtatacacatttttcartacacaaacttaggtatcatgtta

SEQ ID NO: 97774 - DNA, 50 bp, homo sapien
gaagatgaacatgctcctgacaatgsagtgtgatttagaaaactatatcc

SEQ ID NO: 97775 - DNA, 50 bp, homo sapien
catgcaaagcaatgaaattccacaaraccatatgagtgttttctggtatg

SEQ ID NO: 97776 - DNA, 50 bp, homo sapien
tcttaccagggctttatccaatataygcttttgtaaagagtcacattttt

SEQ ID NO: 97777 - DNA, 50 bp, homo sapien
accaaaaaaaaaaatagaacaacaartaatttatgaacaaacaacatact

SEQ ID NO: 97778 - DNA, 50 bp, homo sapien
gaaaactttgactactcttatggcawcgtggtaataacacaggaatggga

SEQ ID NO: 97779 - DNA, 50 bp, homo sapien
aaggatggtggggacctccatgatgraattagtgtacttttaagtcaccc

SEQ ID NO: 97780 - DNA, 50 bp, homo sapien
tcctcatgaggcatctggtaattctmaaattcatcggtaagaaactgaga

SEQ ID NO: 97781 - DNA, 50 bp, homo sapien
ttcttcccatataccaaatctattascaaatcttataaattttctccttg

SEQ ID NO: 97782 - DNA, 50 bp, homo sapien
ttcacctttcaaagtttactgtcacyaattattatggtttctgggaaatg

SEQ ID NO: 97783 - DNA, 50 bp, homo sapien
ctgactaataagaatcctgataacarcatgacaactgttaagggcaatat

SEQ ID NO: 97784 - DNA, 50 bp, homo sapien
atcagtgtaagtgtaaattatatgaratgacataggtagataagcacacg

SEQ ID NO: 97785 - DNA, 50 bp, homo sapien
aaaagacagggtgagagagaaataaygagtggaactcccttttaggctgg

SEQ ID NO: 97786 - DNA, 50 bp, homo sapien
ttaaatttgcagaaaatatatctcartaaactgtggcctttagtatactg

SEQ ID NO: 97787 - DNA, 50 bp, homo sapien
ggattaatatcaattgaaagctagtraaggtttaccccatgttagtcacc

SEQ ID NO: 97788 - DNA, 50 bp, homo sapien
aaaaggggcagacccaggtatcaaamctctaacgaccaattctgtcctag

SEQ ID NO: 97789 - DNA, 50 bp, homo sapien
agaaagaaaaatgcattgcaaaatgrcactataatgtacaggaaagagtc

SEQ ID NO: 97790 - DNA, 50 bp, homo sapien
gaaaaacaagcatgggactacctcasagttttacatgaggtcaattctga

SEQ ID NO: 97791 - DNA, 50 bp, homo sapien
aataaattttacatgtaaaataccaraataaaatagataatgcagaatct

SEQ ID NO: 97792 - DNA, 50 bp, homo sapien
gaaacaggaaacattgtaatcgtgayatgtcattagaaagcccctctaca

SEQ ID NO: 97793 - DNA, 50 bp, homo sapien
ttcttgaaaaagtttgtacatgataygaaaagcactacttttttgttgta

SEQ ID NO: 97794 - DNA, 50 bp, homo sapien
catctgcgcatctgggttgcaaggartaggtcacagaactagtggcttcc

SEQ ID NO: 97795 - DNA, 50 bp, homo sapien
gaaatcagcaaaataaattctcatamtaacagtgagaggagaccccacaa

SEQ ID NO: 97796 - DNA, 50 bp, homo sapien
catagggatggaatgtatgactggayggttacatgtcatggaaggcatat

SEQ ID NO: 97797 - DNA, 50 bp, homo sapien
taaaatgtgagggtataagaagtaaytaaagtatcacagctgctctctgt

SEQ ID NO: 97798 - DNA, 50 bp, homo sapien
atttgaaatatctatatatatgatayggcaattatatgttttttggtctg

SEQ ID NO: 97799 - DNA, 50 bp, homo sapien
agcaggcctgactctttatgcatctktcatctcttgctttcctacgatga

SEQ ID NO: 97800 - DNA, 50 bp, homo sapien
acagtacccattagtcccagatttaygtttaggagccagaggcaactttc

SEQ ID NO: 97801 - DNA, 50 bp, homo sapien
tctgtgtctcttgggaatgtcaaaartaacatggctgtcttagtccattt

SEQ ID NO: 97802 - DNA, 50 bp, homo sapien
tggggaaagaaccttttctcagaaarctttagatatggtaaactccacct

SEQ ID NO: 97803 - DNA, 50 bp, homo sapien
tttcattgtttatctgaaacttctaygtaaaatttcacatctcatatcct

SEQ ID NO: 97804 - DNA, 50 bp, homo sapien
atgaaagttagatcatatattgccaytggaaaacaaataaataattggta

SEQ ID NO: 97805 - DNA, 50 bp, homo sapien
ctttctaaatagtacatagcctttaragttacatggatttaggtagaaat

SEQ ID NO: 97806 - DNA, 50 bp, homo sapien
tggaatttttaaacaaaataaactgmaatcaaacattatacataaaaatt

SEQ ID NO: 97807 - DNA, 50 bp, homo sapien
caaagacatacgaagccagggagaaytgttagatatattatctctaattc

SEQ ID NO: 97808 - DNA, 50 bp, homo sapien
tgaatttgaatatgctcataaggtaytaacaatatggttctactatagat

SEQ ID NO: 97809 - DNA, 50 bp, homo sapien
taacaaatattacttaaatttagacyacattgactttatataatataccc

SEQ ID NO: 97810 - DNA, 50 bp, homo sapien
gtcaccagtacttgaacagcttggayggattttattaaatacaggctaaa

SEQ ID NO: 97811 - DNA, 50 bp, homo sapien
tctcagatctgacaatgaccaatggmaagttgtaggagaaacttcaggac

SEQ ID NO: 97812 - DNA, 50 bp, homo sapien
aaggtccaactcagctgtcacatackgatcttcccgttctgatgaattgt

SEQ ID NO: 97813 - DNA, 50 bp, homo sapien
cttccacctaaagttggctttaaacwcagcagctatatcaatcgcccaca

SEQ ID NO: 97814 - DNA, 50 bp, homo sapien
cttggagtggaggtgagaaggggcaytgataggtgttagtaaggtggccc

SEQ ID NO: 97815 - DNA, 50 bp, homo sapien
ttttgtcacccattgtcaatagcaartgtttcaattgcctattgattaac

SEQ ID NO: 97816 - DNA, 50 bp, homo sapien
aatgtttcttctgttgatattgggtragtttctgggcacattgaatattt

SEQ ID NO: 97817 - DNA, 50 bp, homo sapien
aaaaatagttaccaagaagaaaatamaagttggcattagcaaactaaatc

SEQ ID NO: 97818 - DNA, 50 bp, homo sapien
cagaaatatagaaatttaagcctgamactcaactgaaaggatggatttac

SEQ ID NO: 97819 - DNA, 50 bp, homo sapien
ctaatattttgacatacttgtgcctygattccagaagtagagtacactta

SEQ ID NO: 97820 - DNA, 50 bp, homo sapien
aatcatggacattccaaattgagacycacaagggtttatgactacattgt

SEQ ID NO: 97821 - DNA, 50 bp, homo sapien
atatttgccatttgcatcaactttarggtgtatcatttctttaaaagtta

SEQ ID NO: 97822 - DNA, 50 bp, homo sapien
atgtcgtggtaatcttattataagckcatatgttacctacttatttattc

SEQ ID NO: 97823 - DNA, 50 bp, homo sapien
aggaatttctttctactagctgacayggccccttgaaaatctaggtgcaa

SEQ ID NO: 97824 - DNA, 50 bp, homo sapien
ccctgcaattacattcctccagatcyctgatacaaaagatcactctcttc

SEQ ID NO: 97825 - DNA, 50 bp, homo sapien
agtagtgttttcatacacccataatsaactttctggataggaaattaaga

SEQ ID NO: 97826 - DNA, 50 bp, homo sapien
agaagcattgtggtaaaccaggtcarcatttgcaattaagactacagcat

SEQ ID NO: 97827 - DNA, 50 bp, homo sapien
tatgataatgcctcccgtatgctaargacttcaagctcaggagtggtgtt

SEQ ID NO: 97828 - DNA, 50 bp, homo sapien
ataagagtgattagctataaatataytgacttctctaatgttacagaaaa

SEQ ID NO: 97829 - DNA, 50 bp, homo sapien
gctgtgtcttggccaggaggagatcraaagatttgtgccacacagtgatg

SEQ ID NO: 97830 - DNA, 50 bp, homo sapien
tggagaactgggttcttgcaccatcraggattttaggacaggtgtacagt

SEQ ID NO: 97831 - DNA, 50 bp, homo sapien
cttcaaggagtccttttagattcacrgtatgatgtataattctttttttc

SEQ ID NO: 97832 - DNA, 50 bp, homo sapien
gtgttctcaatttggttcttagctcraatgttattgggtatagaaatact

SEQ ID NO: 97833 - DNA, 50 bp, homo sapien
gaaaaaaaaaagtcttgattgaaaayatgtaaaattaacagcacggtctc

SEQ ID NO: 97834 - DNA, 50 bp, homo sapien
tgccagattcagtattacacattccrgatgcctgagcttttgcataatga

SEQ ID NO: 97835 - DNA, 50 bp, homo sapien
gatgaagcagcaagtgaagtaaaaaytaaattaggagaatagtgtgaata

SEQ ID NO: 97836 - DNA, 50 bp, homo sapien
atcaccataacgtggtatacagcaakttagttcaaacttttttcaatcct

SEQ ID NO: 97837 - DNA, 50 bp, homo sapien
tagcacaaaagttccacaagacaacraaggtaagtacactactggggaaa

SEQ ID NO: 97838 - DNA, 50 bp, homo sapien
aatgtggatcagcatagcctttatgragagttgaaattagacagattccc

SEQ ID NO: 97839 - DNA, 50 bp, homo sapien
aaacaattagcgaagaactcaaccargataaagaagaatagttcttctta

SEQ ID NO: 97840 - DNA, 50 bp, homo sapien
ccctagaagaaaaaagtaacatgtakaaggtatcctagaaggaaaataat

SEQ ID NO: 97841 - DNA, 50 bp, homo sapien
aaaatcaggaataataaagttagcawgagatttttaacacaagatataaa

SEQ ID NO: 97842 - DNA, 50 bp, homo sapien
aacacacatcttagccgtcttcccawggtttcctattctttaatcatttc

SEQ ID NO: 97843 - DNA, 50 bp, homo sapien
ggggatcaaatacggcctataaatgyagttgcaaatcataatcttataat

SEQ ID NO: 97844 - DNA, 50 bp, homo sapien
ttgtgtcaaacaggtgcccctcaggwatcctgggttttacaggcctgaag

SEQ ID NO: 97845 - DNA, 50 bp, homo sapien
ggttgagaatcaaaggtgagttatcrgaatcattttgagaattcttccca

SEQ ID NO: 97846 - DNA, 50 bp, homo sapien
atagctgccacacatagggattcctstaacagatctgggcaaagtacatt

SEQ ID NO: 97847 - DNA, 50 bp, homo sapien
tagaaactgcaactatctcacggacygaaatggacaaaaactttttttaa

SEQ ID NO: 97848 - DNA, 50 bp, homo sapien
tataattagaggagttgtcagggctytgctgtaaatcctaaatttttcca

SEQ ID NO: 97849 - DNA, 50 bp, homo sapien
ggatctatgacctattcgatcttccsataaataaataggactgttcacat

SEQ ID NO: 97850 - DNA, 50 bp, homo sapien
ttaaattctgtaccaatcaactggamacttacatctggaatctagaagaa

SEQ ID NO: 97851 - DNA, 50 bp, homo sapien
ttggctaaaatatgggaaagaaacawtgtgtctaaaataagaataaaata

SEQ ID NO: 97852 - DNA, 50 bp, homo sapien
agactgaattactgtgattatatgaraaaaagatcacctttaccatatat

SEQ ID NO: 97853 - DNA, 50 bp, homo sapien
aagataaatacatctatgactttaayagataatgcaaaattgttcaagaa

SEQ ID NO: 97854 - DNA, 50 bp, homo sapien
gtaaacaggattagttgtaatgagaytatgaacttaggacctggaggcct

SEQ ID NO: 97855 - DNA, 50 bp, homo sapien
gtgtgagcttttaaaatgtgatagargaatgaaaaacaatactcttaatc

SEQ ID NO: 97856 - DNA, 50 bp, homo sapien
gattcttgtgtacaccgaagtttgargattattggggcagatcagaggtt

SEQ ID NO: 97857 - DNA, 50 bp, homo sapien
taagccacagcaggggctctgtgaaycgagaaggaaaatatattgcatct

SEQ ID NO: 97858 - DNA, 50 bp, homo sapien
tgcttattgatgttattcacaagtaygctaaataagggaaattttttaag

SEQ ID NO: 97859 - DNA, 50 bp, homo sapien
caaagtacacagtcaactggtgtcargactggaaagagaacgtttttgtt

SEQ ID NO: 97860 - DNA, 50 bp, homo sapien
gttacaattaaggtttaaagaattamggaatgcatttgtagccagtttag

SEQ ID NO: 97861 - DNA, 50 bp, homo sapien
ttatttagctcattatgctaaattayatccaagattttctcattctacag

SEQ ID NO: 97862 - DNA, 50 bp, homo sapien
cagtggaactcattctgacctggctyaatacagagttacaaagattgggg

SEQ ID NO: 97863 - DNA, 50 bp, homo sapien
aagaaagatcattccaggcagaaackaatggttgataaaagccagtacac

SEQ ID NO: 97864 - DNA, 50 bp, homo sapien
cgtggatatagtaatggctcgttaartcaattaacatttgtcaattaatt

SEQ ID NO: 97865 - DNA, 50 bp, homo sapien
atccctccttccagagtgtatgaagyataactgtgtatgagtttagttac

SEQ ID NO: 97866 - DNA, 50 bp, homo sapien
tgaagaagcaaaggtttctaatactsacatgtactactgctccaaccaat

SEQ ID NO: 97867 - DNA, 50 bp, homo sapien
ctcagttatcagacactggtatctaygttaatgctgaaaaaaaaatccct

SEQ ID NO: 97868 - DNA, 50 bp, homo sapien
actatgtttcacaagacaccaagctmaataagggactactaagtcacaat

SEQ ID NO: 97869 - DNA, 50 bp, homo sapien
caagtctcctgactcactttcaagayaggtaatccagcagctggaatcat

SEQ ID NO: 97870 - DNA, 50 bp, homo sapien
gctcattgctgctgaaccatcctgcrctgtccagaagaccagctctgccc

SEQ ID NO: 97871 - DNA, 50 bp, homo sapien
gagctttgggagatgaggtccataaktagatcagagttttaggtgttagc

SEQ ID NO: 97872 - DNA, 50 bp, homo sapien
tagcataaaagaacttagaagatacraaataaggggaaagagcaaaaagt

SEQ ID NO: 97873 - DNA, 50 bp, homo sapien
atttttcttttggtaggctgcctaartagataagtaagtatctgccttgc

SEQ ID NO: 97874 - DNA, 50 bp, homo sapien
ttcctctgccccgtggcaaaaagtargtctgttccatttgtttacaacca

SEQ ID NO: 97875 - DNA, 50 bp, homo sapien
ttaccatggaggtgaaggcagaagayatgtacaaataattcccagagtaa

SEQ ID NO: 97876 - DNA, 50 bp, homo sapien
acactccaacatacccaactcacagyccagattcagatactggtgggata

SEQ ID NO: 97877 - DNA, 50 bp, homo sapien
tactccattgcctgcctgccatcaayttcacttcatacttctgctgaagg

SEQ ID NO: 97878 - DNA, 50 bp, homo sapien
gttataaagtgcatggttcattaggrattttgtaaggactacgtgaggga

SEQ ID NO: 97879 - DNA, 50 bp, homo sapien
ggttatgactatcagagacactataygtaaaatgtctagcagaggtcttg

SEQ ID NO: 97880 - DNA, 50 bp, homo sapien
ctcaagttgccaatatgttttccacraggcttgcaattttacaaaaacct

SEQ ID NO: 97881 - DNA, 50 bp, homo sapien
gcgagcttcttagcgctcatcaactyagttatcagacactggtatctacg

SEQ ID NO: 97882 - DNA, 50 bp, homo sapien
aaatagatactgagaatgattgaatyggctaaatatctctccttatcaat

SEQ ID NO: 97883 - DNA, 50 bp, homo sapien
ctaaactatatccatgaatttaaaaygccttgactcactgtatttgttga

SEQ ID NO: 97884 - DNA, 50 bp, homo sapien
caagaaaaatatttattataggataytaaatggcttactgaatcattgag

SEQ ID NO: 97885 - DNA, 50 bp, homo sapien
ataaataagaagatcagtgcagggastacgcttttaaagaacaaattatt

SEQ ID NO: 97886 - DNA, 50 bp, homo sapien
atgaaagaacaataaaagatataaamtgacatataattgttgacagattt

SEQ ID NO: 97887 - DNA, 50 bp, homo sapien
cataaatagtcttgtcccttgaagakgtgagttaagaaaacagctggccg

SEQ ID NO: 97888 - DNA, 50 bp, homo sapien
ttcatctagttcctctggggacacaytgtgcagctaattcatccaggcag

SEQ ID NO: 97889 - DNA, 50 bp, homo sapien
gcccataactagcatttttatgaacygctcatgcagaggatctccatgtt

SEQ ID NO: 97890 - DNA, 50 bp, homo sapien
cctgaaagatacaaataacagcaaaytaaaagagaggttaagtaacttgc

SEQ ID NO: 97891 - DNA, 50 bp, homo sapien
gtttccggattgagaaaaccctccamgtatgtacccagtgaccaaatcca

SEQ ID NO: 97892 - DNA, 50 bp, homo sapien
caaatacatctctaaaaatccatcarcttataatttaatactaattgctt

SEQ ID NO: 97893 - DNA, 50 bp, homo sapien
tgtttttttaaaaaatcaagctatawagaagtgtatagagtaaaatacat

SEQ ID NO: 97894 - DNA, 32 bp, homo sapien
tgcttctctgggcgagwctcatggattctttg

SEQ ID NO: 97895 - DNA, 50 bp, homo sapien
tttgccagggtgtatgcataaaaaastttcataaaccttggatgccaggc

SEQ ID NO: 97896 - DNA, 50 bp, homo sapien
gtttatttatttaagtaattggtcaygaaatagacttgcatgctgaatac

SEQ ID NO: 97897 - DNA, 50 bp, homo sapien
tttattcacattttatgggtaagtaragaggttcagagaaattaaatggt

SEQ ID NO: 97898 - DNA, 50 bp, homo sapien
ttcctatttaaattggtaaaacaccraaatctgcttggaggcaattagga

SEQ ID NO: 97899 - DNA, 50 bp, homo sapien
tgatgaatgaaacctgtctaacataygacaactatcaaacatgtatggga

SEQ ID NO: 97900 - DNA, 50 bp, homo sapien
atcagttcttagatatggcacctaamggtaggaaaaataattatcatgaa

SEQ ID NO: 97901 - DNA, 50 bp, homo sapien
aaagaaacaacaaattattacaggargaagacaaactaaaagtgaattca

SEQ ID NO: 97902 - DNA, 50 bp, homo sapien
acaagcttaaagtaactcattaaaayaagatagagaaaaattatcttgat

SEQ ID NO: 97903 - DNA, 50 bp, homo sapien
acatagtcacttgcatatgtttatcmaaatactcccataaatataaaatg

SEQ ID NO: 97904 - DNA, 50 bp, homo sapien
atgacattcttaacagaagaaggaasagtgtttgtttagttgaattaggg

SEQ ID NO: 97905 - DNA, 50 bp, homo sapien
accttgtggtggtatcaagtagtaamtagtaattgaagaaatgagcactt

SEQ ID NO: 97906 - DNA, 50 bp, homo sapien
ttatgaatctcatcagatttcggaaygtgctgatctcagaggtgagggca

SEQ ID NO: 97907 - DNA, 50 bp, homo sapien
actcgatctgggctctatggagtgayaaaattatgcaaaaaaaaaatgaa

SEQ ID NO: 97908 - DNA, 50 bp, homo sapien
agtaaactattgtacaaatagcccaytgaagttcactaaaatgggaaagg

SEQ ID NO: 97909 - DNA, 50 bp, homo sapien
acctcatgcatgctactgctgctaargtagatgagtagagactgagtaaa

SEQ ID NO: 97910 - DNA, 50 bp, homo sapien
gcctgatactcaaaaacaatgagaamaagaccatttaaaaaatatcagct

SEQ ID NO: 97911 - DNA, 50 bp, homo sapien
ttccacaaagtgataaaaggattaaygtgagatcatgaatttgaaagtgg

SEQ ID NO: 97912 - DNA, 50 bp, homo sapien
tgatatataacaaacagaacctattraagtgtatcatttgatatgttttg

SEQ ID NO: 97913 - DNA, 50 bp, homo sapien
ggttctcaactctttggtttcaagamcattgaatgcttaaaaatgatcgg

SEQ ID NO: 97914 - DNA, 50 bp, homo sapien
gcttggagataaaggggatattctcrctactatttccctctactgtggct

SEQ ID NO: 97915 - DNA, 50 bp, homo sapien
gtgcagctctccttgatgactctcckcataggtttaacaaagtaagaatg

SEQ ID NO: 97916 - DNA, 50 bp, homo sapien
gtccccccaacacaagccgctttgcygtgctgattgcttcacactgaggg

SEQ ID NO: 97917 - DNA, 50 bp, homo sapien
tgaaacatacttattttcagcatctktgagattatttcattatttctagc

SEQ ID NO: 97918 - DNA, 50 bp, homo sapien
aagtacaagaacaaaaagtttcctcwctgggaagtggaagaatggaggaa

SEQ ID NO: 97919 - DNA, 50 bp, homo sapien
attttacataaacaactcacaagatraactgaaattctcattctttacct

SEQ ID NO: 97920 - DNA, 50 bp, homo sapien
gaggctggtctctgtagccctagackcaggattttacttgcagactaaga

SEQ ID NO: 97921 - DNA, 50 bp, homo sapien
gttagggagtatagcaggactgttakagaccattatctcttttgctttgg

SEQ ID NO: 97922 - DNA, 50 bp, homo sapien
aagttaaatttacctaatgtttattrtataccagatgtgatgctaagaca

SEQ ID NO: 97923 - DNA, 50 bp, homo sapien
acactgtgaatacactaaatatcaaygactgtatgctttaaatgattaat

SEQ ID NO: 97924 - DNA, 50 bp, homo sapien
ccttgttactccactagacactgacragattaaacttcaagcacaatctc

SEQ ID NO: 97925 - DNA, 50 bp, homo sapien
cattctcttccctcctttgatgtagmaattatggagtttttaaaattggc

SEQ ID NO: 97926 - DNA, 50 bp, homo sapien
acctcaagtttgaattccagtgaaaracccttagctagtctctgtgaatc

SEQ ID NO: 97927 - DNA, 50 bp, homo sapien
ggtttcatatgacttaatctattctyaaacctccctaaattatcagccct

SEQ ID NO: 97928 - DNA, 50 bp, homo sapien
gaaaccacatttcatggaattgaaartatgccaagtgtgaaaaatattcc

SEQ ID NO: 97929 - DNA, 50 bp, homo sapien
ttttcttctgtcttagcttttccaamattagttccttgactagaacggca

SEQ ID NO: 97930 - DNA, 50 bp, homo sapien
tttattgaagaaagtcccaggaatgwataatttctaacatcaaattgaga

SEQ ID NO: 97931 - DNA, 50 bp, homo sapien
cactgaattatctctttagcaaatamctttttaataaatccatccataaa

SEQ ID NO: 97932 - DNA, 50 bp, homo sapien
tattttcttcgcataaattcttagargtgaagtggagtcaaaggattata

SEQ ID NO: 97933 - DNA, 50 bp, homo sapien
gttttgctccctgttagatagtaaamcatataagggaacaaatctttatt

SEQ ID NO: 97934 - DNA, 50 bp, homo sapien
ttgttcttcttttattaaatcacccrcaggacaaccggatgctccagcaa

SEQ ID NO: 97935 - DNA, 50 bp, homo sapien
ttttgtttttgttttcttgccttgakatatgaggctgtaccgttcacagc

SEQ ID NO: 97936 - DNA, 50 bp, homo sapien
gaacttatctagatcataagaaaacrgaatatcttatcggtaacaatacc

SEQ ID NO: 97937 - DNA, 50 bp, homo sapien
tgtttctttcacatcttctgaacttygacttcgcactttgttgctgattt

SEQ ID NO: 97938 - DNA, 50 bp, homo sapien
attaattgcttcaagcagaatatccraatgactaattttaatatcaatat

SEQ ID NO: 97939 - DNA, 50 bp, homo sapien
taggacaactctatatctgatgaccrccatgaggggcttaatgacctctg

SEQ ID NO: 97940 - DNA, 50 bp, homo sapien
tcctatactcatcatgcaaggtagaraaaattcagttggcttctactgaa

SEQ ID NO: 97941 - DNA, 50 bp, homo sapien
agtgatcctcccacctcagcttctcraatagttgtgtctacaggcgcgtg

SEQ ID NO: 97942 - DNA, 50 bp, homo sapien
aagtaaggtatctctattaatgatayatttctgtgttctcaagacctacg

SEQ ID NO: 97943 - DNA, 50 bp, homo sapien
acttggcccaggtttgaataaagccwccttgaccagtaaaaattattgct

SEQ ID NO: 97944 - DNA, 50 bp, homo sapien
aatatatatttggtctctgctctcamcttcttttgtcccatagtgaggac

SEQ ID NO: 97945 - DNA, 50 bp, homo sapien
ggccacaggccacacatgccagatgkgtcatctcatacaggagggtggga

SEQ ID NO: 97946 - DNA, 50 bp, homo sapien
ttgttagtttcctatctctgctataraaagacttgaatatttcattagac

SEQ ID NO: 97947 - DNA, 50 bp, homo sapien
tgataattaccttcatatatcttaayattcccctagacataaacactgta

SEQ ID NO: 97948 - DNA, 50 bp, homo sapien
ttatccttctacactcagctcaagtyttcactgaccccaagtacaatcta

SEQ ID NO: 97949 - DNA, 50 bp, homo sapien
ccaaggtgtttttaaacctgataatkaccttcatatatcttaatattccc

SEQ ID NO: 97950 - DNA, 50 bp, homo sapien
acacagaccacaccatttaggctccraaacaattttcatacatgcttgaa

SEQ ID NO: 97951 - DNA, 50 bp, homo sapien
tctgaatcatctgcttttaaatttakgagatgagatttcctttcagtggt

SEQ ID NO: 97952 - DNA, 50 bp, homo sapien
gcatggttgaggatgacaaaagacaytggatcaaacaatatctcccacag

SEQ ID NO: 97953 - DNA, 50 bp, homo sapien
actgagtggtttcctgttctgctaartatcttcctcccttcctgattttc

SEQ ID NO: 97954 - DNA, 50 bp, homo sapien
ttagcaaagtgtagaaatagcaaacygtagaacaataactacagcttttc

SEQ ID NO: 97955 - DNA, 50 bp, homo sapien
gtgtgctttcaattagattcaggaaraaatatgtccatgacactgctcta

SEQ ID NO: 97956 - DNA, 50 bp, homo sapien
agcacctgaaacaacacattttctayatgcaatgccctctggtatttctt

SEQ ID NO: 97957 - DNA, 50 bp, homo sapien
ttgaaatgctgctcatgaccaattawgttgatttaaaaatattgtgttga

SEQ ID NO: 97958 - DNA, 50 bp, homo sapien
ttttctagaactatttaataaaatargaaccttagcactctaaccatcca

SEQ ID NO: 97959 - DNA, 50 bp, homo sapien
cacgaggaaaaaataactcagggacsagaaataagggtcaggactcaaag

SEQ ID NO: 97960 - DNA, 50 bp, homo sapien
ttgtatgcttgtatcaaaagttcaamtatacttcataaatgtgtacagct

SEQ ID NO: 97961 - DNA, 50 bp, homo sapien
ccactcacctgctgggcaccagggawaccaaaaaaatcaatctcttgacc

SEQ ID NO: 97962 - DNA, 50 bp, homo sapien
tttatacataaaaggtgagtcaacaratacaggttaggtgacacagagtg

SEQ ID NO: 97963 - DNA, 50 bp, homo sapien
gcaaattctacttccaatcgatcaamgttattaattctgtccctctctaa

SEQ ID NO: 97964 - DNA, 50 bp, homo sapien
atttgcctttttattctacttggaarctctgctgataaagctgtttaagg

SEQ ID NO: 97965 - DNA, 50 bp, homo sapien
tcaaaggcccaggttccatctcttayagagctgacaattttcatataaac

SEQ ID NO: 97966 - DNA, 50 bp, homo sapien
tacatactcagtagatggttataatsaaaaaatgacacatcataataagt

SEQ ID NO: 97967 - DNA, 50 bp, homo sapien
cctcttcagtacatacataggaggasattcctgattgtttaacatttttt

SEQ ID NO: 97968 - DNA, 50 bp, homo sapien
ctcctggcttgtccataaaaagagasgtatagcagtaagaatactctctt

SEQ ID NO: 97969 - DNA, 50 bp, homo sapien
acctctgagcactaaactgtggaaartcggctggctctcataccagtgag

SEQ ID NO: 97970 - DNA, 50 bp, homo sapien
gaagtaaaaggcattttaatccttamgaagtttaacagaaaaaaaaaaaa

SEQ ID NO: 97971 - DNA, 50 bp, homo sapien
aggcaggtagcagcaggtgaaaagcrctagaatgttggacagtaattaag

SEQ ID NO: 97972 - DNA, 50 bp, homo sapien
acattttatctactaaacttattaamagtcatcatgattaaacaatctct

SEQ ID NO: 97973 - DNA, 50 bp, homo sapien
tgaaaagtctcacagtgtaggtaaaycaaacttaaatatcataactctat

SEQ ID NO: 97974 - DNA, 50 bp, homo sapien
tcaagaacacaaacctgaatgtcaartaccatgaatcctaatttattcaa

SEQ ID NO: 97975 - DNA, 50 bp, homo sapien
tttaaatcaaagtagctagaactaaygtactcctgaataacataatagag

SEQ ID NO: 97976 - DNA, 50 bp, homo sapien
cccaagcaaatggagaagaaggtgartatggtgaacataagttgtgaaag

SEQ ID NO: 97977 - DNA, 50 bp, homo sapien
cctaattgctgacttcatggtattasgaatgaggcctttgggtggtgcta

SEQ ID NO: 97978 - DNA, 50 bp, homo sapien
tagtagcagaaggctattgtgtaaaycgaagcaaaaattttaagaaatgg

SEQ ID NO: 97979 - DNA, 50 bp, homo sapien
cttttgcccaaatattttcttataargagtcctgaagcttcctgtggaga

SEQ ID NO: 97980 - DNA, 50 bp, homo sapien
cacaaacaaaaagatagccaattccrgactagaatctagtttccgtgact

SEQ ID NO: 97981 - DNA, 50 bp, homo sapien
ggttggtaccatttctgcttaatacwacttacttcaaattctgtattttc

SEQ ID NO: 97982 - DNA, 50 bp, homo sapien
ctttaactcattcccctggtagagcrctgtgaaaaataagaaattgaaga

SEQ ID NO: 97983 - DNA, 50 bp, homo sapien
taacattgttgagcacttgcgctaakcattttattagatgctctacattt

SEQ ID NO: 97984 - DNA, 50 bp, homo sapien
gaatactattggataaatcctgtagsaactagtttcagtaaacagaagta

SEQ ID NO: 97985 - DNA, 50 bp, homo sapien
atagctaagaggtttctgagttagawtaccaatgccaaaatcttctatga

SEQ ID NO: 97986 - DNA, 50 bp, homo sapien
aagcagaatacacttctttggaaacycagagtcagatacttatttaacat

SEQ ID NO: 97987 - DNA, 50 bp, homo sapien
taaaccttaaaggaacctaaacttayacctgtaatgaaggccctctctct

SEQ ID NO: 97988 - DNA, 50 bp, homo sapien
taaaccatcgtgtattactatacttsaagggctgtgacctggaaaatcac

SEQ ID NO: 97989 - DNA, 50 bp, homo sapien
gaggtgatgaacttgaactgaagagsaaggcatttgagagggagatttct

SEQ ID NO: 97990 - DNA, 50 bp, homo sapien
atgtagcactaccgtgctagttttasaatgctggtaatttctttactaaa

SEQ ID NO: 97991 - DNA, 50 bp, homo sapien
gtgtttgtcccttccagaggaaacartgtttaaggcaccatcttggaagc

SEQ ID NO: 97992 - DNA, 50 bp, homo sapien
cttgcttgccttgtcaggtgatccartgaatgttgggaccatcttcatga

SEQ ID NO: 97993 - DNA, 50 bp, homo sapien
ttgattaaaaagagagtttccaccamattttaatggaacgagtagattgt

SEQ ID NO: 97994 - DNA, 50 bp, homo sapien
catgccttgctctgtttccttgctcrtctcagatctgccaggatcacaac

SEQ ID NO: 97995 - DNA, 50 bp, homo sapien
actatatgacaaagacaatgaaaacyctggttcctatggcatatagggtg

SEQ ID NO: 97996 - DNA, 50 bp, homo sapien
aaaatgacccccaagtactgaataaktctttgagggttagaattcccaat

SEQ ID NO: 97997 - DNA, 50 bp, homo sapien
aacaatgttagtagaaaatgaattayatataacagcaggataggtctaac

SEQ ID NO: 97998 - DNA, 50 bp, homo sapien
cattgctgattgaatctgaatgaaargtatgggagtcaaagatctgatgt

SEQ ID NO: 97999 - DNA, 50 bp, homo sapien
gtttgcttgttctggtgaataaaaaygctcctaattttagtagtaggttt

SEQ ID NO: 98000 - DNA, 50 bp, homo sapien
aaaaactgaagatatagacatataarctgaagatgtatatgaagatattt

SEQ ID NO: 98001 - DNA, 50 bp, homo sapien
ggttaatgaatgtgaaacattcaatragacatgaataaacatgaagtgga

SEQ ID NO: 98002 - DNA, 50 bp, homo sapien
gaaaggtaggaagctgtgaaaagcaytgaagaggaactaaaaaagagttc

SEQ ID NO: 98003 - DNA, 50 bp, homo sapien
aatataaatctaatatgtccagaacraatcccttattcttattctattcc

SEQ ID NO: 98004 - DNA, 50 bp, homo sapien
atttgttatgaagacatgtttgttaygttagatgacgtttgaccaataga

SEQ ID NO: 98005 - DNA, 50 bp, homo sapien
cttgccaaaacctgcagtgctcaaaygagtatccccttaacatttcataa

SEQ ID NO: 98006 - DNA, 50 bp, homo sapien
attatccctcagatatatttcaacastaaaatttagcgataagtccctac

SEQ ID NO: 98007 - DNA, 50 bp, homo sapien
gggaaaacatttagtcccattgtaargattggaaagaaaaggaaaagaga

SEQ ID NO: 98008 - DNA, 50 bp, homo sapien
tttaggtgggagttggaagggtgtayagagaacaacagcatgttacattt

SEQ ID NO: 98009 - DNA, 50 bp, homo sapien
acaattgtttgatgcttaatcttgayattaaaacctaaaacactactttc

SEQ ID NO: 98010 - DNA, 50 bp, homo sapien
agttgatggtttaacattgattttamgattataagccctggtgctagact

SEQ ID NO: 98011 - DNA, 50 bp, homo sapien
cttggaacctacaaattccgtttaaytgataaataggaacagatcattgg

SEQ ID NO: 98012 - DNA, 50 bp, homo sapien
atctttcctgtccccatgcaggttcragttagccgccttgccttgagtgt

SEQ ID NO: 98013 - DNA, 50 bp, homo sapien
cttccttgttctggtggagcccatcyatcagtactttccttggaaagggt

SEQ ID NO: 98014 - DNA, 50 bp, homo sapien
agttttatcctcttgattgcaggaasagttcttataacaagggcaaatca

SEQ ID NO: 98015 - DNA, 50 bp, homo sapien
tgcctcataaattgcaaaacctaatraaagtgactgcttggtaaacaaat

SEQ ID NO: 98016 - DNA, 50 bp, homo sapien
ggttttcaaaagcaacctgtgtggcratatgattagttacaaccaggcaa

SEQ ID NO: 98017 - DNA, 50 bp, homo sapien
gaattaagttgtgggtgtctcttaaygtatacttagcttgaaggaaaaca

SEQ ID NO: 98018 - DNA, 50 bp, homo sapien
ggtctagactgacttctaatgactarctcaaagtcaaggcaactgagtaa

SEQ ID NO: 98019 - DNA, 50 bp, homo sapien
ccaaggaggttaaagacttatacacrgcaactttaattcttttacatcta

SEQ ID NO: 98020 - DNA, 50 bp, homo sapien
aatgagtgaactgactgtggctacawtcttgaagatatacggaagagacg

SEQ ID NO: 98021 - DNA, 50 bp, homo sapien
acccagccaaagcaaaatgatctttrtgtgactcttttgataactaagtc

SEQ ID NO: 98022 - DNA, 50 bp, homo sapien
aaataggcagaccaatggaaccaacrataacttcaggaaaggacccagat

SEQ ID NO: 98023 - DNA, 50 bp, homo sapien
ccctctggtgactacctgtgtttccragtcctttgttagtcaatcagcca

SEQ ID NO: 98024 - DNA, 50 bp, homo sapien
aatcctaaaatttatatgaaaatgcwagagacctaaaatatgtaaaacaa

SEQ ID NO: 98025 - DNA, 50 bp, homo sapien
ttcaactggttcgttctacttggatyacctgccacctctttctccaaccc

SEQ ID NO: 98026 - DNA, 50 bp, homo sapien
caatgaggcaatctatttttagcacrcagtgaagtttggctcaaaattta

SEQ ID NO: 98027 - DNA, 50 bp, homo sapien
ttcaacatttattgaccatccacaaygtgcaggatacaacagcccaggag

SEQ ID NO: 98028 - DNA, 50 bp, homo sapien
gttgataagtattgctaatttgtacyccatagaatttgtagtcatttgct

SEQ ID NO: 98029 - DNA, 50 bp, homo sapien
ctttcacctcaaagagtgcataaccyaagagagagataagttatctgttt

SEQ ID NO: 98030 - DNA, 50 bp, homo sapien
gttcttaaagcaccaaagaacatatrtataaaggaccttgagttgatgat

SEQ ID NO: 98031 - DNA, 50 bp, homo sapien
taaatgctttgtttattctgaagtakaagatttcactctggatgtcgagt

SEQ ID NO: 98032 - DNA, 50 bp, homo sapien
tttctaacagagaaaatgctctaatytgaaagaaaaagtctgcatctctc

SEQ ID NO: 98033 - DNA, 50 bp, homo sapien
catggcctgtgtcctggatagctggmaactctaaataaaaagagcctaca

SEQ ID NO: 98034 - DNA, 50 bp, homo sapien
gatatttaaattacaatttcatggcrgactctgaagaaaggaggaggggt

SEQ ID NO: 98035 - DNA, 50 bp, homo sapien
ttggagactctgaagggttgaagtgmacccagaagatacagcttatcacc

SEQ ID NO: 98036 - DNA, 50 bp, homo sapien
cagagtagccaatttagtaagccacrggtaccaataattactagttatta

SEQ ID NO: 98037 - DNA, 50 bp, homo sapien
agcagtattttcagagaaaagtataraagaacagatgaaatcacacaaga

SEQ ID NO: 98038 - DNA, 50 bp, homo sapien
ctcctgtgcttgcaggaaaggagatwatagattttggaagaccaggcaat

SEQ ID NO: 98039 - DNA, 50 bp, homo sapien
gccttttatcttttattgctctcccrgactgtgacttgaattcattcttt

SEQ ID NO: 98040 - DNA, 50 bp, homo sapien
tttttttattaaaagtatgactcacrcttgggacttaatagaaagcacca

SEQ ID NO: 98041 - DNA, 50 bp, homo sapien
cagttttcatttgggcatatgctttrttatgtatgcatacaggcacataa

SEQ ID NO: 98042 - DNA, 50 bp, homo sapien
tggtggtgtttcagatgcttctaaarataccaagtcatattgttttttaa

SEQ ID NO: 98043 - DNA, 50 bp, homo sapien
agacctagttgcaaaagaatggttgraacttagaggaaaagtcaagtcta

SEQ ID NO: 98044 - DNA, 50 bp, homo sapien
agaaaagcactcattaataggtatayggaaactagatattgctgcttttt

SEQ ID NO: 98045 - DNA, 50 bp, homo sapien
cagatttcacaagtctcatttgtctktgatccctgaagcaaccactttcc

SEQ ID NO: 98046 - DNA, 50 bp, homo sapien
tggctactaacttgattctgactgawattattacttatacttttgaactg

SEQ ID NO: 98047 - DNA, 50 bp, homo sapien
tatgattattaagctgaaaattataraagggtatatacatactttacctg

SEQ ID NO: 98048 - DNA, 50 bp, homo sapien
tatgcagttgcccacagctataggtkactagatgttcgagctcccaggtc

SEQ ID NO: 98049 - DNA, 50 bp, homo sapien
tgagatcggcctagaagaacaacatkaaatgggatgacaaacataattgt

SEQ ID NO: 98050 - DNA, 50 bp, homo sapien
acatgttttaaaatgttcttcaggcmtaataggtgcagttcattgttgta

SEQ ID NO: 98051 - DNA, 50 bp, homo sapien
cccaaagagaacaccaagtaattgcrgcaatgccacagcagaaagaacct

SEQ ID NO: 98052 - DNA, 50 bp, homo sapien
ccgttttctagagagccctgctcttwaaaaacgtggaaagaactcttggt

SEQ ID NO: 98053 - DNA, 50 bp, homo sapien
ctggtggttgtcaaaacctgcagcgyataaaaatcacctaggagtcttgt

SEQ ID NO: 98054 - DNA, 50 bp, homo sapien
atacttccatgaaaagaaaattatcrcatctcaaatataaaatttgctta

SEQ ID NO: 98055 - DNA, 50 bp, homo sapien
gctacacagtcttgatttagagggamccggactttgacattttctaattc

SEQ ID NO: 98056 - DNA, 50 bp, homo sapien
cctagacaacatactattctccttarcattcctttatgtgtgctcacaat

SEQ ID NO: 98057 - DNA, 50 bp, homo sapien
ggagttgatggagatatttttaggcrgacattaaagttcctcttctgatg

SEQ ID NO: 98058 - DNA, 50 bp, homo sapien
aaatgaagtctgaaatgggaactaayttactgagagcctaactcatggag

SEQ ID NO: 98059 - DNA, 50 bp, homo sapien
agggtttgaaacatcaggaattcaawgatagataatgtttttatatattc

SEQ ID NO: 98060 - DNA, 50 bp, homo sapien
tttttgaacagtttcacctaacaaaktatttctataaaacttaatgacca

SEQ ID NO: 98061 - DNA, 50 bp, homo sapien
tcaacactagatatctacacttagawaaattgtgagcaaataatgagtaa

SEQ ID NO: 98062 - DNA, 50 bp, homo sapien
tccctggtcttagagtctgatcttayggtgatattggtctcttctaaatc

SEQ ID NO: 98063 - DNA, 50 bp, homo sapien
tctgagtctagatgattatattggarctaaatttgtggtatcagaaatca

SEQ ID NO: 98064 - DNA, 50 bp, homo sapien
aaaaaaaaaacaaaaaaaaaaacackatgtctcatgtctcatttctcact

SEQ ID NO: 98065 - DNA, 50 bp, homo sapien
taggtttttttgttaccttcaattaragcaaagttatttcagaaatatca

SEQ ID NO: 98066 - DNA, 50 bp, homo sapien
aacatttttcctctttgttttagtawagtaaattcgtggcaaaattcaga

SEQ ID NO: 98067 - DNA, 50 bp, homo sapien
agaaatccaaataatttttgttttargtcatcaaatttgtggcccagcat

SEQ ID NO: 98068 - DNA, 50 bp, homo sapien
tataaaatttagacagtaatttataygctagtttgtttcagaaaaatgtt

SEQ ID NO: 98069 - DNA, 50 bp, homo sapien
taaattcctagtgccttcgagtaaarctgttcatggagcatatttaagac

SEQ ID NO: 98070 - DNA, 32 bp, homo sapien
aaagccagctgtttgaygctcaatggatccag

SEQ ID NO: 98071 - DNA, 50 bp, homo sapien
attgagcttactggattctaaccackcttaatacacaatatcagagaaag

SEQ ID NO: 98072 - DNA, 50 bp, homo sapien
aaaaaaaggtttcatggtcaaataartcttataagtgctatacctgttag

SEQ ID NO: 98073 - DNA, 50 bp, homo sapien
cgcttaatacacaatatcagagaaasgtgctaatactttggaggaatata

SEQ ID NO: 98074 - DNA, 50 bp, homo sapien
ctgggctcaaacctagaaaagggaamtgcatgtcttcttccttatctctc

SEQ ID NO: 98075 - DNA, 50 bp, homo sapien
cagctgctctctggacactaatacayggatcttgacgaagtgcttggagt

SEQ ID NO: 98076 - DNA, 50 bp, homo sapien
aaatgatgcagaggtcgttacgtgaracttgctattgaaagtctgtttgg

SEQ ID NO: 98077 - DNA, 50 bp, homo sapien
atgtacacacacacactgtatataaratattcacatatacagtatatata

SEQ ID NO: 98078 - DNA, 50 bp, homo sapien
actgaaccaatgtacaacaccttaawtgtattgatctcatgacttcctaa

SEQ ID NO: 98079 - DNA, 50 bp, homo sapien
attactttttgattgtgctcatctcrgaagcattgataaaatatccccct

SEQ ID NO: 98080 - DNA, 50 bp, homo sapien
acatggatgttaccaatagcctatartaagcagtccacacattttaatgt

SEQ ID NO: 98081 - DNA, 50 bp, homo sapien
agaaaatgtcacactgtgggataaamtatagccatggaaacagacttatg

SEQ ID NO: 98082 - DNA, 50 bp, homo sapien
tagagaatacatgtcacaaattgacygaaggaaaagatctacctgctaca

SEQ ID NO: 98083 - DNA, 50 bp, homo sapien
aagttgagacaaagaaaaatatataygaaatgttgcaacaagaagactga

SEQ ID NO: 98084 - DNA, 50 bp, homo sapien
agaggatgtagccaatctaggggacrgtaaatgatttttgagaaagatga

SEQ ID NO: 98085 - DNA, 50 bp, homo sapien
gaagcaaatcataatgcaacgcaaarataatttactatacaaaagtacaa

SEQ ID NO: 98086 - DNA, 50 bp, homo sapien
ccagataccccaaaataataaaccarcatttgtatttccaaaacattttc

SEQ ID NO: 98087 - DNA, 50 bp, homo sapien
tttgtttgcttctttgccatgatatsagagtagaataaagagagcagaga

SEQ ID NO: 98088 - DNA, 50 bp, homo sapien
agtcatatatcagaagtttctgcaayagtccaatttatcacaggtattta

SEQ ID NO: 98089 - DNA, 50 bp, homo sapien
gcctgtagcagccctaaattaggtaragacccagcttttgtttgcttttt

SEQ ID NO: 98090 - DNA, 50 bp, homo sapien
aaataattgttgaggaaaataggaaytcagaagtgatcttctaataacga

SEQ ID NO: 98091 - DNA, 50 bp, homo sapien
ttgtatgcacataattcctggacacygtatgggaaatgctcagtgataat

SEQ ID NO: 98092 - DNA, 50 bp, homo sapien
tgccagattttcaggtttattgataytaagttgcacagagtgttttttaa

SEQ ID NO: 98093 - DNA, 50 bp, homo sapien
tggatttgagggagcgggaataggcsagaaagagggacattaaaagtttg

SEQ ID NO: 98094 - DNA, 50 bp, homo sapien
agggatcacctaaaaaccacagagarcaatgtaataggaaactcccttca

SEQ ID NO: 98095 - DNA, 50 bp, homo sapien
tatgtatctcctctggcatagaatayattgtctttttcttgtctaaataa

SEQ ID NO: 98096 - DNA, 50 bp, homo sapien
gctggtagatatccatggatactcargaggaacaattaagctgacattga

SEQ ID NO: 98097 - DNA, 50 bp, homo sapien
ttgcgaggcttcctcttaatccatgkagatttcagaaattctaaaagtga

SEQ ID NO: 98098 - DNA, 50 bp, homo sapien
cttgaaagattagataagttctacaygaaatgcaagggtccagcacttag

SEQ ID NO: 98099 - DNA, 50 bp, homo sapien
taatcatggtctggctagattgttaycaaactctaagtcgtgctgtaaag

SEQ ID NO: 98100 - DNA, 50 bp, homo sapien
ttagtcttaattacaaacctaactgrattattgtcaatattacttagctg

SEQ ID NO: 98101 - DNA, 50 bp, homo sapien
tttatataaagcctcccctaattaayactctccacagacagttctcagag

SEQ ID NO: 98102 - DNA, 50 bp, homo sapien
gaaacacacacacacagttaaagtcygaagcacaaatagatatgggtagc

SEQ ID NO: 98103 - DNA, 50 bp, homo sapien
catatccactgactcctagacataayatgtgtccgtgtgtgtgcttatga

SEQ ID NO: 98104 - DNA, 50 bp, homo sapien
agataatatcatggaacagcgtaatmagatttagagggtggggaatgagg

SEQ ID NO: 98105 - DNA, 50 bp, homo sapien
agagaagggggaaaatattaatttasattcgaaaaaaataaagatgaact

SEQ ID NO: 98106 - DNA, 50 bp, homo sapien
tattcattttcctaaatcctgatacyaatgaagaaaatagactacaatta

SEQ ID NO: 98107 - DNA, 50 bp, homo sapien
attgaaaataaggtattggacgagaygcgacagctcacgcctgtaatccc

SEQ ID NO: 98108 - DNA, 50 bp, homo sapien
gtctacatttttttctgaacgtgtayaactgaaagcacattatttggtga

SEQ ID NO: 98109 - DNA, 50 bp, homo sapien
catcatccaaggaagcaaaaagagtrctgttatcacccctcccctaacct

SEQ ID NO: 98110 - DNA, 50 bp, homo sapien
ccgttcattctgcatggttattaatsagcttacctagacaatcagaagga

SEQ ID NO: 98111 - DNA, 50 bp, homo sapien
caggtttagaatctgagactctacargttagtgaaaagtatgaggggaaa

SEQ ID NO: 98112 - DNA, 50 bp, homo sapien
tatttgaacaaccaatcaggactgasgaccaagtatgaagcagatgagaa

SEQ ID NO: 98113 - DNA, 50 bp, homo sapien
ggcaatgaaagaaggtaatagatacrcagagagaaagatagcaagagaga

SEQ ID NO: 98114 - DNA, 50 bp, homo sapien
tggtaaaactcttatgaaggaatcaygtaaactgcagaatatgagagagg

SEQ ID NO: 98115 - DNA, 50 bp, homo sapien
acagataaattaggagctggtaaaastcttatgaaggaatcatgtaaact

SEQ ID NO: 98116 - DNA, 50 bp, homo sapien
acaaatcctgctggctctacatatayagtatttccgtatccagataaatt

SEQ ID NO: 98117 - DNA, 50 bp, homo sapien
aaagattgtgaatgatttctttcccrcaatagcagttactgtcaacaaac

SEQ ID NO: 98118 - DNA, 50 bp, homo sapien
aaactatgagtttcagggattgagcraaatgcatccagataaacaaaaac

SEQ ID NO: 98119 - DNA, 50 bp, homo sapien
gttttggagaatgactgcctcttcamgattcgggctctggtcttcaatgg

SEQ ID NO: 98120 - DNA, 50 bp, homo sapien
ctctattattataaacacacacctgratgctaatccacaccaaaaacata

SEQ ID NO: 98121 - DNA, 50 bp, homo sapien
cagaggagggagaagtcatagactamcctgctttaggacttccctgagaa

SEQ ID NO: 98122 - DNA, 50 bp, homo sapien
agaaatttaaaagttgagttgagaaytgagatttgcagaatgaagaacag

SEQ ID NO: 98123 - DNA, 50 bp, homo sapien
gccacatctgtaactctcaaattctsaaaactaacatgtctcttttaacc

SEQ ID NO: 98124 - DNA, 50 bp, homo sapien
cctctgactatttagttcacaatgaygttgcccatttctgaattcttaga

SEQ ID NO: 98125 - DNA, 50 bp, homo sapien
ctgagaaagcatgtggcttctgagcmaaagatataaattacacttcagag

SEQ ID NO: 98126 - DNA, 50 bp, homo sapien
tttcaaagttttgaatccagaaatasgaggacttagaaaaaatgatatca

SEQ ID NO: 98127 - DNA, 50 bp, homo sapien
catagctttaattctttcgaaagaartataagttgacagaaaaggtagcc

SEQ ID NO: 98128 - DNA, 50 bp, homo sapien
gctcaggaccagagtcagcctgtaamataccatggtttcagcaccgtcgt

SEQ ID NO: 98129 - DNA, 50 bp, homo sapien
cataaaggagaaaagtgctgcacacygataacatatttataatacagagg

SEQ ID NO: 98130 - DNA, 50 bp, homo sapien
atggaataacctacttctatttaaartgctgagtaggatggggtacatct

SEQ ID NO: 98131 - DNA, 50 bp, homo sapien
ctctatgactctcttcactgaaaaaygttccttgtttaattctattaatt

SEQ ID NO: 98132 - DNA, 50 bp, homo sapien
gagaccaggaaatttgtcttttcaartcatcaaacagttaataccttagc

SEQ ID NO: 98133 - DNA, 50 bp, homo sapien
ctggacaccataaatcataccctatrgttaaaaaatgtacaacagtcact

SEQ ID NO: 98134 - DNA, 50 bp, homo sapien
ttgggtgtgagtcttctgggaagctygtcccttagttgaagtttgaagtt

SEQ ID NO: 98135 - DNA, 50 bp, homo sapien
ctctcagggttattgtgaggactaaycataatatttctggtatggtaggc

SEQ ID NO: 98136 - DNA, 50 bp, homo sapien
ataaaatgtatatcaagtatatcaargagaagagaggaaaataataataa

SEQ ID NO: 98137 - DNA, 50 bp, homo sapien
tctaaatagtgtcttaagacataaawtgtatatcaagtatatcaaagaga

SEQ ID NO: 98138 - DNA, 50 bp, homo sapien
tatgaagtttgattgcaaagagatayaggaagcacttagcacagtgtctg

SEQ ID NO: 98139 - DNA, 50 bp, homo sapien
cttaattttaaatgtattgccttgckaaagaaataatctcaatcacttat

SEQ ID NO: 98140 - DNA, 50 bp, homo sapien
ttctctatcaattaaacccttgtaayaagagaaggataagaaggatggtg

SEQ ID NO: 98141 - DNA, 50 bp, homo sapien
agctatcattataaccacatacagartctacactagaaaccatttccttc

SEQ ID NO: 98142 - DNA, 50 bp, homo sapien
ggggaggcagaagagatttctacatmaaaaggtgcagggagtagaaattg

SEQ ID NO: 98143 - DNA, 50 bp, homo sapien
gaggaacaacacaatggcttcttttygtaaagaggaaggtattggggaag

SEQ ID NO: 98144 - DNA, 50 bp, homo sapien
aaacctcagggacacatgagacttasaatttttagagttgagatttgtta

SEQ ID NO: 98145 - DNA, 50 bp, homo sapien
ggaatgaatgactggtaagtgaatgsaaatggagttaatgaagaaaacat

SEQ ID NO: 98146 - DNA, 50 bp, homo sapien
cccatggtctgtctactttcctacayctctacccctagctaccaccttct

SEQ ID NO: 98147 - DNA, 50 bp, homo sapien
cacttacatactattacaataatgawgctgaagtattttttaggaaaaca

SEQ ID NO: 98148 - DNA, 50 bp, homo sapien
caactccttccttcttcctacactayagtttggttccaaaatcaaacatt

SEQ ID NO: 98149 - DNA, 50 bp, homo sapien
gcagacaaaagatcctcaaaactcamgttgaatctataggagccttcaac

SEQ ID NO: 98150 - DNA, 50 bp, homo sapien
gtagcttagtacttagaattatcccrgaagtgaacaacatcagtaaggtc

SEQ ID NO: 98151 - DNA, 50 bp, homo sapien
aattgtagtaattctcatgtgtcaayggcggggccaagtggagataattg

SEQ ID NO: 98152 - DNA, 50 bp, homo sapien
gttctaaactgaaagcagaaaacagrtatcagccttgggaaacaggccta

SEQ ID NO: 98153 - DNA, 50 bp, homo sapien
gtgcttaattaaaaccttatgcttamacaaacattggtttagttctcaaa

SEQ ID NO: 98154 - DNA, 50 bp, homo sapien
gcctgttgctataataattccttackaatgagactttattaatttgtagt

SEQ ID NO: 98155 - DNA, 50 bp, homo sapien
gatttaatctagaaagtgattgaatyagcactgagtgtagaagctggaca

SEQ ID NO: 98156 - DNA, 50 bp, homo sapien
tttcttctccttttctttctagtaayattttgctttttacaacttttaac

SEQ ID NO: 98157 - DNA, 50 bp, homo sapien
ttgagttcaggatcacagaaagtcayatacccaatttcctgtgcagagag

SEQ ID NO: 98158 - DNA, 50 bp, homo sapien
ttgtctcatttgaaatatctgtactwacaccttgccttggagcagtcacc

SEQ ID NO: 98159 - DNA, 50 bp, homo sapien
cctcatttcccttaaaatgcagagaygtatgaatataaccataaattgaa

SEQ ID NO: 98160 - DNA, 50 bp, homo sapien
gggcattggggaaaggagttagtagratgaaatatgggtgtgtgtgtgga

SEQ ID NO: 98161 - DNA, 50 bp, homo sapien
gaaaactgcagaagttaaactggcaygtttcacctagtacccctaaggta

SEQ ID NO: 98162 - DNA, 50 bp, homo sapien
ctgtggcaccccatgtgaatgctttmtagttagttgagaatattccacac

SEQ ID NO: 98163 - DNA, 50 bp, homo sapien
ttatttctcaattttcctgaatcaaraacaatttatacagttttaaacga

SEQ ID NO: 98164 - DNA, 50 bp, homo sapien
cttattataaaatgttcactggagaraatacagaaagttatgaagaaata

SEQ ID NO: 98165 - DNA, 50 bp, homo sapien
tcaacatcagtgctttcctatcatgrcatagattatgagtttttattctg

SEQ ID NO: 98166 - DNA, 50 bp, homo sapien
tatgttattaactccttccactaacratagcaattgaataaaacagatac

SEQ ID NO: 98167 - DNA, 50 bp, homo sapien
aaattagtgaaccaaaaatagaaatyagatttgtgcaaacatggagaaat

SEQ ID NO: 98168 - DNA, 50 bp, homo sapien
aaggagttaataacataattcgtgasgaagaaagcctggtagaattttaa

SEQ ID NO: 98169 - DNA, 50 bp, homo sapien
aactatactaggtataatagtcttcrcagcctgaaagatctcctgaggtc

SEQ ID NO: 98170 - DNA, 50 bp, homo sapien
ctcatctatactccagaatttcttayaaatcaaaggaagctgatctccag

SEQ ID NO: 98171 - DNA, 50 bp, homo sapien
gggacactgactgatcaaatatctcyggcatttcaaaggcatatggaaaa

SEQ ID NO: 98172 - DNA, 50 bp, homo sapien
agagtggggaggcctggcttgccaamagttcttgtgaaaaataacaaggc

SEQ ID NO: 98173 - DNA, 50 bp, homo sapien
aacaagattaaccctgattgcacggyaaaattacctggagaggttttttt

SEQ ID NO: 98174 - DNA, 50 bp, homo sapien
ctggtaataacaattacaatagttgmaataaggtacactacacatgagct

SEQ ID NO: 98175 - DNA, 50 bp, homo sapien
atttccttttccacaattggcctcaygggctgcaaaatatctctttgcag

SEQ ID NO: 98176 - DNA, 50 bp, homo sapien
agttattaaaaagccatgttaagaaygaatgctgttatttgaatctttgg

SEQ ID NO: 98177 - DNA, 50 bp, homo sapien
tcaatggatggttgcataaagaaackgaggtacacatatacaacaaaata

SEQ ID NO: 98178 - DNA, 50 bp, homo sapien
accttgacttggctttggcattcagyacttcttgatgttctttgtgcaca

SEQ ID NO: 98179 - DNA, 50 bp, homo sapien
atatatcaaatcatcctgttgtatamcttgactataatcaagctttattt

SEQ ID NO: 98180 - DNA, 50 bp, homo sapien
ttgactgtattgactgacaggtcgartatttttttagtagtaatataaag

SEQ ID NO: 98181 - DNA, 50 bp, homo sapien
gcctgcatctgtaagaatggtcatayacagacaaaatcagtggttctcaa

SEQ ID NO: 98182 - DNA, 50 bp, homo sapien
attagaataccaaaatggtgaggaaytagatacctttctaatgtatgtgt

SEQ ID NO: 98183 - DNA, 50 bp, homo sapien
tcataaaatggactggatacaactayaattttgcaggctatttgtttggt

SEQ ID NO: 98184 - DNA, 50 bp, homo sapien
acctatgaaagtgtaaactctggcakatcaacatctttctataacctctc

SEQ ID NO: 98185 - DNA, 50 bp, homo sapien
tgtagtacatacatctattcttttarcatcaaggcttgctgagttgaaaa

SEQ ID NO: 98186 - DNA, 50 bp, homo sapien
catgcattaggcactgttttgttccraggaagatattgcaggagaagcaa

SEQ ID NO: 98187 - DNA, 50 bp, homo sapien
tccttaagggacacttggaaaataawctcagccttatgaatggccaaact

SEQ ID NO: 98188 - DNA, 50 bp, homo sapien
cagcagctgcaacagtgtttgaacaraatgacactaaaaacaaaatttgt

SEQ ID NO: 98189 - DNA, 50 bp, homo sapien
caaagtcttctagagctttggctaayaagagcagaaatctgaatccttgc

SEQ ID NO: 98190 - DNA, 50 bp, homo sapien
tctcttcacgaatatttgggtagagmatagccttaaaatatagagacagt

SEQ ID NO: 98191 - DNA, 50 bp, homo sapien
tgaactaacaagatattcaaagagcyacgaagagaaaatggtcacaacag

SEQ ID NO: 98192 - DNA, 50 bp, homo sapien
ctgatattttacggtgataggtatcmaacaataaacccaagatttggtga

SEQ ID NO: 98193 - DNA, 50 bp, homo sapien
aaacaattccctgaacttacagatayggaaaccggaatctagataagatc

SEQ ID NO: 98194 - DNA, 50 bp, homo sapien
tttttatttcattaaaatataactaygtgaaataagggagcacctatcag

SEQ ID NO: 98195 - DNA, 50 bp, homo sapien
ctctcaagacaccatatgtagaacamgttgcataaatattgatacatcta

SEQ ID NO: 98196 - DNA, 50 bp, homo sapien
agcacaatgttacgcacattttaatragttgcatattttgacctgttgtg

SEQ ID NO: 98197 - DNA, 50 bp, homo sapien
tattttgacctgttgtgtatgcaatyaaacaaccagatcatttacattta

SEQ ID NO: 98198 - DNA, 50 bp, homo sapien
gcttacctaagtaagaaggacagtayttgtgctgaagaaactcctttatg

SEQ ID NO: 98199 - DNA, 50 bp, homo sapien
gtgcattatttattatggtatccaasaagataataacatagcactagaat

SEQ ID NO: 98200 - DNA, 50 bp, homo sapien
tgtccaagaaaaaggcatgatatatytgtctactcctcagtgaggaaaag

SEQ ID NO: 98201 - DNA, 50 bp, homo sapien
tcatgaatacttgcaaagtctcccayaatcacccagttgtggtatccatg

SEQ ID NO: 98202 - DNA, 50 bp, homo sapien
atcaaaatttattaagcaactcctaygtgtttttatacttctagattctt

SEQ ID NO: 98203 - DNA, 50 bp, homo sapien
tgatatcgacctattagaacctgtgraatttgtgtgttacccacttacca

SEQ ID NO: 98204 - DNA, 50 bp, homo sapien
ttcagctctgtctgattttaaattcyatgatgaacccactgtcccatgat

SEQ ID NO: 98205 - DNA, 50 bp, homo sapien
tgcatggaagccaagggaacaagtaragagggatgagttgagctcacacg

SEQ ID NO: 98206 - DNA, 50 bp, homo sapien
tgcttctttcctacagatattatgcrgattcattgaacatgtctttttga

SEQ ID NO: 98207 - DNA, 50 bp, homo sapien
ctccaacggtggtgtaaattttaacscttttgcagaaaaaagtcaaccag

SEQ ID NO: 98208 - DNA, 50 bp, homo sapien
acttgtggtttcttgcacacactackctgtttctagtctccaagatgttg

SEQ ID NO: 98209 - DNA, 50 bp, homo sapien
atatacttcagtttggctggaaaagkatcagatcttcagtaataattgga

SEQ ID NO: 98210 - DNA, 50 bp, homo sapien
attttttctccagatcatcagctaargtgtattctatacatttctgggtc

SEQ ID NO: 98211 - DNA, 50 bp, homo sapien
agaaaacagcatagcctagcgagaargtacgtgatagagtgtcagaacat

SEQ ID NO: 98212 - DNA, 50 bp, homo sapien
tacacaaccttacaatttcatctaawgctgacattttttataatggctag

SEQ ID NO: 98213 - DNA, 50 bp, homo sapien
acttgtcacccttggaagaagttaartgagggtttcttgtgggaagataa

SEQ ID NO: 98214 - DNA, 50 bp, homo sapien
ctgcactaatctgttaacttttccaygagattccaacttctgtcatagaa

SEQ ID NO: 98215 - DNA, 50 bp, homo sapien
aattctaaggctcaaaataactggtraaactgaggttaaaattttcaaaa

SEQ ID NO: 98216 - DNA, 50 bp, homo sapien
tgaagacttctggggcatcattataragtaagtcattttcttaagacatc

SEQ ID NO: 98217 - DNA, 50 bp, homo sapien
accctgccctaatcaccctacaatakgtctgtgtgcctaaattttccttg

SEQ ID NO: 98218 - DNA, 50 bp, homo sapien
ataaagccttaatgtttatgaagaaygcactagagaaggcaactagcagt

SEQ ID NO: 98219 - DNA, 50 bp, homo sapien
cccagaactgccatgaagttaagcartacaaataaggtaggcctgctgga

SEQ ID NO: 98220 - DNA, 50 bp, homo sapien
ttaatcaattttccttagttaatgaygaaaaggcaataagaataacatgc

SEQ ID NO: 98221 - DNA, 50 bp, homo sapien
tagaactctaagcctattaagatcayattaactctaaattaaatgaaatc

SEQ ID NO: 98222 - DNA, 50 bp, homo sapien
catctcttgactaagaggtgacaagyctaagggccaaaggccaattcatg

SEQ ID NO: 98223 - DNA, 50 bp, homo sapien
aagggaaggagcaacagagtgattamcattgactatctgagcaaaataaa

SEQ ID NO: 98224 - DNA, 50 bp, homo sapien
agagaagagatttatgaaatatttargttggagaaatacagaatttggta

SEQ ID NO: 98225 - DNA, 50 bp, homo sapien
caatgaacatggactcttttgtggcrgataataaaaatgtgtaagataat

SEQ ID NO: 98226 - DNA, 50 bp, homo sapien
cgtggccatctgtctgggactttccraggcttccattgtctgtctcagca

SEQ ID NO: 98227 - DNA, 50 bp, homo sapien
aggtcactcagagtaataaatttggyggacataggcaaaataaaaaagga

SEQ ID NO: 98228 - DNA, 50 bp, homo sapien
tttgattccctacacaccaaggatargacactcagtctacatgggaggta

SEQ ID NO: 98229 - DNA, 50 bp, homo sapien
tcctgcaacaaattccctcttaaagrcggagcagattatatacagaaaat

SEQ ID NO: 98230 - DNA, 50 bp, homo sapien
attctctgtagtttacagtctctgarctccggaaaaatctaggcattctt

SEQ ID NO: 98231 - DNA, 50 bp, homo sapien
agagaaaaactgccttgccacaagawgataatttgataaataaggagggt

SEQ ID NO: 98232 - DNA, 50 bp, homo sapien
agaaagttcacaacagaaagaactaygctaacctgataaaagaacatcta

SEQ ID NO: 98233 - DNA, 50 bp, homo sapien
actcaatatgaataggtgacaaaaartaggtgacattggaatcagatata

SEQ ID NO: 98234 - DNA, 50 bp, homo sapien
taccacaatacaactcagcggtgtgsatttactttaatttgttctgttgt

SEQ ID NO: 98235 - DNA, 50 bp, homo sapien
ttgctatccccatcttaagctgaagyaataataatacacagtaaaagtaa

SEQ ID NO: 98236 - DNA, 50 bp, homo sapien
aattaatgggcatgttttaaaggaaygatttcagatggacttctaaaaca

SEQ ID NO: 98237 - DNA, 50 bp, homo sapien
ttgcttcacaatttgaaaaatataawcaatgatgcctccttttttgtggt

SEQ ID NO: 98238 - DNA, 50 bp, homo sapien
atcttcttggacatacaaaattgtgyagctgagtaccttccaaaactgaa

SEQ ID NO: 98239 - DNA, 50 bp, homo sapien
gctgatatttgattcaggaatttgcsgaccgagatgaaatttttgattac

SEQ ID NO: 98240 - DNA, 50 bp, homo sapien
cactgaaatggtctctgactttatcratatccctttaacctttgctggga

SEQ ID NO: 98241 - DNA, 50 bp, homo sapien
atctaaaagaaatttgttttgtctgygaaaatctataactctagatttat

SEQ ID NO: 98242 - DNA, 50 bp, homo sapien
tagcgtgttcttcaactgatggagaraatattagttttataacctgatag

SEQ ID NO: 98243 - DNA, 50 bp, homo sapien
tcaaaaaacctgcttcatagtctcamatgttcatgagatttgctttgcag

SEQ ID NO: 98244 - DNA, 50 bp, homo sapien
tcataggtgagaaaacacaggtgctracaagctaacatagcaagtagtag

SEQ ID NO: 98245 - DNA, 50 bp, homo sapien
ttgacatgcactgacctctcctatamccctcactggagaagggcacagat

SEQ ID NO: 98246 - DNA, 50 bp, homo sapien
cagctgcccaacctccgctttgctawcttggttgcttgtatcttggttgc

SEQ ID NO: 98247 - DNA, 50 bp, homo sapien
atgtaaaagcaaaatactatacgcartcatttaacccatttcccatttgt

SEQ ID NO: 98248 - DNA, 50 bp, homo sapien
tctccttctcagcttttacgaacaawaatcttgtaaataatgtcattaaa

SEQ ID NO: 98249 - DNA, 50 bp, homo sapien
ttcatcatatatttataagtagttaraagaataatgtctagcacagggta

SEQ ID NO: 98250 - DNA, 50 bp, homo sapien
cttcgctccctctcagagactcccargagcactccccaataaatttccta

SEQ ID NO: 98251 - DNA, 50 bp, homo sapien
tcaaaggtggaatcttaaatgtttasagtaattcatattaagttccaggg

SEQ ID NO: 98252 - DNA, 50 bp, homo sapien
ttcctacctctttcataaactgtcasgttaggataataataataactact

SEQ ID NO: 98253 - DNA, 50 bp, homo sapien
cctggctaaaacagaaatgggtcacyaaggctatgtctgctcagcctctc

SEQ ID NO: 98254 - DNA, 50 bp, homo sapien
ccggacttctcctttgggaattaagraatgtagctccaagcaaggttcat

SEQ ID NO: 98255 - DNA, 50 bp, homo sapien
tatagaatactaaataatgttcaaayagtcaaatgaaagcaggaaagggg

SEQ ID NO: 98256 - DNA, 50 bp, homo sapien
aaaagaattcctcatgatattgtcaytctaatttttctaggtcactagag

SEQ ID NO: 98257 - DNA, 50 bp, homo sapien
ttggtcagaacttgaattttccatarctctacccactagttaatagcacc

SEQ ID NO: 98258 - DNA, 50 bp, homo sapien
gaaaactccttatgttggagaggtcyaagagctaatacacttattttaaa

SEQ ID NO: 98259 - DNA, 50 bp, homo sapien
gatctgaccatggtgatagtaaccaygattctttaattcaaggcactgta

SEQ ID NO: 98260 - DNA, 50 bp, homo sapien
tgagccgttgcatcaaattgtcagaycaaacctaaaatgcagcacttcgc

SEQ ID NO: 98261 - DNA, 50 bp, homo sapien
ggataacaagtgattgggctgcttayctttaacccttcagtgttggagga

SEQ ID NO: 98262 - DNA, 50 bp, homo sapien
aaccaagatgtacttaattgtttcckccattcctaatgcaccatgcacgt

SEQ ID NO: 98263 - DNA, 50 bp, homo sapien
aaacagaatctgtacattaattatcyatgcctactgcttacttatctgaa

SEQ ID NO: 98264 - DNA, 50 bp, homo sapien
agtgctggggtgattttatgctcagraagtaaccaaaggctagcaaacat

SEQ ID NO: 98265 - DNA, 50 bp, homo sapien
ccttcttacatattcaataacttgckccataggtgacaggattgaaatgc

SEQ ID NO: 98266 - DNA, 50 bp, homo sapien
tcattaaatttggtgaagccaagtckgactataagaattgtatctctctg

SEQ ID NO: 98267 - DNA, 50 bp, homo sapien
actataagaattgtatctctctggcyctattcaaatttctcttctaaatt

SEQ ID NO: 98268 - DNA, 50 bp, homo sapien
agctttaattcttaatttcgagtggycagaatagagaaatcacataactt

SEQ ID NO: 98269 - DNA, 50 bp, homo sapien
ggagattggagtggggagaaactacrgcaagttaagaatagagtctgggc

SEQ ID NO: 98270 - DNA, 50 bp, homo sapien
agaactgaaatataaagaggtaaaaygtaaaataatctgagtagtagaaa

SEQ ID NO: 98271 - DNA, 50 bp, homo sapien
ccatatcagctttcttaaccataaakccattccaagcgctaacttttgtt

SEQ ID NO: 98272 - DNA, 50 bp, homo sapien
cttttttgttctactttggacaaaayaaaacagatacctgatcaccactc

SEQ ID NO: 98273 - DNA, 50 bp, homo sapien
tttgttttttgtttttaaactcaagwcttcctcatagcatccctttgaat

SEQ ID NO: 98274 - DNA, 50 bp, homo sapien
aaaatgaagacattaaacagaggaarctctaatattctttctacctctgt

SEQ ID NO: 98275 - DNA, 50 bp, homo sapien
atcagcaaattgtcagtgggaaaaaygtatctatattgactgctctcaac

SEQ ID NO: 98276 - DNA, 50 bp, homo sapien
gattagtcatcttgactagatgttcratgaatcgtgctatttacatttaa

SEQ ID NO: 98277 - DNA, 50 bp, homo sapien
aactgaagcctagttgctagataacraaaagctataaatgtttatgtatg

SEQ ID NO: 98278 - DNA, 50 bp, homo sapien
caccgaactcatgacccttaacttawcgtggtctagccaaatgagttttc

SEQ ID NO: 98279 - DNA, 50 bp, homo sapien
tgaatagttatgcaaattagcttcamctctatgtatattatatgtgaaca

SEQ ID NO: 98280 - DNA, 50 bp, homo sapien
agttctgtttccaaccgttagaatcragaattcctataatatccaatttg

SEQ ID NO: 98281 - DNA, 50 bp, homo sapien
tagaaataaacaggaagttgggaatsaaaataacacagagaagaaaagaa

SEQ ID NO: 98282 - DNA, 50 bp, homo sapien
ttttggtggctaggaatgaaacttaygtaggtccatgttcggtatttgat

SEQ ID NO: 98283 - DNA, 50 bp, homo sapien
tgaagtgacagtgataatagaagtcyctgaaaagtcaaatggtgaaatgg

SEQ ID NO: 98284 - DNA, 50 bp, homo sapien
tttgaactggacatagaataccttgrcaaaacacatctgtaaactcagag

SEQ ID NO: 98285 - DNA, 50 bp, homo sapien
tctgtctagcaagtagtgctacccartcaaaacctcatctagatactaga

SEQ ID NO: 98286 - DNA, 50 bp, homo sapien
taaaaccagaagctatccaagggtamaaacaatctatatagcaattatcc

SEQ ID NO: 98287 - DNA, 50 bp, homo sapien
taaagttagtttacaaaggcaattaycgccaacagtaaagattaaagaac

SEQ ID NO: 98288 - DNA, 50 bp, homo sapien
tttagcatttgatgtgtgcttagacraaggaactgaattttataatttat

SEQ ID NO: 98289 - DNA, 50 bp, homo sapien
aggaattcctcaacctgataaaaagwatctatgaaaatcctacagctaac

SEQ ID NO: 98290 - DNA, 50 bp, homo sapien
aatcaacctagctattgtaacttccyacatcttaaataacatgtttttca

SEQ ID NO: 98291 - DNA, 50 bp, homo sapien
aagagataaagttgtcagtcaaagayatttgtgttaaatgagtttcaggt

SEQ ID NO: 98292 - DNA, 50 bp, homo sapien
ttattcagtatccttttgattgttayagcatccccccaaacttataattc

SEQ ID NO: 98293 - DNA, 50 bp, homo sapien
agtagtactgagtggatgggcattayggaagcctgggcatttcttctaga

SEQ ID NO: 98294 - DNA, 50 bp, homo sapien
actacttattctttcctgactatcayctttctacaaacttcccacgtctc

SEQ ID NO: 98295 - DNA, 50 bp, homo sapien
tgtaaacagaagggggaggaaggacyactcatcttcatttcgcatggcat

SEQ ID NO: 98296 - DNA, 50 bp, homo sapien
ggagaactttacttttaaacaatcartagaatatgatttagcagcctact

SEQ ID NO: 98297 - DNA, 50 bp, homo sapien
gagaagaccaattatatgtgtgagaygatctgccatgaactacttggtct

SEQ ID NO: 98298 - DNA, 50 bp, homo sapien
ttaaaaataaagtagaaagaagtcaytcatggaaaaactagtgaaatcca

SEQ ID NO: 98299 - DNA, 50 bp, homo sapien
tcttggttagtcagggcccatataaygtttttacactttaaatatgtgca

SEQ ID NO: 98300 - DNA, 50 bp, homo sapien
caaaaataactgattgagcattccartagtactatgaagattattaacaa

SEQ ID NO: 98301 - DNA, 50 bp, homo sapien
gagaagaagaaggttgtatatacccraaagtctatcgtcagcatagatgt

SEQ ID NO: 98302 - DNA, 50 bp, homo sapien
cattaatcttctattttaatgagtayatgtgataagtaaagcttaactgg

SEQ ID NO: 98303 - DNA, 50 bp, homo sapien
catagcggtgcccacctatgtggaayggtttgaagagtcctcgacagggc

SEQ ID NO: 98304 - DNA, 50 bp, homo sapien
gtagaagcttgaatatttgtacagargtaatatgcaaagaagtagggcaa

SEQ ID NO: 98305 - DNA, 50 bp, homo sapien
acccatactttcaaaattatctgcaygatggaaacgtctacggcatttta

SEQ ID NO: 98306 - DNA, 50 bp, homo sapien
agaattcaaaatcccagcacattacrggctccatggacaggaaaggtctc

SEQ ID NO: 98307 - DNA, 50 bp, homo sapien
gatggctgccaagccacccaagcacractatatccaatggagaagaaggg

SEQ ID NO: 98308 - DNA, 50 bp, homo sapien
gcaggtggaaagatcttcaccttgcyctgatttaaatataagattatagg

SEQ ID NO: 98309 - DNA, 50 bp, homo sapien
caaaggttgccctcctgttgatataygtctgggtgatgagctgccttacc

SEQ ID NO: 98310 - DNA, 50 bp, homo sapien
actcttagccttgcacagagcctaaygtatggaagatggtgtatatttat

SEQ ID NO: 98311 - DNA, 50 bp, homo sapien
cactcaactggtaaccaagatcaaaycactgaatccccagaaagctttct

SEQ ID NO: 98312 - DNA, 50 bp, homo sapien
tgacatattgacattacatacgaaawcaaatggactaatttgtgaccact

SEQ ID NO: 98313 - DNA, 50 bp, homo sapien
acgttacaggattctccagaatagaygacgagtgccatcctttgctgaac

SEQ ID NO: 98314 - DNA, 50 bp, homo sapien
gggaaccatacaaggaatctggttaygtatgggatgaaagagttaagaag

SEQ ID NO: 98315 - DNA, 50 bp, homo sapien
tgacacaccaatcttgaggtaagtargaacctgatttaaggtatttggat

SEQ ID NO: 98316 - DNA, 50 bp, homo sapien
ttgcccactgctatattcactcccayagtgtttgttcttgtgtcttcacc

SEQ ID NO: 98317 - DNA, 50 bp, homo sapien
tggtggcaaagactaattgagaggcyctctgaatactctatgcaaggctc

SEQ ID NO: 98318 - DNA, 50 bp, homo sapien
tattttttttttttttgcttctaaawgtggctgctagggaaccaaaaata

SEQ ID NO: 98319 - DNA, 50 bp, homo sapien
ccatctcaccacataataaatagcckgacagctcaaatttccagccctac

SEQ ID NO: 98320 - DNA, 50 bp, homo sapien
atccaggacttccagaatcacatcasagtattctaccacctcacggactc

SEQ ID NO: 98321 - DNA, 50 bp, homo sapien
gagaagcaaatagcacaccatcctarattttttttcatctatttggccag

SEQ ID NO: 98322 - DNA, 50 bp, homo sapien
tccctgaagttcacaatggttgccartagtcctgggtcaagcatactaaa

SEQ ID NO: 98323 - DNA, 50 bp, homo sapien
caactcaacgaggaataatggctcgygtccacggttctggttgttttctc

SEQ ID NO: 98324 - DNA, 50 bp, homo sapien
acacttttctcctttatttcccaatsttatagacaatgagcaaattgtat

SEQ ID NO: 98325 - DNA, 50 bp, homo sapien
ggataacaaaacatacgcatacataraaatattaggtcacttccctggaa

SEQ ID NO: 98326 - DNA, 50 bp, homo sapien
ggcaatataacatacttgttaaaagmctacattttggagttagacattcc

SEQ ID NO: 98327 - DNA, 50 bp, homo sapien
tgataaagtactcaggatcaaagaakttatttggttgccaggaagaaaaa

SEQ ID NO: 98328 - DNA, 50 bp, homo sapien
gaaaatagcctactgttattaattayattcctgcctactccatttttaat

SEQ ID NO: 98329 - DNA, 50 bp, homo sapien
ctattggttaacaagctgacattaarcatttagattatataaatcacctt

SEQ ID NO: 98330 - DNA, 50 bp, homo sapien
cagtagagagtactatgtaacaatgmagatcagaaaatgtctttggaagc

SEQ ID NO: 98331 - DNA, 50 bp, homo sapien
gagagagagcaagaacaagagccaaytctcagatacagccaagaggagca

SEQ ID NO: 98332 - DNA, 50 bp, homo sapien
aaagacttgcttggtgaaaccagaayatattagagcagaaaagacatctt

SEQ ID NO: 98333 - DNA, 50 bp, homo sapien
tcattttaatattcattcattgatasatttggttacttcagaagaattgg

SEQ ID NO: 98334 - DNA, 50 bp, homo sapien
attacttttgtaagtggatgataaasagtcctacatatttagaatggtat

SEQ ID NO: 98335 - DNA, 50 bp, homo sapien
aacaatggataaatattcctatttayggtggctattctattaacatagac

SEQ ID NO: 98336 - DNA, 50 bp, homo sapien
tgagaacaacatacacttcattgggmaaatcacattttgcctcactagct

SEQ ID NO: 98337 - DNA, 50 bp, homo sapien
cctcacaaaaaaagaatcttgcaaakgtatacagagaaaattatgataat

SEQ ID NO: 98338 - DNA, 50 bp, homo sapien
aatttctatacttccctatggctaaygaatagaaccatcctttaccgatt

SEQ ID NO: 98339 - DNA, 50 bp, homo sapien
aatgtcccgacaaaatagtcgtaaaygttttctccaaatagaacttgtgt

SEQ ID NO: 98340 - DNA, 50 bp, homo sapien
tacattttcccctgtaattccttgarctccttcgtctttgaggatctcac

SEQ ID NO: 98341 - DNA, 50 bp, homo sapien
ttttgcgaagtctcgggtgaaggacrattattttttagacaacaaagaca

SEQ ID NO: 98342 - DNA, 50 bp, homo sapien
tgaatggtcccactcattatgtccaygttgagtacccccatcctttgtcc

SEQ ID NO: 98343 - DNA, 50 bp, homo sapien
tgtaaaggttatcacagttgagtcasacaaggaactttaaggccgctcac

SEQ ID NO: 98344 - DNA, 50 bp, homo sapien
tagagacaggctgtgagaatggagamagttgaggagtgtctctgttagga

SEQ ID NO: 98345 - DNA, 50 bp, homo sapien
aggtccttcccagtatggtccttcargaattatttctttttttgtttttt

SEQ ID NO: 98346 - DNA, 50 bp, homo sapien
atatatatatttttgcaagaaggcayaatttaatcaggattgtctctctc

SEQ ID NO: 98347 - DNA, 50 bp, homo sapien
ggttttggagcaagagtgagagatascttaaattatgccttttggattct

SEQ ID NO: 98348 - DNA, 50 bp, homo sapien
agctttgatcttcattatatcagcaktcaaaatacatagatttttttcta

SEQ ID NO: 98349 - DNA, 50 bp, homo sapien
aatagcacagtatccattaaactaayctttaaaagcacagggagcagtgg

SEQ ID NO: 98350 - DNA, 50 bp, homo sapien
tcatattaaacctaatttaatctccrgaatttatattttgagattggtag

SEQ ID NO: 98351 - DNA, 50 bp, homo sapien
gcatgttcataattgcccattgaaasattttttacatggctactctaaaa

SEQ ID NO: 98352 - DNA, 50 bp, homo sapien
tacctagaaagcctaaataaaatcargagtcttataatgtaatatgaaaa

SEQ ID NO: 98353 - DNA, 50 bp, homo sapien
gtcttatttatcaattaccaatatcwactcagtaaatgactggtcccctt

SEQ ID NO: 98354 - DNA, 50 bp, homo sapien
ggcaaccagttgctggttatttttartagagctcaacattataaagatca

SEQ ID NO: 98355 - DNA, 50 bp, homo sapien
ttcagtgacatgaggtaaaagatgcrctgtcaaaattgcagtgtctctaa

SEQ ID NO: 98356 - DNA, 50 bp, homo sapien
tgcaactaaattattgattctgctgraaggttatatgagtttatgcacta

SEQ ID NO: 98357 - DNA, 50 bp, homo sapien
aggatggagattcctacctccagaaratgactgtgccatacctatgcttt

SEQ ID NO: 98358 - DNA, 50 bp, homo sapien
tacttctggccccatggatagccaaygtttctattggagccttcatagga

SEQ ID NO: 98359 - DNA, 50 bp, homo sapien
tgtcagatgggttgaggtgccatgaraataaactccaccctcgtattgct

SEQ ID NO: 98360 - DNA, 50 bp, homo sapien
tctttgcagagaatctaggtgactawaagtatccatgagaatagaagtat

SEQ ID NO: 98361 - DNA, 50 bp, homo sapien
tattgacttactgtcagataggtagraatgaacttaaattcaatgtgaaa

SEQ ID NO: 98362 - DNA, 50 bp, homo sapien
ataataattgacatataccttggagrccatttggaatctccataaacgaa

SEQ ID NO: 98363 - DNA, 50 bp, homo sapien
ttctatttataccctaccaacttcarcttgttcaatagactgcttacaaa

SEQ ID NO: 98364 - DNA, 50 bp, homo sapien
cccactggtggtggctaggactgackgaagaaataccgcactttaactgt

SEQ ID NO: 98365 - DNA, 50 bp, homo sapien
aaccccccaccgtaaacactcatcasggtcagaagtattttcagatagtt

SEQ ID NO: 98366 - DNA, 50 bp, homo sapien
taaagaagagatagcacatgaaatasagtcaaccacaggttagattatct

SEQ ID NO: 98367 - DNA, 50 bp, homo sapien
aaagccaggactcgcagggctgctcyacccacaataatgaaccactatct

SEQ ID NO: 98368 - DNA, 50 bp, homo sapien
tactatcttgatgaggtaatacagcrctcacaaactgagaaaggtcttga

SEQ ID NO: 98369 - DNA, 50 bp, homo sapien
tcaacagttctgactaattcaactartccctaacctttctattttatttt

SEQ ID NO: 98370 - DNA, 50 bp, homo sapien
cttcatgtttctccttcttggaccartgatctcccagggcgtgtccttgt

SEQ ID NO: 98371 - DNA, 50 bp, homo sapien
tgaaattaaaatataactagccatcytgtattttatccagcaaccctact

SEQ ID NO: 98372 - DNA, 50 bp, homo sapien
gcatcttatttatgtcaaaagacgasaaacgaaggccatttttggcattg

SEQ ID NO: 98373 - DNA, 50 bp, homo sapien
aggaatctgggtatcatggcccaaayaaattgacaaaaatgttaactatt

SEQ ID NO: 98374 - DNA, 50 bp, homo sapien
aaaggtgggggaaggaaaatgatatraataatgtgaatagacagaataag

SEQ ID NO: 98375 - DNA, 50 bp, homo sapien
tcccctgagcctatgtagtccttgasagaaagatagaattgttgcttata

SEQ ID NO: 98376 - DNA, 50 bp, homo sapien
aggcagaaacaagtatggataatcargaatggtcacttgggtcaaattcc

SEQ ID NO: 98377 - DNA, 50 bp, homo sapien
tacactatgggcaatgggtatgtctsaaaattcttaaacatgatttgtat

SEQ ID NO: 98378 - DNA, 50 bp, homo sapien
ctagatattgtgggactgcccgcaartaagtcataaacattggtacttac

SEQ ID NO: 98379 - DNA, 50 bp, homo sapien
caaaagcaatttggccatggagatamatttgcaatcaccagcaactaaaa

SEQ ID NO: 98380 - DNA, 50 bp, homo sapien
gagggactaaaactgagcacgatgcygaaatgacgggagcagaccattct

SEQ ID NO: 98381 - DNA, 50 bp, homo sapien
agggtttgcatattttagatttttakaggtcttgccaaattgccctccag

SEQ ID NO: 98382 - DNA, 50 bp, homo sapien
attttaaagaaactgcaaggtataaratgactcaggtcaacaataacaaa

SEQ ID NO: 98383 - DNA, 50 bp, homo sapien
atttaaatgttagtttttcttaatcrattcttgtatgaataagggaaggt

SEQ ID NO: 98384 - DNA, 50 bp, homo sapien
caataacaaaaaagatttctccacayagataatagataagacattcggta

SEQ ID NO: 98385 - DNA, 50 bp, homo sapien
ctcccatgctattttctcagcattamggaaacccaacaatgtctaaacag

SEQ ID NO: 98386 - DNA, 50 bp, homo sapien
aagttgacttgatctctcccttgaartgcatatgctaatatgacccctgg

SEQ ID NO: 98387 - DNA, 50 bp, homo sapien
taatctctatttggtttcaaaaggaraatttctaatcatcccaaagaaaa

SEQ ID NO: 98388 - DNA, 50 bp, homo sapien
tactggactaggtgacaactatgaayacttttagtctgtttgagaggaaa

SEQ ID NO: 98389 - DNA, 50 bp, homo sapien
ttctttctttctttatggacagaacrgtataaacataggcaggcttattt

SEQ ID NO: 98390 - DNA, 50 bp, homo sapien
aaaagctttttggttttctagctaartaggcttcttcttcactgggcctt

SEQ ID NO: 98391 - DNA, 50 bp, homo sapien
cttccccatgatttacttcagttgaragttcagccagatccattattttc

SEQ ID NO: 98392 - DNA, 50 bp, homo sapien
aatagtcttctcttcgcctgtattgyaagtatgaacatcagaatggctca

SEQ ID NO: 98393 - DNA, 50 bp, homo sapien
tttaaactatgagtcaagtattctaygatattgcccttggattgaacaaa

SEQ ID NO: 98394 - DNA, 50 bp, homo sapien
catcttgctgttgatttatatataawctgtactcacatgttcagaaggag

SEQ ID NO: 98395 - DNA, 50 bp, homo sapien
aactcattcacttgaaaaacacttaytaaaatctcactatatgctaggca

SEQ ID NO: 98396 - DNA, 50 bp, homo sapien
gagggaaagccatttgtaaacagtaygttgcttttcaaatataaaatgtt

SEQ ID NO: 98397 - DNA, 50 bp, homo sapien
acacatgtgtgcttgtacttttaacraggttccatcctaaaacaaagtca

SEQ ID NO: 98398 - DNA, 50 bp, homo sapien
taatcctttattattttattgatgcyaaaattactgatagaaaaaaattc

SEQ ID NO: 98399 - DNA, 50 bp, homo sapien
caatctggtaaacttttaagaggcaycctgttctttcccttcatagtgct

SEQ ID NO: 98400 - DNA, 50 bp, homo sapien
agcagtaattctctctttagtacaamttttattggcttttctcccttcac

SEQ ID NO: 98401 - DNA, 50 bp, homo sapien
agcaaaaagccaaggatataaaataygatggaaaagtaaaaaagatatga

SEQ ID NO: 98402 - DNA, 50 bp, homo sapien
tttgccataggatcttgcttagcccrtgcacacagcatcttgccccaagg

SEQ ID NO: 98403 - DNA, 50 bp, homo sapien
tagtaaaacaaaaaacaaaagtagakagtccagtttagaggaggaaaagt

SEQ ID NO: 98404 - DNA, 50 bp, homo sapien
cacattaatgggattagtttccttaytgggagagaccagagagctagctt

SEQ ID NO: 98405 - DNA, 50 bp, homo sapien
cagacggagaattgtcatcctgggartcaaaatcagactaattttttcca

SEQ ID NO: 98406 - DNA, 50 bp, homo sapien
tttactgattaatctcatctaaaaartagtttcacggcaatatagatatg

SEQ ID NO: 98407 - DNA, 50 bp, homo sapien
aaagcaattgagcatcactgatgtgsataccattttctttaggttttaag

SEQ ID NO: 98408 - DNA, 50 bp, homo sapien
tcgtgaagggaccgatcagaagttgkcaacaggccagtgctaaggaataa

SEQ ID NO: 98409 - DNA, 50 bp, homo sapien
ttcagttattgggtatgttttataakgtactactggaatagtacattata

SEQ ID NO: 98410 - DNA, 50 bp, homo sapien
tgcttcattccataaaggatttagaycaaaacagaataaaacagtatgag

SEQ ID NO: 98411 - DNA, 50 bp, homo sapien
aaatagtattctggagggatctaagyctggaaaagttgacatcatatatc

SEQ ID NO: 98412 - DNA, 50 bp, homo sapien
cattaagattcactctttgtattatraagttctatgcgtgttgacatata

SEQ ID NO: 98413 - DNA, 50 bp, homo sapien
aaaggatcagttctgaacattgtgcygattttggagcaaacaaagctcat

SEQ ID NO: 98414 - DNA, 50 bp, homo sapien
tgtatatgtgtttgtatatctgttcrtattctgtctgccttactcatttc

SEQ ID NO: 98415 - DNA, 50 bp, homo sapien
gctatataattttgcatcatgttatrtactgatcacactagagcaacaaa

SEQ ID NO: 98416 - DNA, 50 bp, homo sapien
aaaatggcaaaggaaaagtttaagawcaaatgcataaggaagactgtctt

SEQ ID NO: 98417 - DNA, 50 bp, homo sapien
tttgagtgtttttacatcaaacatcraccttactgtggtacctttagtta

SEQ ID NO: 98418 - DNA, 50 bp, homo sapien
tatctcccttatagtatggttatgargaataatcaggataaaacatgcaa

SEQ ID NO: 98419 - DNA, 50 bp, homo sapien
aaattgccccatgtcaactgtgtacmaattaatccgtgcatattttatag

SEQ ID NO: 98420 - DNA, 50 bp, homo sapien
aactgcaaaacaatgcaattctctayggacaacaaagtacaggatctcct

SEQ ID NO: 98421 - DNA, 50 bp, homo sapien
aaaatattaatttgttgctaaagttraaaattgaagaaatgatttcatag

SEQ ID NO: 98422 - DNA, 50 bp, homo sapien
tttttaaggatcctacatgtcataartctacattaaaaattatttaaaaa

SEQ ID NO: 98423 - DNA, 50 bp, homo sapien
agagcccggttgaatgtggtgcctargaaagtagatgaggtgcagaagga

SEQ ID NO: 98424 - DNA, 50 bp, homo sapien
atagccgagacatgcaacaaaactaytaaatctttagaatttgtgagggc

SEQ ID NO: 98425 - DNA, 50 bp, homo sapien
aaacttggtgtggccatgacagtgamcttgatcttaggttatttaacatt

SEQ ID NO: 98426 - DNA, 50 bp, homo sapien
agattgagtaattttgcacagtgatragtggtatttagttaccttacttt

SEQ ID NO: 98427 - DNA, 50 bp, homo sapien
ccttttgatttttgatccttctataygatacgataatgatccttagaaca

SEQ ID NO: 98428 - DNA, 50 bp, homo sapien
gaagtcgtcattgggttaaccactckcgaaagatgcactaagaagaaaac

SEQ ID NO: 98429 - DNA, 50 bp, homo sapien
agtgctataatccccatgataggaartgggttgcaaggaaatgtggtagc

SEQ ID NO: 98430 - DNA, 50 bp, homo sapien
aaaagcattctataggcactaaataktatgctagaacacctctaagtgct

SEQ ID NO: 98431 - DNA, 50 bp, homo sapien
agaaaatgatgctacttacagcaagygacaagtcaaagaagttacacatt

SEQ ID NO: 98432 - DNA, 50 bp, homo sapien
ggaatttgcgcatagcttatgctgastatgtggaaatttgggatataaca

SEQ ID NO: 98433 - DNA, 50 bp, homo sapien
actctgtgctagcgttcggacataayatttcactgtaggagacatgcctg

SEQ ID NO: 98434 - DNA, 50 bp, homo sapien
taagagaattatgcttgctctgcaayatatgactgcactcacatttgctc

SEQ ID NO: 98435 - DNA, 50 bp, homo sapien
tagacactcaaaaaatattgccttcrcaccatcctgtaagctttatttta

SEQ ID NO: 98436 - DNA, 50 bp, homo sapien
ttttaacaataattgttttgagatcrctgaggcttctgcactacactgaa

SEQ ID NO: 98437 - DNA, 50 bp, homo sapien
cagagtccaaatcgatagctaaacartgtctgtgggatttgaatccccct

SEQ ID NO: 98438 - DNA, 50 bp, homo sapien
atgacttttatgtctcagctaccaasactgtgttctttgatctccttcaa

SEQ ID NO: 98439 - DNA, 50 bp, homo sapien
aaataaagagtaaagcctcactcgcrtatcttacgtagggcagggacttt

SEQ ID NO: 98440 - DNA, 50 bp, homo sapien
taataggatgtgatttaaaaggatgyatgttccttccattcaagaaaaat

SEQ ID NO: 98441 - DNA, 50 bp, homo sapien
atgcaggggccctctagttcgcaatsagcaagaatcgttttatgatcatt

SEQ ID NO: 98442 - DNA, 50 bp, homo sapien
tacatacattctccagtatattgtargctccaagaatacaagaatcttgt

SEQ ID NO: 98443 - DNA, 50 bp, homo sapien
tagtcgttggccctaatgaacaagargtttggaaatacctttatctcccc

SEQ ID NO: 98444 - DNA, 50 bp, homo sapien
gataaacatatttaacagctagaaartgttagatctttaagatatgcagg

SEQ ID NO: 98445 - DNA, 50 bp, homo sapien
cacagctttggagaagaaatggtaamgtgggatgccaagttatttacttt

SEQ ID NO: 98446 - DNA, 50 bp, homo sapien
atagtattatgtagataataaacagyggtcagtttttgttaagatagaga

SEQ ID NO: 98447 - DNA, 50 bp, homo sapien
caataccctgcacattaaatgagaayatacaatttgatgaattttgacat

SEQ ID NO: 98448 - DNA, 50 bp, homo sapien
ttggttctatctgatactaaagaaarcataattaactgaaagttttcaag

SEQ ID NO: 98449 - DNA, 50 bp, homo sapien
tcccaatatttcaaagtagctttgayggtatttagatagcaaactcattt

SEQ ID NO: 98450 - DNA, 50 bp, homo sapien
gtcctcaacatggctgaaaaggcaasgtagctttctggggtttcttttac

SEQ ID NO: 98451 - DNA, 50 bp, homo sapien
gccacagctttatcctggcctacaaygctcatttatactttctttcctgt

SEQ ID NO: 98452 - DNA, 50 bp, homo sapien
tctagaaacagtgggaggaaagttayggagcaaacaaacaaaaacagcca

SEQ ID NO: 98453 - DNA, 50 bp, homo sapien
tgtaccctttgagtacaatccggaayatcagtcagggccctgagcaatgg

SEQ ID NO: 98454 - DNA, 50 bp, homo sapien
ccatatttcgagtggtcatgtatttrtggatttgtttctaaacgcttcat

SEQ ID NO: 98455 - DNA, 50 bp, homo sapien
ccttccattacatggtacaaaagacrgattaagttactacctctcttcct

SEQ ID NO: 98456 - DNA, 50 bp, homo sapien
gtacccaaggcttgaaaactatgagraaaatttagaaactatagtcttaa

SEQ ID NO: 98457 - DNA, 50 bp, homo sapien
gaggcagcatgacactgaaattggtraagatacattaatacttatttaat

SEQ ID NO: 98458 - DNA, 50 bp, homo sapien
ttgccaaaatggcctactcgggacarctcaattgactacttagaaccatt

SEQ ID NO: 98459 - DNA, 50 bp, homo sapien
taaaattaaggttgccaattggtgayatatgcaatgctgttagctattga

SEQ ID NO: 98460 - DNA, 50 bp, homo sapien
tggaaactagaagagagcttctcaarattttaagtacatatgactcattt

SEQ ID NO: 98461 - DNA, 50 bp, homo sapien
cttttatgttaagactccaaccaaaytctttccagttttaacccaaagag

SEQ ID NO: 98462 - DNA, 50 bp, homo sapien
ccctaccccacttgaatcatcttgarctactttgaggaacatcaacttgc

SEQ ID NO: 98463 - DNA, 50 bp, homo sapien
aaacagaaagataaaccagaatggcyagtaacaccacaccttggggttat

SEQ ID NO: 98464 - DNA, 50 bp, homo sapien
agaagaaggagaagtagaggtggtcyatccaagaagagaaaggggtgagt

SEQ ID NO: 98465 - DNA, 50 bp, homo sapien
tcttattggtagtatctactacaaaygagtaaggtgataacttttaaagc

SEQ ID NO: 98466 - DNA, 50 bp, homo sapien
ggcccttttgtcgctatgaattttcygtctttaattctataaatgcttta

SEQ ID NO: 98467 - DNA, 50 bp, homo sapien
actcactgaacaacaaaagctgcaayataaccatatcagtggtgatatct

SEQ ID NO: 98468 - DNA, 50 bp, homo sapien
aagacttgtgactttgccgacagacmattttaaatagctgttttgaggaa

SEQ ID NO: 98469 - DNA, 50 bp, homo sapien
aggatgtttatagatatcatttagtrtaacattgatgccgccaattacca

SEQ ID NO: 98470 - DNA, 50 bp, homo sapien
aaaaaaatactgagtgtcatgactayacaaacatgtagtatataataatt

SEQ ID NO: 98471 - DNA, 50 bp, homo sapien
atagaatgagcccatagcaccaaacrgcctagtaaagagatatgttaggg

SEQ ID NO: 98472 - DNA, 50 bp, homo sapien
cagccccgggcagggtgctaaagaaygtaagaccatttaccttctaggta

SEQ ID NO: 98473 - DNA, 50 bp, homo sapien
cagcattcatccaaacatttaataastcgaactaaatgatgcctgaaagc

SEQ ID NO: 98474 - DNA, 50 bp, homo sapien
tttttctactgcctgtaaacctatamtaaaccatataatttgtcaaaaat

SEQ ID NO: 98475 - DNA, 50 bp, homo sapien
ttctccatttattccagcctattccrattatgctcctctcttctatctat

SEQ ID NO: 98476 - DNA, 50 bp, homo sapien
tgttttttccattgatttatttaccyagtatcctaatgccagtatcatac

SEQ ID NO: 98477 - DNA, 50 bp, homo sapien
caggaccggagaagccccagaggtcygaagctgaaaacagagactcaagg

SEQ ID NO: 98478 - DNA, 50 bp, homo sapien
tcagaacatgaagggaaattcacaargggtacaatacatcgataactaca

SEQ ID NO: 98479 - DNA, 50 bp, homo sapien
atgaaaacacagaccaaaacccatcraggattgtaatccagaacatcaag

SEQ ID NO: 98480 - DNA, 50 bp, homo sapien
tggcagggtctctttgagtgaagacrtaagatctattctttattggttgg

SEQ ID NO: 98481 - DNA, 50 bp, homo sapien
cttgtcctatagcaattcaatttacyaccgatttgcaaaggcctgtgtca

SEQ ID NO: 98482 - DNA, 50 bp, homo sapien
tctgtggtttgagaatagtgtctackgctatgtcttaaagtttcttaaaa

SEQ ID NO: 98483 - DNA, 50 bp, homo sapien
ctagatgaagttttctaactctttamgttctcattctcaagataaagtag

SEQ ID NO: 98484 - DNA, 50 bp, homo sapien
tctttaaaatatagattacaagagaraggctgactacaaagtgctgcagt

SEQ ID NO: 98485 - DNA, 50 bp, homo sapien
ctgttacaatccagcctcatatctgraagcaagccaaactgaattcaagt

SEQ ID NO: 98486 - DNA, 50 bp, homo sapien
tatcaaagtaactcacaaatatggcyactgatttttaacaaaagcacaaa

SEQ ID NO: 98487 - DNA, 50 bp, homo sapien
gtcttgtaaggccaggctagtgttaygaaagttccttaggttttgcttgt

SEQ ID NO: 98488 - DNA, 50 bp, homo sapien
cataggttattaaagatgagagctasaggcatcctttcagctctggaaaa

SEQ ID NO: 98489 - DNA, 50 bp, homo sapien
gaagtctagacatagcggcagatgcrtgatggagtagctggaatcaggag

SEQ ID NO: 98490 - DNA, 50 bp, homo sapien
tttttctccagcagcctcatccttayctcactttacagcaacctattctt

SEQ ID NO: 98491 - DNA, 50 bp, homo sapien
acccctgaatttcaatgacctttaawtcctttcatttcagctacccacat

SEQ ID NO: 98492 - DNA, 50 bp, homo sapien
gctgataacaatattgggagaatatraagccaatgtactttcatcttgtt

SEQ ID NO: 98493 - DNA, 50 bp, homo sapien
gggataaagtttgtccacagactcayggaactaggattttgtagtcacaa

SEQ ID NO: 98494 - DNA, 50 bp, homo sapien
cctttgtattcccgtatcggccagcsactggatgcaggttgccaccaaga

SEQ ID NO: 98495 - DNA, 50 bp, homo sapien
caaagggtcagttactggaccatccragaatagtttatcacgtggtccaa

SEQ ID NO: 98496 - DNA, 50 bp, homo sapien
aagtgaagttttatcagcacttcaakgtctctgagcctctacaaatctac

SEQ ID NO: 98497 - DNA, 50 bp, homo sapien
aagaggagaagagttaagcattgacragattcaattaagaccttacaacc

SEQ ID NO: 98498 - DNA, 50 bp, homo sapien
ttcaatgtcaactcacattagttcaytctgtcacaaaactgtcagccatg

SEQ ID NO: 98499 - DNA, 50 bp, homo sapien
tgtatcatgccaaagctttttaaagratactaatgatggttagaatccaa

SEQ ID NO: 98500 - DNA, 50 bp, homo sapien
aagtagacctaaataaatggagctayctaccgtgttcacagagtagagga

SEQ ID NO: 98501 - DNA, 50 bp, homo sapien
aatggtattcaatccatatttttacygacaagaaagctctagaagttgtg

SEQ ID NO: 98502 - DNA, 50 bp, homo sapien
tttctagaatagctctgctactccaygaagggctagtctgcagcacatgg

SEQ ID NO: 98503 - DNA, 50 bp, homo sapien
ggcagttctctattatgaaggtatayagaatcctgatagattcatatgtc

SEQ ID NO: 98504 - DNA, 50 bp, homo sapien
tcctgaaactttctcagtcctctaasagattaaggtgatacaatcctctg

SEQ ID NO: 98505 - DNA, 50 bp, homo sapien
cacggggccagctgtgggacttgtgyatgcgcaatttgggtatattcagg

SEQ ID NO: 98506 - DNA, 50 bp, homo sapien
gcatgaggccatgcatctagcttccmagtggaattttaatctgaaatagc

SEQ ID NO: 98507 - DNA, 50 bp, homo sapien
ttctaaccaataccatatagcaaaastgattaactgttacttctgcaact

SEQ ID NO: 98508 - DNA, 50 bp, homo sapien
tcacttctcttgagtaagtgcttagsagtgaaatggctagttcttttggt

SEQ ID NO: 98509 - DNA, 50 bp, homo sapien
caaggctccttacatacatgcactcygaaagtatatctctatctcctacc

SEQ ID NO: 98510 - DNA, 50 bp, homo sapien
aattgaattgcgcttactttacttayggcatccattttgaggaacgcctt

SEQ ID NO: 98511 - DNA, 50 bp, homo sapien
attcctacatatcaatattcttgacragtatcatctgatggaatgtatat

SEQ ID NO: 98512 - DNA, 50 bp, homo sapien
ttaagcttgatcccctagtagaatgmaaacaagagaatatgtatggcaga

SEQ ID NO: 98513 - DNA, 50 bp, homo sapien
ctttaaaactgaactcagactcaaaygtgaacttggtatgaagctcctag

SEQ ID NO: 98514 - DNA, 50 bp, homo sapien
ttactcttacttaggaggaataagargttaatccaacagcaccgtttcga

SEQ ID NO: 98515 - DNA, 50 bp, homo sapien
atcaccacctccacgctacaggtaaragaaggctatttgctagacatcca

SEQ ID NO: 98516 - DNA, 50 bp, homo sapien
gagaatctgagctcctcattgagacwccaaacaaggatttggttactaaa

SEQ ID NO: 98517 - DNA, 50 bp, homo sapien
tgaacggtccatttccttagtcctcrctagaaatcaagcaaaagtgaaaa

SEQ ID NO: 98518 - DNA, 50 bp, homo sapien
tcaaagcaaatgaagatactctcacyataggtaacttgcagaaaatttac

SEQ ID NO: 98519 - DNA, 50 bp, homo sapien
caggagacagaagtagagatacacaycagaaatttcaagtgaggtgggtt

SEQ ID NO: 98520 - DNA, 50 bp, homo sapien
acattaagtgttatccaatacttgayctcatctttaaattctcaggggag

SEQ ID NO: 98521 - DNA, 50 bp, homo sapien
atagaaagagtttacatccatgagakaaactaagcttgagtccttatgat

SEQ ID NO: 98522 - DNA, 50 bp, homo sapien
gtgttgtatccagaattcagacccaraatttttgctctaaaccagtgctc

SEQ ID NO: 98523 - DNA, 50 bp, homo sapien
tttttttttttttgtaaatggaaatyagataagatgtcatgtataggata

SEQ ID NO: 98524 - DNA, 50 bp, homo sapien
gggtttatgacccagaccaataccaygtcttatctaattatctaagtatg

SEQ ID NO: 98525 - DNA, 50 bp, homo sapien
tgttaaatatgataacaacataccartatcaatatatttcaaccattgtg

SEQ ID NO: 98526 - DNA, 50 bp, homo sapien
gctttcaacttgcacgggtcacctaygtaaattcagaacccttcctggga

SEQ ID NO: 98527 - DNA, 50 bp, homo sapien
tagcgtagttcttctctatactcaamatacttgtagctgagttcatggtg

SEQ ID NO: 98528 - DNA, 50 bp, homo sapien
ctttccctgtcaagcctatgagtacrctttacaggccaaggctcccctct

SEQ ID NO: 98529 - DNA, 50 bp, homo sapien
ctcatgggcaagtctgattagaaaamaaaagtactcaacatcaggactga

SEQ ID NO: 98530 - DNA, 50 bp, homo sapien
ttaatccaggtataagaggttttagrcgtttcttactatggacttgcata

SEQ ID NO: 98531 - DNA, 50 bp, homo sapien
actctattcagaattaagattcagaratgtacagatagagggtgaactgg

SEQ ID NO: 98532 - DNA, 50 bp, homo sapien
tctcttcctgatgcacagactgaccygggatcattttcagtactagctgc

SEQ ID NO: 98533 - DNA, 50 bp, homo sapien
gtccattcaaagagaaattaaacggyccatgttctgaaattcgtatttac

SEQ ID NO: 98534 - DNA, 50 bp, homo sapien
agctataagtgattatgtgcgtgaaygtgtaatttgcataggtaattgct

SEQ ID NO: 98535 - DNA, 50 bp, homo sapien
ttttttcctttgttgttttccattcractgtctaaatgatttttcttcat

SEQ ID NO: 98536 - DNA, 50 bp, homo sapien
tccttgtgggctagagtgccgttcaratttacttagggcccctgggcact

SEQ ID NO: 98537 - DNA, 50 bp, homo sapien
cttcgtgaaagactttgattcttcasacttggatacattctagctcaaga

SEQ ID NO: 98538 - DNA, 50 bp, homo sapien
tacttgcatctttgcatatagttgcrtcttgaagaaagaagaacaaaccc

SEQ ID NO: 98539 - DNA, 50 bp, homo sapien
ctcagcacagaccacatcaaagaaasgaccatagacataagagttttaag

SEQ ID NO: 98540 - DNA, 50 bp, homo sapien
tagaattcctctaagagctttttggragataacatagtttctttacttaa

SEQ ID NO: 98541 - DNA, 50 bp, homo sapien
tggatgtctaatacctactagctgaygataatgagaggaaagtctccata

SEQ ID NO: 98542 - DNA, 50 bp, homo sapien
gcaatatcttaaaagagagataatargcagttgagattcaaccccacccc

SEQ ID NO: 98543 - DNA, 50 bp, homo sapien
aagttatgaagtttaagagtatgcartaggaaagattcagagaaagagca

SEQ ID NO: 98544 - DNA, 50 bp, homo sapien
ctggaaatgattttctgatttaaaamggaggacaatcaactcgatagtag

SEQ ID NO: 98545 - DNA, 50 bp, homo sapien
gattaattttaaacatgctgtctttsaaacctaaacataggcatccaggt

SEQ ID NO: 98546 - DNA, 50 bp, homo sapien
aatgttggagaggagcagtggaaacsgtcataaatcattggtgagtgtat

SEQ ID NO: 98547 - DNA, 50 bp, homo sapien
tggtcaagtttctacccatgtctaayggactcaacacccaaaaattttgt

SEQ ID NO: 98548 - DNA, 50 bp, homo sapien
cgctggtaggaatataaattgatacragcacattataaaatagtttggaa

SEQ ID NO: 98549 - DNA, 50 bp, homo sapien
gactttactaattgtctataaccaaraagttatggtttgatatcactgca

SEQ ID NO: 98550 - DNA, 50 bp, homo sapien
attccagcctttaggcaaataaaaamtagagtaacatccttcagtcacca

SEQ ID NO: 98551 - DNA, 50 bp, homo sapien
attctgatggccagagtctgtgacawcctagagcagtggttttcacccct

SEQ ID NO: 98552 - DNA, 50 bp, homo sapien
gacatttccatttttattagtaagcratctatgaggtcatattttgggat

SEQ ID NO: 98553 - DNA, 50 bp, homo sapien
aattcctaatgttataattggctgaraacaagaatcctcaatgggttcta

SEQ ID NO: 98554 - DNA, 50 bp, homo sapien
taattacactgaagcaattgtcccaygttttagtttggaaactgtggttg

SEQ ID NO: 98555 - DNA, 50 bp, homo sapien
aaaatcaagaaattatccacattaaygcttattttccataatttggtata

SEQ ID NO: 98556 - DNA, 50 bp, homo sapien
aaactgacgatattatatagtttcayagttgtggtttcataataagctct

SEQ ID NO: 98557 - DNA, 50 bp, homo sapien
taaatctttctggacatggtctacayatttaaacgcttctagatgagttt

SEQ ID NO: 98558 - DNA, 50 bp, homo sapien
attaatttcagtgactgaagatttasggcaagctcaacaagaaaagttta

SEQ ID NO: 98559 - DNA, 50 bp, homo sapien
gattggaaatgatgaaagccaactckatcagcgggtattgggttcattcc

SEQ ID NO: 98560 - DNA, 50 bp, homo sapien
tatgatgcttggatatatgtaaacaytgtagaatgcctaaattatgttaa

SEQ ID NO: 98561 - DNA, 50 bp, homo sapien
caggtaagtacataacgttgttacayaggtcatagtttaaagatcataga

SEQ ID NO: 98562 - DNA, 50 bp, homo sapien
tcctaggacctcatatctgatatacraaagaaagtgatacagatttccct

SEQ ID NO: 98563 - DNA, 50 bp, homo sapien
aaattgaaattttgtatagacttaasattgatataaaatttttgttaaaa

SEQ ID NO: 98564 - DNA, 50 bp, homo sapien
tcctgggagctgtcagccttttgtgragtggccaggcccccttgttttct

SEQ ID NO: 98565 - DNA, 50 bp, homo sapien
gtttcttggaaagaaataatccaaartcttaagataatatgaaaatgcaa

SEQ ID NO: 98566 - DNA, 50 bp, homo sapien
atttctgataaatgtatccactctaygaaattagaaaaatgtgtgctgaa

SEQ ID NO: 98567 - DNA, 50 bp, homo sapien
gcaataaagctcaccaaggcaacaaygattactcaccagcagagtttgat

SEQ ID NO: 98568 - DNA, 50 bp, homo sapien
ctcttgctctgttgttctcagtccartcttactgtgaggccccagacagg

SEQ ID NO: 98569 - DNA, 50 bp, homo sapien
ttttcttctccaaaacagttactttsggacagtctatgccaatttcacaa

SEQ ID NO: 98570 - DNA, 50 bp, homo sapien
tttatacatttcatatcagtataaawctcatatcagtaaacagctctttg

SEQ ID NO: 98571 - DNA, 50 bp, homo sapien
gatttcagtttctgtctttgaacaakatgaactttcagtgagtcatttgc

SEQ ID NO: 98572 - DNA, 50 bp, homo sapien
tctgaaaatgttttcttcatctcaaycctctgactgtttcaggagactat

SEQ ID NO: 98573 - DNA, 50 bp, homo sapien
aattatctcagattcaccagattcaygctaataataaagtttgaggcata

SEQ ID NO: 98574 - DNA, 50 bp, homo sapien
gcccaaaaatcaaaggctgaaagtargagtggcctcagtaatccactgta

SEQ ID NO: 98575 - DNA, 50 bp, homo sapien
aatagaagcatggaatgagcaaattktggtatattcatgcagttgaatgc

SEQ ID NO: 98576 - DNA, 50 bp, homo sapien
agcttggttttcaaaatgattgttayagccaatgaacacacaagcatcta

SEQ ID NO: 98577 - DNA, 50 bp, homo sapien
tacaaatcaaacatggaataggaaayagtagttaagaaggaatctctgga

SEQ ID NO: 98578 - DNA, 50 bp, homo sapien
aatgtctcatacattttttagcatcracaatagacaacacaaatatgcaa

SEQ ID NO: 98579 - DNA, 50 bp, homo sapien
gaatctgaacctaattctatgttccygacacatttgcttaaagctgggat

SEQ ID NO: 98580 - DNA, 50 bp, homo sapien
actgccctaccatagattttcttaawgcctggcctagaatgaaggaagca

SEQ ID NO: 98581 - DNA, 50 bp, homo sapien
tcttaccacttatacgtgattattayaacaaaatgtactgagagtatcct

SEQ ID NO: 98582 - DNA, 50 bp, homo sapien
ccatcttggacttctgcctctcagaygttaaggtgataaacttgtatggt

SEQ ID NO: 98583 - DNA, 50 bp, homo sapien
taaacatatcacagatttagtttaastcattaaggaacagttaaaatgat

SEQ ID NO: 98584 - DNA, 50 bp, homo sapien
ttcctatgtagcaggacaatactcamgcttttacatgaaaaataaaacat

SEQ ID NO: 98585 - DNA, 50 bp, homo sapien
ttcttaaatcttcacctgataattaygtctatttagagagatctcatcat

SEQ ID NO: 98586 - DNA, 50 bp, homo sapien
tgcattccagcattgccatgttccamaaagttcccaggtgattctaaggg

SEQ ID NO: 98587 - DNA, 50 bp, homo sapien
aatttgttcttctaatttctgaatcraagaatttaaaaacatacattgga

SEQ ID NO: 98588 - DNA, 50 bp, homo sapien
caactgctctttgggctacagctggrattcttgctatgctaatggaggac

SEQ ID NO: 98589 - DNA, 50 bp, homo sapien
tacatggttctgcaaataaaaattgraagagccactgcattatctcaaac

SEQ ID NO: 98590 - DNA, 50 bp, homo sapien
aagaagccagcaatgtgttggtgatyatacaaagctggtataacaatttg

SEQ ID NO: 98591 - DNA, 50 bp, homo sapien
tgccaattgactggactacatgagcrcatctgtcaaaaacaggtctctta

SEQ ID NO: 98592 - DNA, 50 bp, homo sapien
ctcaggtaagacatttctattaagaygtagaaaacacagactttaaaaga

SEQ ID NO: 98593 - DNA, 50 bp, homo sapien
atttggctttccaggtacatcataawctgggataaaacaaggactagaac

SEQ ID NO: 98594 - DNA, 50 bp, homo sapien
gtagataatagttgaagctgggtaaygagtacatggaggataattatact

SEQ ID NO: 98595 - DNA, 50 bp, homo sapien
aaggctacctctcaatgactggagaraaaaaggcttaatttattacttaa

SEQ ID NO: 98596 - DNA, 50 bp, homo sapien
acattctattgatgcattctttcttwaaaaatatggacattcattgagaa

SEQ ID NO: 98597 - DNA, 50 bp, homo sapien
gttcaaatatattaacaacatctcaygatagcaaattaaaaattaaccct

SEQ ID NO: 98598 - DNA, 32 bp, homo sapien
aatatatactcttaccrgtcaataaggcagac

SEQ ID NO: 98599 - DNA, 32 bp, homo sapien
taggttacctcttcacmaggtacattccactt

SEQ ID NO: 98600 - DNA, 50 bp, homo sapien
taacttctttagcctttctgttttamaaattgcattggtaggtgctatgg

SEQ ID NO: 98601 - DNA, 50 bp, homo sapien
cgcaaaaagaaaaagagaaagtgagmatttaggtttccatacatcatctt

SEQ ID NO: 98602 - DNA, 50 bp, homo sapien
tattccaatcaggaatagccaattakgtaaatgtgtactcttaacatagc

SEQ ID NO: 98603 - DNA, 50 bp, homo sapien
aggaaaaaacacactcaaaaagtaarccttaatacttagcataaacaaga

SEQ ID NO: 98604 - DNA, 50 bp, homo sapien
aattaatctttgaatttgggaaagaycactgtgccttaagtacagagtct

SEQ ID NO: 98605 - DNA, 50 bp, homo sapien
gagactgggcagacttgaaggcagartaaaagaattggaagattgcgctg

SEQ ID NO: 98606 - DNA, 50 bp, homo sapien
ggtcactggtaatctctgtaagagakgctttcatgtagtactatagtatg

SEQ ID NO: 98607 - DNA, 50 bp, homo sapien
atattgtctcctattactacaaatayaccttgtttatgacactacatatt

SEQ ID NO: 98608 - DNA, 50 bp, homo sapien
tttatgagcaggttctattataagawggtgagaacaaatagtccctgttt

SEQ ID NO: 98609 - DNA, 50 bp, homo sapien
tcctgacctctttactgctctccacmatacactttcctgctttttgcaga

SEQ ID NO: 98610 - DNA, 50 bp, homo sapien
tctgccctgcaatgggaaatgctcasagtcaatgtttctctgtcttaaaa

SEQ ID NO: 98611 - DNA, 50 bp, homo sapien
cttgctaggttgcagaacttataagsccacttttatggcattgctggagg

SEQ ID NO: 98612 - DNA, 50 bp, homo sapien
ccagatgagctcaggggttggcctaygcacaaaattaaattgattcccca

SEQ ID NO: 98613 - DNA, 50 bp, homo sapien
aaaatgcaaaataaaaaccagatackgcaattacataggccaaaattaag

SEQ ID NO: 98614 - DNA, 50 bp, homo sapien
aaaggaactgaaggaaaagagagcayggatatatgagtgtggttgcatag

SEQ ID NO: 98615 - DNA, 50 bp, homo sapien
ccccagagtaaaaggagtgattgtargaagtcatataaatggatttgatc

SEQ ID NO: 98616 - DNA, 50 bp, homo sapien
ataatttatccatcttgttgtcagaytcacagctagtttgcctgactcta

SEQ ID NO: 98617 - DNA, 50 bp, homo sapien
ttcttcttctctctgagcaggcaackctcccttttttacgcttttctaat

SEQ ID NO: 98618 - DNA, 50 bp, homo sapien
caaatgttccaattgtcatttgttaygtctagctgctattggagaaagct

SEQ ID NO: 98619 - DNA, 50 bp, homo sapien
tgacctcaaactgtctttcccggaaygttgtgaaaacatgctatacacac

SEQ ID NO: 98620 - DNA, 50 bp, homo sapien
ccttaaactacctggtaatttgtatraggctctgttggctggagcccagt

SEQ ID NO: 98621 - DNA, 50 bp, homo sapien
tcagccctcatggaatttaggatcartcagagggtacacgaagggacaca

SEQ ID NO: 98622 - DNA, 50 bp, homo sapien
aagaatagtttcggttttttataagkaatggaatgccatgtggctctatt

SEQ ID NO: 98623 - DNA, 50 bp, homo sapien
ttagcccttccctgcaaaatgtgtartccagcatcctaggctattcctgg

SEQ ID NO: 98624 - DNA, 50 bp, homo sapien
aatcacaagtgtagtgatttaaacasggtatcagtggctttacgcatcca

SEQ ID NO: 98625 - DNA, 50 bp, homo sapien
ttccatacaaaacacatgcttttagragtccataagttatctcaggaatt

SEQ ID NO: 98626 - DNA, 50 bp, homo sapien
tggtagagtcagaccagtggactaawaatagattgtaatgttgacatcta

SEQ ID NO: 98627 - DNA, 50 bp, homo sapien
acactttcatttgtgtgaacaaaaayatatcaggagaacatgtttcaaat

SEQ ID NO: 98628 - DNA, 50 bp, homo sapien
gacaaaatgaaataaataagtaggtsaagtagagatgattataaagcaca

SEQ ID NO: 98629 - DNA, 50 bp, homo sapien
accactttcttagtggtaggaggtasaaagtgcacacatttgttcgcccc

SEQ ID NO: 98630 - DNA, 50 bp, homo sapien
ggtaagtggtctgaggagttggctasaaaacagagctctgaagggagagc

SEQ ID NO: 98631 - DNA, 50 bp, homo sapien
ttagattgcttaccttatggaataaygcagacctttttctctgagaggtc

SEQ ID NO: 98632 - DNA, 50 bp, homo sapien
agctttaaaacaaagatgattaacastcctttcccaaaattaacccactc

SEQ ID NO: 98633 - DNA, 50 bp, homo sapien
tcaataaatatttgttggagcaatawgggaacaaataaatatgataattc

SEQ ID NO: 98634 - DNA, 50 bp, homo sapien
aaccagttgagtcagtttcttcataygggctcctggtccaagtggcacca

SEQ ID NO: 98635 - DNA, 50 bp, homo sapien
ctaaaactctcaaagaggaagtaaasactcaggggactaagtgctcagag

SEQ ID NO: 98636 - DNA, 50 bp, homo sapien
tactttttggcatgtactctccacgscataatttgtaaatgccctggtct

SEQ ID NO: 98637 - DNA, 50 bp, homo sapien
gggaaagtcaagaagactaaatgctwaataaatacggaggttgaactagg

SEQ ID NO: 98638 - DNA, 50 bp, homo sapien
ctttatggtacattggagtccctcartaatcaacacatgcccctctaatc

SEQ ID NO: 98639 - DNA, 50 bp, homo sapien
aaagcagggttttatcgggtgaaaaytgttcgaatcccaggttccacaca

SEQ ID NO: 98640 - DNA, 50 bp, homo sapien
tgcttttgtgaaatatttttgttcaygtctactatttacatgaagccaag

SEQ ID NO: 98641 - DNA, 50 bp, homo sapien
aagttatttgcatggagtaatgagakatttgcattgggaagcaaggagtg

SEQ ID NO: 98642 - DNA, 50 bp, homo sapien
aatcgagttgaatacaagtttccctsaaggataggagtggcttggagaat

SEQ ID NO: 98643 - DNA, 50 bp, homo sapien
tcctaggggaaggaagatgtggtaaracaaaatctcacaatttatgttgt

SEQ ID NO: 98644 - DNA, 50 bp, homo sapien
ttaagcagacaatatccgtgagaaasacaaggtattgtattggaagagag

SEQ ID NO: 98645 - DNA, 50 bp, homo sapien
agagaaataatacagtagtaccaaasgaaagatccatttctgagggaagg

SEQ ID NO: 98646 - DNA, 50 bp, homo sapien
acagaataatgaagtcaggagtcaamataaattataataatgattattat

SEQ ID NO: 98647 - DNA, 50 bp, homo sapien
atcttcatgattactctccagtgtakgtatttttattttccacatcttgc

SEQ ID NO: 98648 - DNA, 50 bp, homo sapien
aacctgaaggtagtggagagcttaargcagggatccccagtgcccgggcc

SEQ ID NO: 98649 - DNA, 50 bp, homo sapien
gcatctatagaatttaaaataccaawgttagtatgtcatctgtagagaca

SEQ ID NO: 98650 - DNA, 50 bp, homo sapien
tacaactggctttactcttatgtcakcctatttaactgtgccctcaaaat

SEQ ID NO: 98651 - DNA, 50 bp, homo sapien
ttgtatgtgtctgaggcacctgggcrgacaggatttaaacgtacgagttt

SEQ ID NO: 98652 - DNA, 50 bp, homo sapien
ttatcaatgtattttggttatagtcragcaggagctctgtctttcgtgat

SEQ ID NO: 98653 - DNA, 50 bp, homo sapien
ccaaaaattagtatacttactgtaayagagcttgatttcgttctgtttca

SEQ ID NO: 98654 - DNA, 50 bp, homo sapien
ttttcctgtttttatcatgctcttayggtttcattctttaaacagaaaac

SEQ ID NO: 98655 - DNA, 50 bp, homo sapien
atagacccattttttaggtctacaarcactgaatgagcacctctgatttt

SEQ ID NO: 98656 - DNA, 50 bp, homo sapien
ggtcatgcttataactagcagctaakgttttagggaatgtagatttgttt

SEQ ID NO: 98657 - DNA, 50 bp, homo sapien
ctgaggaccttatggccattgcagtsttttccttggcagtccgagggaag

SEQ ID NO: 98658 - DNA, 50 bp, homo sapien
agggaaatgaaactggcttaactcaytcagatgtggaagagcatatgccc

SEQ ID NO: 98659 - DNA, 50 bp, homo sapien
caatgacaagccactttagagtctgratgataagaatggaatgaagattt

SEQ ID NO: 98660 - DNA, 50 bp, homo sapien
gacagccttgaattttcaaagcccarattttcaatgacaagccactttag

SEQ ID NO: 98661 - DNA, 50 bp, homo sapien
aattgaacttgtattctgatttctawccttgctacctattgctgttttat

SEQ ID NO: 98662 - DNA, 50 bp, homo sapien
ccatcctgacatctgcttcatggagkacctgaattaatacaaataagcaa

SEQ ID NO: 98663 - DNA, 50 bp, homo sapien
gtgcttgtttccttaattggatactytgtgggtggtttggctagatttgg

SEQ ID NO: 98664 - DNA, 50 bp, homo sapien
gtcttactgcatctttcctgaggctstcttagaatactgcaattaaatta

SEQ ID NO: 98665 - DNA, 50 bp, homo sapien
gagcttagatgtggattacactataygtttaaaatgaacccctcaattgc

SEQ ID NO: 98666 - DNA, 50 bp, homo sapien
atgtcctggattgcctcaaactctgwatatgcaatattttccatttacaa

SEQ ID NO: 98667 - DNA, 50 bp, homo sapien
aatattattgaaaagggatgaatagscaatatctttttacagaaaggttt

SEQ ID NO: 98668 - DNA, 50 bp, homo sapien
gggtattgcgcttttccagcctgtamaatggaggcaacaagaagattgtg

SEQ ID NO: 98669 - DNA, 50 bp, homo sapien
acatgccagtaacatatttgataaargcaaaatttaaattcaagggtgca

SEQ ID NO: 98670 - DNA, 50 bp, homo sapien
taggacttcttcctgaaggtcaacaytattagcacttcctccacaaaacc

SEQ ID NO: 98671 - DNA, 50 bp, homo sapien
gattacttgttacacttaccttctcrcactgatatcttcatttctgcaac

SEQ ID NO: 98672 - DNA, 50 bp, homo sapien
tagcccttgatcctcaggcagtacarcattctggtgatacttcagtcacc

SEQ ID NO: 98673 - DNA, 50 bp, homo sapien
caatataccagttccttcatgcctgwctactgcagaaccatcttgacttg

SEQ ID NO: 98674 - DNA, 50 bp, homo sapien
aattgcatgcagttaatatttgaaarttgcattagctcttacttcagaat

SEQ ID NO: 98675 - DNA, 50 bp, homo sapien
gtattacccaccataaaaaatgaacrgcgcaacacctcattgcattgaca

SEQ ID NO: 98676 - DNA, 50 bp, homo sapien
cagatttttctctagttttatggtaycagagaatttgtgataagggaaga

SEQ ID NO: 98677 - DNA, 50 bp, homo sapien
attattttggatttcctgttataatyaaccctatcttctgtacttggtca

SEQ ID NO: 98678 - DNA, 50 bp, homo sapien
tgaaaacctatgtccatacaaaaacyctgttacataaatgtttataccag

SEQ ID NO: 98679 - DNA, 50 bp, homo sapien
catcaattgtgacaaatctactacayggatgcaagaactgggacctcatg

SEQ ID NO: 98680 - DNA, 50 bp, homo sapien
aaagatcaatgtcttgagtaatggamtagcacatgggacgtaccttaact

SEQ ID NO: 98681 - DNA, 50 bp, homo sapien
aaccttgtatcacttaaactcctgcrgacaagccctgccccatcctgttg

SEQ ID NO: 98682 - DNA, 50 bp, homo sapien
ttgttgttgctacctcatttgcactraataagcgttctgtggaaacagca

SEQ ID NO: 98683 - DNA, 50 bp, homo sapien
ggtgagctctagaaatggcatggccraaaaaaggataaggatgaggaaat

SEQ ID NO: 98684 - DNA, 50 bp, homo sapien
ttgatagaagtgttgaagaatttgayatggtaacatgcttttggaggact

SEQ ID NO: 98685 - DNA, 50 bp, homo sapien
gaacaccacagaacataataatgtargtttcttgagttctcactgttcac

SEQ ID NO: 98686 - DNA, 50 bp, homo sapien
aagtgtttataagaagtgactgtgtraagtgtgaccggggatctgggcta

SEQ ID NO: 98687 - DNA, 50 bp, homo sapien
tttcctaacagtctaatatgtaatcmaatgccattagctactgactgtct

SEQ ID NO: 98688 - DNA, 50 bp, homo sapien
cattaattgttgactccagcttatcrcatttttaaaactttttcttttga

SEQ ID NO: 98689 - DNA, 50 bp, homo sapien
aacttcagagccttggggctggtccragccaaccaagagaattcctcaga

SEQ ID NO: 98690 - DNA, 50 bp, homo sapien
aacatggtcactttgagagtaagaaraaagtaggaattttaatcaattat

SEQ ID NO: 98691 - DNA, 50 bp, homo sapien
tattgtaggcacattttgaaaatcartaaaacctcgttgatttaatttag

SEQ ID NO: 98692 - DNA, 50 bp, homo sapien
cttaaagagtgttctcagtggtccaygtgctacaactgagaggcaatgag

SEQ ID NO: 98693 - DNA, 50 bp, homo sapien
atcagtgtgaagaacttccagtttamaatgacacctggctagcagtccat

SEQ ID NO: 98694 - DNA, 50 bp, homo sapien
ttactgcaaagagaaataaaagagargcagatcccagcacagtagaagga

SEQ ID NO: 98695 - DNA, 50 bp, homo sapien
ctacaatatcgtctatcttcatgctracataacatatcacatcttcatgg

SEQ ID NO: 98696 - DNA, 50 bp, homo sapien
gccctcagtcaccccaagtcttaaasaaaagccatgttaaccactaacga

SEQ ID NO: 98697 - DNA, 50 bp, homo sapien
gggtgtcaggaaagctgttttctaayggaaggaagcgttgcttgaactga

SEQ ID NO: 98698 - DNA, 50 bp, homo sapien
aggccctgatgtcatctgagtgccaytacatccctgccactactccaaat

SEQ ID NO: 98699 - DNA, 50 bp, homo sapien
catattataatttatttgataaaacrccttctatggtcaaataatgtttg

SEQ ID NO: 98700 - DNA, 50 bp, homo sapien
acaagaacaagggtttagtaacttargctaagaaagtgaatttagaccgg

SEQ ID NO: 98701 - DNA, 50 bp, homo sapien
gaagaagcaggagagctcgaagtcayagaagtgaagatgatgattccaca

SEQ ID NO: 98702 - DNA, 50 bp, homo sapien
aaacccaaacagtaattgtattgacycaagaaagcactattaaaatgtat

SEQ ID NO: 98703 - DNA, 50 bp, homo sapien
atcagttagaagctgattattatgayctgcaacttcagttgtatgaagta

SEQ ID NO: 98704 - DNA, 50 bp, homo sapien
gtgccacggtccgagtttttcaacastaaactatgctgctagtaagaaca

SEQ ID NO: 98705 - DNA, 50 bp, homo sapien
gagacccagaatggttaagtcacaakttgagaaagaggtggaattgggac

SEQ ID NO: 98706 - DNA, 50 bp, homo sapien
agaggggccttgtgctaggtacatgsatttactagtttcaaagccaaaaa

SEQ ID NO: 98707 - DNA, 50 bp, homo sapien
gaggagcagaatcatctgaggagcaygttaaaaagcagagtcttgaccat

SEQ ID NO: 98708 - DNA, 50 bp, homo sapien
tgaagtggttgttaaagtcttttagyccatcttaaaattgggttatttgt

SEQ ID NO: 98709 - DNA, 50 bp, homo sapien
ctctgaaacaactgatggatccatamtatagaatgtcacttattgccaat

SEQ ID NO: 98710 - DNA, 50 bp, homo sapien
ttagttgagtgaatgattgaattaaytgagtgaagcttttataaaattgc

SEQ ID NO: 98711 - DNA, 50 bp, homo sapien
gtattactataaacacagccttaaartatcattagtttcttctttgaaaa

SEQ ID NO: 98712 - DNA, 50 bp, homo sapien
taccacaaaaaggataaagcgcaaawctggtgaagacctgtatttaagta

SEQ ID NO: 98713 - DNA, 50 bp, homo sapien
ttggtttaaaataattataggaaagraattcagcagtgaaatatgtgact

SEQ ID NO: 98714 - DNA, 50 bp, homo sapien
tactgtatttctagcgcttgtgccaygtaagggctgatgaactcaaaccg

SEQ ID NO: 98715 - DNA, 50 bp, homo sapien
tttggtgtcacaggagtaaagatgtmaaacagggaagccttgggaaccca

SEQ ID NO: 98716 - DNA, 50 bp, homo sapien
ataaaaactagatcaaaaacaggacwcagattttaaaaatatagctactt

SEQ ID NO: 98717 - DNA, 50 bp, homo sapien
tccaaggggtgctgtggtagaacgcrgaaggagatttttggaaaattgca

SEQ ID NO: 98718 - DNA, 50 bp, homo sapien
tctatgtattttcctgcaaataaaaycattagtaaaaagattttaagttg

SEQ ID NO: 98719 - DNA, 50 bp, homo sapien
aatctagattttcaacctattaccayacaagatttaatctaaatgtatat

SEQ ID NO: 98720 - DNA, 50 bp, homo sapien
ttacatggagtaagttcacataacaygactggctttatagactctaacca

SEQ ID NO: 98721 - DNA, 50 bp, homo sapien
ctgaacttcagcaggaagtgatctayatccttggtctacaaatgtttttg

SEQ ID NO: 98722 - DNA, 50 bp, homo sapien
agaattaaccttggaaacaggaactyaggtacacagggcacaataaggat

SEQ ID NO: 98723 - DNA, 50 bp, homo sapien
aagatctacacttgagttgggaaccraaagagaaaaatggacttccatct

SEQ ID NO: 98724 - DNA, 50 bp, homo sapien
actggatgtgggtccaaaattccagragcccaaattagaggcatgattta

SEQ ID NO: 98725 - DNA, 50 bp, homo sapien
attctacaaagactagcatatacagyctcaaactttacaacataacaact

SEQ ID NO: 98726 - DNA, 50 bp, homo sapien
atgaaatgacctaaaattttcatacrctgttcaattaaaacatctttcta

SEQ ID NO: 98727 - DNA, 50 bp, homo sapien
acacattaaagattgaaattcttaamctactgatgaagaaagggcaacgt

SEQ ID NO: 98728 - DNA, 50 bp, homo sapien
tgtgctcccacccctccagcctacayatccgtcgacctttccctcatctc

SEQ ID NO: 98729 - DNA, 50 bp, homo sapien
ggcaggactcaagttctgcagatacsagattgagaggattttcctttgaa

SEQ ID NO: 98730 - DNA, 50 bp, homo sapien
tagctagtattctcactggactcggkatgtatgaggacagacgctgtgtt

SEQ ID NO: 98731 - DNA, 50 bp, homo sapien
tgtagccattttctcagctatgcaakgttgataaaatatatatgaaaagt

SEQ ID NO: 98732 - DNA, 50 bp, homo sapien
caaggagcaactggaaagtttgccaygactaaggtgcacaatggggtcag

SEQ ID NO: 98733 - DNA, 50 bp, homo sapien
gattgttatgtacactatttattgasgtaccagatggtgtgactatgata

SEQ ID NO: 98734 - DNA, 50 bp, homo sapien
aataaagcaagataaattagtaaaamaaatagtgtgtcaaatagtgataa

SEQ ID NO: 98735 - DNA, 50 bp, homo sapien
cacattcacagaaagcataaaatccraatctcgagttttgaggggcagga

SEQ ID NO: 98736 - DNA, 50 bp, homo sapien
gctccttatgaatccttcagatcgaygttcttgaggaaaacagtcaagct

SEQ ID NO: 98737 - DNA, 50 bp, homo sapien
agatttttgttctgcccagctcttakgtctagtctgtctattcactcctc

SEQ ID NO: 98738 - DNA, 50 bp, homo sapien
acatggtaggtatttgatacagagaygaatgaatgctcttcagttcccca

SEQ ID NO: 98739 - DNA, 50 bp, homo sapien
aatatgcactactctaactggtatayggtagaaattcagaaagaggaaac

SEQ ID NO: 98740 - DNA, 50 bp, homo sapien
atatagtcattgagcctctccacacmggtatatctctttattattttcac

SEQ ID NO: 98741 - DNA, 50 bp, homo sapien
gcagatgggagttataaggatgtgayattttaatgtagaaacactcggca

SEQ ID NO: 98742 - DNA, 50 bp, homo sapien
ggcaatctcttaactgtaactaccamaacaaatggcttaaatgcttcttc

SEQ ID NO: 98743 - DNA, 50 bp, homo sapien
gggtgccccatgtgaagccctcgaargatgacatgagggccctgagaccc

SEQ ID NO: 98744 - DNA, 50 bp, homo sapien
tacaaatatgtatgtaaaaataccartgaatcaatccttttgttagtggt

SEQ ID NO: 98745 - DNA, 50 bp, homo sapien
agtttgggggaagttgattctaaccygcacagataactttgagggattca

SEQ ID NO: 98746 - DNA, 50 bp, homo sapien
atttagtgagactagaccaaaattaycatgagggagaggatagttgttat

SEQ ID NO: 98747 - DNA, 50 bp, homo sapien
gttcatcagtggagggccagttgaawaatgtagtgcgtctccacaatgga

SEQ ID NO: 98748 - DNA, 50 bp, homo sapien
ggcaccatcgtgggtgggagggtatyttgcatttgtcttggtattgccct

SEQ ID NO: 98749 - DNA, 50 bp, homo sapien
ttaagagagaaattagttaattccaracatacattatacaactaaagaat

SEQ ID NO: 98750 - DNA, 50 bp, homo sapien
caatatctgtagaggatgtttttgaratcacctgcttatcctaacctgga

SEQ ID NO: 98751 - DNA, 50 bp, homo sapien
ttggatttcatttccatggacctcarattcctcatgtaatgaaagggttt

SEQ ID NO: 98752 - DNA, 50 bp, homo sapien
agatatattcaaatatgattacacasgtaagagaccaagtggatgtgggg

SEQ ID NO: 98753 - DNA, 50 bp, homo sapien
agtgactcttgcatttgtctttccaygaggctggcctaccatagccatgg

SEQ ID NO: 98754 - DNA, 50 bp, homo sapien
gtctcttttggaagaaatatttaaarcataactgttcgataaccaaaaac

SEQ ID NO: 98755 - DNA, 50 bp, homo sapien
aaatttatacattttaagtgtatgartcaatcaattttgacagatacaca

SEQ ID NO: 98756 - DNA, 50 bp, homo sapien
aattctctttgggaaatttgaggtamatggtaataagaattgaggaggca

SEQ ID NO: 98757 - DNA, 50 bp, homo sapien
agccagttgaaaatctttggttgaaracagtaattctccatctctgcaga

SEQ ID NO: 98758 - DNA, 50 bp, homo sapien
ctaaatcattctctcactttatggargctttcaaaatcttttctctattc

SEQ ID NO: 98759 - DNA, 50 bp, homo sapien
ccttaaaagagattgtagtaatttayattcccatcagtaatgtacgagaa

SEQ ID NO: 98760 - DNA, 50 bp, homo sapien
gaaaggcagaggccattatattttaygacctagattcagaaatgatgtat

SEQ ID NO: 98761 - DNA, 50 bp, homo sapien
tcacagcagttatacaactcaattasatttatatgaagaaatatataaat

SEQ ID NO: 98762 - DNA, 50 bp, homo sapien
gacattcattcattcacttaataaayagctactgagaacttaccatatgc

SEQ ID NO: 98763 - DNA, 50 bp, homo sapien
cattatctcacagtaagttactacaygtcaagcactgggctaggtatttt

SEQ ID NO: 98764 - DNA, 50 bp, homo sapien
atatacacaacagcatgtatgaatcwaaatccttatactgggtgaaacaa

SEQ ID NO: 98765 - DNA, 50 bp, homo sapien
gtcgtggtgaggttgaccattgggaractgcttctaagagatagatctgt

SEQ ID NO: 98766 - DNA, 50 bp, homo sapien
gtctcccaatggtcaacctcaccacractgatagaaaaaaacagaatgcc

SEQ ID NO: 98767 - DNA, 50 bp, homo sapien
tcttcttctgtggtttcaactaacaytcctacaaaaatgatgctcaaatc

SEQ ID NO: 98768 - DNA, 50 bp, homo sapien
accaagcatttacaaaaaccaggtayagatgttaaagtaacaaatttttc

SEQ ID NO: 98769 - DNA, 50 bp, homo sapien
ccctatgaagcatgagctcatcttcyagcatggatagcagtcttgactaa

SEQ ID NO: 98770 - DNA, 50 bp, homo sapien
tttagacagcatcccaagagagctaygaaaaataattagtagtagactag

SEQ ID NO: 98771 - DNA, 50 bp, homo sapien
tgctgaataaggttttctttgagtcyacaaatagtgttgttggaagaagc

SEQ ID NO: 98772 - DNA, 50 bp, homo sapien
atcctgcattttctcatcgagttctygtcatgagcccataatttattccc

SEQ ID NO: 98773 - DNA, 50 bp, homo sapien
tgtcctttcatagagcaagcaatgaraagagatgatcatctttttttcaa

SEQ ID NO: 98774 - DNA, 50 bp, homo sapien
agggataaaaatttatgtggtcttayagagggatgagagcaaaaaaaaga

SEQ ID NO: 98775 - DNA, 50 bp, homo sapien
atgtgtttattttttgataactgacraaaattcataaatacaggaataat

SEQ ID NO: 98776 - DNA, 50 bp, homo sapien
tgataccacaggagctcttaaaatcrctaaaaacaaaataaccaagaaaa

SEQ ID NO: 98777 - DNA, 50 bp, homo sapien
agtggaatgggcacaagcttggttayaggcttcaagctgccactaatgag

SEQ ID NO: 98778 - DNA, 50 bp, homo sapien
cttaaaaaatgaatattctaaactgmaaatctggtaaattatactactat

SEQ ID NO: 98779 - DNA, 50 bp, homo sapien
cccacaaatggaggaattggaacacratctaactgttgcttaatgatcac

SEQ ID NO: 98780 - DNA, 50 bp, homo sapien
cagtcattccccaatcctggtttaargccaaagcagatgggagctgcaac

SEQ ID NO: 98781 - DNA, 50 bp, homo sapien
agtagaattcaagttcacagaatacycaaactaaggtgagtgatcagaca

SEQ ID NO: 98782 - DNA, 50 bp, homo sapien
attttgtaaagattcctgagcctaaytaatagattttagagtcttattac

SEQ ID NO: 98783 - DNA, 50 bp, homo sapien
tctcactcaccccatgtaattacagrccatggcttttcttaactttgtgg

SEQ ID NO: 98784 - DNA, 50 bp, homo sapien
gcatttctgttctctaaattttctaygttataatgtataaaggagtccaa

SEQ ID NO: 98785 - DNA, 50 bp, homo sapien
agcgtctagactttgctaatggttcyctatgtcaggttatatttttaaac

SEQ ID NO: 98786 - DNA, 50 bp, homo sapien
tgttagtagaatagccacataaaaargaactgatttaaacaattataaac

SEQ ID NO: 98787 - DNA, 50 bp, homo sapien
ggaattctgcccttctctgatggaaygacaaagacgacgagagacaacaa

SEQ ID NO: 98788 - DNA, 50 bp, homo sapien
tttactgggacagaggatgttacacrgattcccttatgtctctagaactt

SEQ ID NO: 98789 - DNA, 50 bp, homo sapien
tcccatttatttgaacctattgctaractcatgggaacttcagttaatca

SEQ ID NO: 98790 - DNA, 50 bp, homo sapien
gagatttcagcatcctacttagaaartctcagtaggataaacccaaatca

SEQ ID NO: 98791 - DNA, 50 bp, homo sapien
aaaaattgattttgcagctatgattrtggatattgagatggggaggttta

SEQ ID NO: 98792 - DNA, 50 bp, homo sapien
aacggtccaaaagcatctatacgccrctagaattacaatacatagaaatg

SEQ ID NO: 98793 - DNA, 50 bp, homo sapien
ttaaaactctttgtacaggaatgaawgttaatcatcaatttaaacacaac

SEQ ID NO: 98794 - DNA, 50 bp, homo sapien
atttcacatagatctgtttagaaaaygtccgattaggataatataaacca

SEQ ID NO: 98795 - DNA, 50 bp, homo sapien
ctctatgccatattcaaggtgtgtargttgacttgttaaccaaaatattt

SEQ ID NO: 98796 - DNA, 50 bp, homo sapien
aataaatatttaaagttttacagtasagtgattataattgcttttcagga

SEQ ID NO: 98797 - DNA, 50 bp, homo sapien
cacagaaggcattctgagagtaaacrctggtgaagttatacaggtggaga

SEQ ID NO: 98798 - DNA, 50 bp, homo sapien
ttttgttggctgtctataaggctagyatgtctcaagcacattgggaaatt

SEQ ID NO: 98799 - DNA, 50 bp, homo sapien
ccctgccacacctcttacctcatacygattggcatgtccaccctcaggct

SEQ ID NO: 98800 - DNA, 50 bp, homo sapien
ccatctggcaacttgagcatagatayaggaagtaactgcaatgaattgca

SEQ ID NO: 98801 - DNA, 50 bp, homo sapien
aagggattttcaagggtagttttgaygacacaaagtctgccttataaact

SEQ ID NO: 98802 - DNA, 50 bp, homo sapien
gaccacagcttgcttccctaatgaargactagtggttcacgtcaacccca

SEQ ID NO: 98803 - DNA, 50 bp, homo sapien
tgaaagattctcacctgtaacgtaamtaagtaacaggactctaaatgata

SEQ ID NO: 98804 - DNA, 50 bp, homo sapien
ttttaaaatgtgtatattgatgaacraaagcacattaattattgcagctg

SEQ ID NO: 98805 - DNA, 50 bp, homo sapien
taccaacagactttctctgtgtgtcyatattgaatgccctgacagagcat

SEQ ID NO: 98806 - DNA, 50 bp, homo sapien
caagatagccagaaattatatttcckgatggagtatacaatctgcctttg

SEQ ID NO: 98807 - DNA, 50 bp, homo sapien
gagagaggagtggtaatactaattasaaaggtactacaaacaacagcatg

SEQ ID NO: 98808 - DNA, 50 bp, homo sapien
cacttccatatggtttcttttctccracatgggactattcagttgacctt

SEQ ID NO: 98809 - DNA, 50 bp, homo sapien
agtagcagggcattgactgttccatraattccaaggtggaaggagtatca

SEQ ID NO: 98810 - DNA, 50 bp, homo sapien
ggagaaaaactacataagactaatamccatcagtacttgtacccatttaa

SEQ ID NO: 98811 - DNA, 50 bp, homo sapien
catatttctctgaggtctgataaaamgtttgttggattaatttaataaca

SEQ ID NO: 98812 - DNA, 50 bp, homo sapien
atttgaatgcgttctctctagtaagrccttggtttttatatgttctgaga

SEQ ID NO: 98813 - DNA, 50 bp, homo sapien
tctctcagttggtatgctaaatttcrggccttgtggcactctgatcacct

SEQ ID NO: 98814 - DNA, 50 bp, homo sapien
accatgctcccctatcaccccatacrttttctagttggctattacccctt

SEQ ID NO: 98815 - DNA, 50 bp, homo sapien
gaaatagcgatgcaaaaaagagcacrgtaccttcaggaaatcacaattat

SEQ ID NO: 98816 - DNA, 50 bp, homo sapien
atgctttaatttcctttgtgagaacygagcagaactctaaatagtccttt

SEQ ID NO: 98817 - DNA, 50 bp, homo sapien
attgcagatttgtgtgtgtattacarcaatcttgggggcagatgacagca

SEQ ID NO: 98818 - DNA, 50 bp, homo sapien
caaagtttcctagcgcttgtaatacygccttagatttttatctattcaat

SEQ ID NO: 98819 - DNA, 50 bp, homo sapien
tgacagaaactcaacccaaaccatastaaggaaaggaatttattggctca

SEQ ID NO: 98820 - DNA, 50 bp, homo sapien
tagaagacaggaattagcggatctcrcaaccacactctagtcactcatag

SEQ ID NO: 98821 - DNA, 50 bp, homo sapien
taaggatgttccttaattacagttasaggagctataacactgcctccaac

SEQ ID NO: 98822 - DNA, 50 bp, homo sapien
tttaccagttaagaaacattagagasacttgtcaggttccttggaggaag

SEQ ID NO: 98823 - DNA, 50 bp, homo sapien
ctttcagaaggcactggattactcamagcagactccctcctattacgata

SEQ ID NO: 98824 - DNA, 50 bp, homo sapien
aaaaaagcagcccactgaataatcartctctaaagcctactcttcatctt

SEQ ID NO: 98825 - DNA, 50 bp, homo sapien
ttccattgccactgaaatttattgcycactttcataaaagtctattgcaa

SEQ ID NO: 98826 - DNA, 50 bp, homo sapien
gtttcaatgacaccaatacatggcamgtaaaaccacaattccctcagtga

SEQ ID NO: 98827 - DNA, 50 bp, homo sapien
ttcaaaacgctttacatgttactctwaatttcaccaccttaataagagag

SEQ ID NO: 98828 - DNA, 50 bp, homo sapien
tgaaagaggttggtatttactccacragagaagctcaacaccaggcgatg

SEQ ID NO: 98829 - DNA, 50 bp, homo sapien
agtaactcaaacaggagagaagtttrtatatctgtctccaaacagtccag

SEQ ID NO: 98830 - DNA, 50 bp, homo sapien
gagccgactgccaagcagctccaaaytattctcaatgtgatttctctcta

SEQ ID NO: 98831 - DNA, 50 bp, homo sapien
agaagctgccacatctctgttggagracgcttgtacccatactctcaaca

SEQ ID NO: 98832 - DNA, 50 bp, homo sapien
tgacaagaacattgccaaaactgacragcctaaactgtttctgtcaatga

SEQ ID NO: 98833 - DNA, 50 bp, homo sapien
tgtagactatactttttatggtaaargcaatgtaggctgataacagtgtt

SEQ ID NO: 98834 - DNA, 50 bp, homo sapien
tgcttttcaatctgttgctcccttakatgatcactgtttgaggtccttgt

SEQ ID NO: 98835 - DNA, 50 bp, homo sapien
actgagtttcaactctgataaaaaawaaaactgttagtgttacatgatag

SEQ ID NO: 98836 - DNA, 50 bp, homo sapien
aaaactgttagtgttacatgatagcrcctatattctaaaggcgaatgagg

SEQ ID NO: 98837 - DNA, 50 bp, homo sapien
ctgctctgcttgatttttccttataygccttatcattatattatatatgt

SEQ ID NO: 98838 - DNA, 50 bp, homo sapien
ttcactgtcgtcatctggtattctgyaatggcaatttcattcattctttc

SEQ ID NO: 98839 - DNA, 50 bp, homo sapien
tctagaaccctttgataggcagctasgaaataataaacccctgcccttct

SEQ ID NO: 98840 - DNA, 50 bp, homo sapien
acattttgtatccttttttccatctkacattataccatattttatcttat

SEQ ID NO: 98841 - DNA, 50 bp, homo sapien
gccttctatctagatggttttctccrcatatatttatacatacaattact

SEQ ID NO: 98842 - DNA, 50 bp, homo sapien
aggtagacaagaaatatgtcaaagtsaatttgtaaataatcaaaacaaat

SEQ ID NO: 98843 - DNA, 50 bp, homo sapien
tacctagaaagcaaaggcctgaaccraatcttcagtcatatggaatgcaa

SEQ ID NO: 98844 - DNA, 50 bp, homo sapien
ggaagagaaaataggcttaaaatacmacttaaatcattagatactggaat

SEQ ID NO: 98845 - DNA, 50 bp, homo sapien
gtagctaaaaaactagtatgtttgayggaataaattgagaatgaatccta

SEQ ID NO: 98846 - DNA, 50 bp, homo sapien
ccaccagtgagtcttttaaggttcarctaaacatttcagactcataaagt

SEQ ID NO: 98847 - DNA, 50 bp, homo sapien
gtacagcaatgcttagaaataacaayctgaacattttaatgttgcttcaa

SEQ ID NO: 98848 - DNA, 50 bp, homo sapien
acccccagatgagcgcttagttgcamagtgacaagatccacattggatgg

SEQ ID NO: 98849 - DNA, 50 bp, homo sapien
agctacaagctgcaaatatgagtgaraaggttaatatttttaatattctt

SEQ ID NO: 98850 - DNA, 50 bp, homo sapien
tgctcagacataacagaacaaaaccmatgataagaggaagtagagctaat

SEQ ID NO: 98851 - DNA, 50 bp, homo sapien
attcttaaatgttgacatccactcaytaggatctaaacacaatttaaata

SEQ ID NO: 98852 - DNA, 50 bp, homo sapien
atgtatatttttcaaagaggaccackgaatcctgttctctaacccaaggg

SEQ ID NO: 98853 - DNA, 50 bp, homo sapien
tccacaaatactaaaattgcaaaaaygattttggtgagaagtggcgagga

SEQ ID NO: 98854 - DNA, 50 bp, homo sapien
tattgcttagtaattgttggtgctgyagaaacatagcctaagagctgtct

SEQ ID NO: 98855 - DNA, 50 bp, homo sapien
tgggactagacagcagactcatcgtracagctgcccagaagattttcttg

SEQ ID NO: 98856 - DNA, 50 bp, homo sapien
tgtgtcctctttaattttcttatctkactttacacattcttcttctactc

SEQ ID NO: 98857 - DNA, 50 bp, homo sapien
catcatttttcatttcctctactgayggacagttaatttgcatgtatcaa

SEQ ID NO: 98858 - DNA, 50 bp, homo sapien
tgaattcattccaatcattccttaawagtcaactcaagttcatttcttta

SEQ ID NO: 98859 - DNA, 50 bp, homo sapien
cttttgtctatattctctttaaagaygtaacggcacaataaaaaagaatt

SEQ ID NO: 98860 - DNA, 50 bp, homo sapien
taggtattaaaaaaaatctctttacwctcatcatgctaggccagagtagg

SEQ ID NO: 98861 - DNA, 50 bp, homo sapien
gtttcccagaaactgtgttaggtaayagacacaaaatgtaaatatgtcac

SEQ ID NO: 98862 - DNA, 50 bp, homo sapien
tgaaaaatgtagcaatagaaaaaaamtcaattgaatcagaacaacatata

SEQ ID NO: 98863 - DNA, 50 bp, homo sapien
ggtaaagcagtagtaattttgtagckcaactgtgatgtcacagatgtgca

SEQ ID NO: 98864 - DNA, 50 bp, homo sapien
agactaatattttcccaatttttccraatctgatgaataacagaaactca

SEQ ID NO: 98865 - DNA, 50 bp, homo sapien
ggcttgaatttctctccagaaaatgyggttttgttttctatagcatcatc

SEQ ID NO: 98866 - DNA, 50 bp, homo sapien
attagaaggatatatgtaaaatagakgcataagttagtcttcaacaaaaa

SEQ ID NO: 98867 - DNA, 50 bp, homo sapien
tgttattgaaaaatagctaaacttaragtcattcagaaagacaaataaaa

SEQ ID NO: 98868 - DNA, 50 bp, homo sapien
aatattagaaattgcttcagtataakaaagctttaaacacttttagagca

SEQ ID NO: 98869 - DNA, 50 bp, homo sapien
ttctctcattcctaggcacgatctayggcccttctacaatgctccaggaa

SEQ ID NO: 98870 - DNA, 50 bp, homo sapien
aagcatttcagttctcctctatccarattccttctattttctctttctaa

SEQ ID NO: 98871 - DNA, 50 bp, homo sapien
tagatagatagataatagatagagaytaaagcctttcaatactgactttc

SEQ ID NO: 98872 - DNA, 50 bp, homo sapien
tggtggctcatttaactgagtaagayagagatatctgaattaaggcacaa

SEQ ID NO: 98873 - DNA, 50 bp, homo sapien
caacaggcatggttatatgaaaatcrcatatggtatcttttaaactgtta

SEQ ID NO: 98874 - DNA, 50 bp, homo sapien
taaacaaggacattcaagcccttackaacaaaagatggaccctggagcat

SEQ ID NO: 98875 - DNA, 50 bp, homo sapien
tatacctagcttacacataccaaaaygccaatatatgtattcacctttgt

SEQ ID NO: 98876 - DNA, 50 bp, homo sapien
ctttctatctacttcaatatttgatyacaacattttgagaaatatgctca

SEQ ID NO: 98877 - DNA, 50 bp, homo sapien
gactttgttcatggtaccagagtgayataattaatgaggcagggcaaatc

SEQ ID NO: 98878 - DNA, 50 bp, homo sapien
ttgtgaaaattttgacaaaagaggawcatagaattgattgaatgattgcc

SEQ ID NO: 98879 - DNA, 50 bp, homo sapien
tagtagggaagacagacatgcctaarttacttaatctcccaaaagctgta

SEQ ID NO: 98880 - DNA, 50 bp, homo sapien
ccccagagttctgattagtaaagaaytgactgcacaaatataaaaatcag

SEQ ID NO: 98881 - DNA, 50 bp, homo sapien
taattttaaatactatggtatggaaytaaaggagatacatagatagatgt

SEQ ID NO: 98882 - DNA, 50 bp, homo sapien
aacatatacttctccacaacatatcygctcctccaggacaattgcagaca

SEQ ID NO: 98883 - DNA, 50 bp, homo sapien
taatactcaacaattaaatgtgtgtraaatattgtagtctaatggaaaaa

SEQ ID NO: 98884 - DNA, 50 bp, homo sapien
gtgggtctctcttaaaagatggaacsaagttagcatttaagccacgacta

SEQ ID NO: 98885 - DNA, 50 bp, homo sapien
tttccatacaacccctatcttggacmctgatgtagtttatattcaaaact

SEQ ID NO: 98886 - DNA, 50 bp, homo sapien
tggggaaacttaaaaatgaaacttaygccttacagtctgtcttgatttga

SEQ ID NO: 98887 - DNA, 50 bp, homo sapien
ctttgagcacttcaaatgacacttckatatttgtaccttacacaaaggat

SEQ ID NO: 98888 - DNA, 50 bp, homo sapien
aagttaatgatattttgtttataaaytgtggagcatagagcctgtaatat

SEQ ID NO: 98889 - DNA, 50 bp, homo sapien
agaaagaaatgtttgaggctgcaaayttctgcaatgtaggggttgttttg

SEQ ID NO: 98890 - DNA, 50 bp, homo sapien
cataaacactcttaaaaaaatgtaarcctctgaatttgcaacataagtta

SEQ ID NO: 98891 - DNA, 50 bp, homo sapien
aattgcttttgaggacttagatatawattctttgcaaaagctgatgtcaa

SEQ ID NO: 98892 - DNA, 50 bp, homo sapien
aaaggctgccctctgggacatgcatratacaaagtccagaagaaaggttg

SEQ ID NO: 98893 - DNA, 50 bp, homo sapien
gctctgctactgtcaatatatgtgartaatgcaaaaatacttaaaaattg

SEQ ID NO: 98894 - DNA, 50 bp, homo sapien
gcttgtatggattggaaaaggcctgycagtagagcaaaacaatacaaatc

SEQ ID NO: 98895 - DNA, 50 bp, homo sapien
aaatctaatcttaacaaatatcacckcaagttactaaagtcacttgactg

SEQ ID NO: 98896 - DNA, 50 bp, homo sapien
agcagttcaatgtaaatgaactattraatacagaggccatgaaacatctg

SEQ ID NO: 98897 - DNA, 50 bp, homo sapien
agttttttgatggctgcttaaatcaragaattgtataaagaaccttaatc

SEQ ID NO: 98898 - DNA, 50 bp, homo sapien
agacacccaggaattctgtactaaawtaagcattcctttattgccaatgg

SEQ ID NO: 98899 - DNA, 50 bp, homo sapien
ggagagaatgtgcagcagtaaaatgwtcaaacaattttggaatggaagct

SEQ ID NO: 98900 - DNA, 50 bp, homo sapien
ggaaattgtctccttatagattctastaaacattttcagtaaaaataaag

SEQ ID NO: 98901 - DNA, 50 bp, homo sapien
ccttggcatgtactgttcatgctaaygctaactttctgcactctcagatg

SEQ ID NO: 98902 - DNA, 50 bp, homo sapien
ccatgagaaatctctacatacaatgraaataattatagttataaatccaa

SEQ ID NO: 98903 - DNA, 50 bp, homo sapien
gctcttctgttctctgtcaataaagwattaaatatgcatgtttatggggc

SEQ ID NO: 98904 - DNA, 50 bp, homo sapien
ttcttgaaagtaatatatttacaaawtcaagaagttcaacaaacactaat

SEQ ID NO: 98905 - DNA, 50 bp, homo sapien
ataatttcataatataggttttcagwagataaataagtaaaatgttttct

SEQ ID NO: 98906 - DNA, 50 bp, homo sapien
atcttaaagactggttattgttgtcrcctctgtataagaaaaaaatgcaa

SEQ ID NO: 98907 - DNA, 50 bp, homo sapien
ctgaatcctgattctgcttgtagtamcattcatgtgcacctgaatatgca

SEQ ID NO: 98908 - DNA, 50 bp, homo sapien
ttcaacctggataagcaaaaggaaamgctaactctatttagtaaacatct

SEQ ID NO: 98909 - DNA, 50 bp, homo sapien
ctcacttaccaagtggtctctttaaratgtgaaaccaactttaaaacttt

SEQ ID NO: 98910 - DNA, 50 bp, homo sapien
aataagtgaatggataaacaaattawggtatatctatccactgtaatgct

SEQ ID NO: 98911 - DNA, 32 bp, homo sapien
gttttcagcttagggawattataacttaaagc

SEQ ID NO: 98912 - DNA, 50 bp, homo sapien
tttgcctttccttgcatactttggcyaagattatattcttaaaatacatt

SEQ ID NO: 98913 - DNA, 50 bp, homo sapien
ctcatatcctcacttgatgcctttcyattgctttctccttctgggaacat

SEQ ID NO: 98914 - DNA, 50 bp, homo sapien
tgctatacagacttatgtttccaacygtagccacacaacacagtgttaca

SEQ ID NO: 98915 - DNA, 50 bp, homo sapien
gagtctagattaagcaaatcaaaaargtctctgggctcttaggtcagatt

SEQ ID NO: 98916 - DNA, 50 bp, homo sapien
ttttttccctttttttacatacttawctgactttaccttttttggtcttt

SEQ ID NO: 98917 - DNA, 50 bp, homo sapien
ggagaacaatttggtgtataatggaratctgagttctatctttgggccat

SEQ ID NO: 98918 - DNA, 50 bp, homo sapien
aaattcaatccaaacgcactggataycaagggcaagcagataaccaccga

SEQ ID NO: 98919 - DNA, 50 bp, homo sapien
aaatatttcctaccaatatgttccamctttcttctctccttcaaaaatct

SEQ ID NO: 98920 - DNA, 50 bp, homo sapien
tcatttgcttcatgttcctaggaggyatgtatatcaaatactgcaccaga

SEQ ID NO: 98921 - DNA, 50 bp, homo sapien
aatgctccttacttattagctgaaamtgaaggaatgcatttggccaggat

SEQ ID NO: 98922 - DNA, 50 bp, homo sapien
taaggagcattaaaataggcatagargaagtaaacctttaacaaccaaca

SEQ ID NO: 98923 - DNA, 50 bp, homo sapien
ctgtaaggtagaaattggaggtcaakaaaaatttaaacagaggaacagag

SEQ ID NO: 98924 - DNA, 50 bp, homo sapien
ttttctttcttatttaactagaatayaaactccataagagcagggatttg

SEQ ID NO: 98925 - DNA, 50 bp, homo sapien
gtagtctcatgctccataccctcacyggcttcagtttctatggctctccc

SEQ ID NO: 98926 - DNA, 50 bp, homo sapien
tttacatagcactttatattgccaartgttttacaattaattctagcagt

SEQ ID NO: 98927 - DNA, 50 bp, homo sapien
tctaacctcaaatggctgagctgaastcctgtgatgtcaacctagttttc

SEQ ID NO: 98928 - DNA, 50 bp, homo sapien
ttttttttttttttggcatatgaaartttattactacagtgttttcacca

SEQ ID NO: 98929 - DNA, 50 bp, homo sapien
aggggtatttggaaagctaaataagwctgaatagcatggggacgtaacct

SEQ ID NO: 98930 - DNA, 50 bp, homo sapien
tgaaaacatgatttaggtcaagctcraatcctatagccttaggcaagaag

SEQ ID NO: 98931 - DNA, 50 bp, homo sapien
agaagtaaaatatatatttatgttawgtttggtaaatttatgttgttttg

SEQ ID NO: 98932 - DNA, 50 bp, homo sapien
cagttcaacagtaaaatgaatcttascagttagaaaatcaatacagagat

SEQ ID NO: 98933 - DNA, 50 bp, homo sapien
aagagcatgttttccttggcttttgsattaatacaataaagcctgtgaag

SEQ ID NO: 98934 - DNA, 50 bp, homo sapien
gttgttgctgctattgttattatgaygtacttggccctcttccagaccca

SEQ ID NO: 98935 - DNA, 50 bp, homo sapien
aactatgctgggagttctatatacaytatcccctttaacaccatgagatg

SEQ ID NO: 98936 - DNA, 50 bp, homo sapien
cctgaatagtaaccagatgtacaaartgatagaaatagcttggaaacgct

SEQ ID NO: 98937 - DNA, 50 bp, homo sapien
acactgttaggtcttttgctccctcrcagtggagtttttgcatgatagtc

SEQ ID NO: 98938 - DNA, 50 bp, homo sapien
actccaaacacataaaatgatagatwaaatagagcaagaggtaaactaga

SEQ ID NO: 98939 - DNA, 50 bp, homo sapien
ggagacagaagaaaggattaaattcrgaacttagaaggccttctctacca

SEQ ID NO: 98940 - DNA, 50 bp, homo sapien
acacaggttatttaaaatgcttaaargattgtctgacatgccagaagtgt

SEQ ID NO: 98941 - DNA, 50 bp, homo sapien
tgaaattatttttttaaatacaaagwactatgcaaatataaagaaatgtt

SEQ ID NO: 98942 - DNA, 50 bp, homo sapien
gcaatctccagcccactgcattgtcraacctgaattccaagccaatgggt

SEQ ID NO: 98943 - DNA, 50 bp, homo sapien
atcaggagactgagatttctcgtcckctggaacagactgtttcctgtggt

SEQ ID NO: 98944 - DNA, 50 bp, homo sapien
caatgaaaatgagatcctcaattccrctcaaacaaaatgtgtctaattat

SEQ ID NO: 98945 - DNA, 50 bp, homo sapien
ctttatataattcccatactacctamcacaagttattcaatatcatccaa

SEQ ID NO: 98946 - DNA, 50 bp, homo sapien
catttgttacctccatttctctctgrtgtcaaagatttttactattatgc

SEQ ID NO: 98947 - DNA, 50 bp, homo sapien
attttgaaataaaagttcagtcatasaaaaaaaatggttacatttctagt

SEQ ID NO: 98948 - DNA, 50 bp, homo sapien
tttcatcactccatggtattaaaaartatctcctagtttgtgatgtgtac

SEQ ID NO: 98949 - DNA, 50 bp, homo sapien
aattaatgactgataactcacacaaraaatagaggcccaagagtacatgt

SEQ ID NO: 98950 - DNA, 50 bp, homo sapien
agtcccctcaactatttcttgactaygcttaggattaaagagctcttcag

SEQ ID NO: 98951 - DNA, 50 bp, homo sapien
tcatgatatacaagtctttaatgccraactgagcatttgaatgtgtaaag

SEQ ID NO: 98952 - DNA, 50 bp, homo sapien
gagaaagaagtggactaaggctgaasgtagaagatatggccagtgaggac

SEQ ID NO: 98953 - DNA, 50 bp, homo sapien
agtatatattattataaacaacatawctatcactgagctcatcttatatt

SEQ ID NO: 98954 - DNA, 50 bp, homo sapien
gctaattatgtgcttttctattcaaragaaactgtctaccactgcccacg

SEQ ID NO: 98955 - DNA, 50 bp, homo sapien
aaacaacgaacgccttttaatctatsatacatcacaattttgcatgataa

SEQ ID NO: 98956 - DNA, 50 bp, homo sapien
ttgctattgtgaattaacagactgcrataaaatattttaatgtagttgaa

SEQ ID NO: 98957 - DNA, 50 bp, homo sapien
ggaggattgggagcaagaccaggaargtaatgtggatctgtattccatag

SEQ ID NO: 98958 - DNA, 50 bp, homo sapien
ttaatagtaatggacaaatagctaartatatcaggatggcattcaaaaag

SEQ ID NO: 98959 - DNA, 50 bp, homo sapien
ggcttagaaattagagtagatataayagagttgattaacaatggaaaaag

SEQ ID NO: 98960 - DNA, 50 bp, homo sapien
ttatcacatgtttaatagtgataaasgtgccacaatatttcaaaaagttt

SEQ ID NO: 98961 - DNA, 32 bp, homo sapien
aagtacagagaatgtawcttgtatttgactta

SEQ ID NO: 98962 - DNA, 50 bp, homo sapien
gtctctgtcataagaacatggcatcrgaatattaatgcctgaaagaacct

SEQ ID NO: 98963 - DNA, 50 bp, homo sapien
gaactgattaattacaaccgcatcayacgccatatgtattcaaaaatacg

SEQ ID NO: 98964 - DNA, 50 bp, homo sapien
gcaccatagagattcttagcataacrgatcagtcattgatttttgcagta

SEQ ID NO: 98965 - DNA, 50 bp, homo sapien
attgagcaatttatctttcatggcastgaaaatgaattataaatgttaaa

SEQ ID NO: 98966 - DNA, 50 bp, homo sapien
cattcacaaatacattccacttgctwaatagattttggtttcgattttac

SEQ ID NO: 98967 - DNA, 50 bp, homo sapien
aaggcttctctcatttcttaactgamgtatatgtcttcccttttgaagta

SEQ ID NO: 98968 - DNA, 50 bp, homo sapien
tacacagttcttcagatcacagaaayctaattgcctttgaaatgacagtc

SEQ ID NO: 98969 - DNA, 50 bp, homo sapien
gatgatgatttttccattgtattcaratgatgtaacctgacgccatccaa

SEQ ID NO: 98970 - DNA, 50 bp, homo sapien
caaactgatttttgcacatcagagargggagtctattaaatttctactgc

SEQ ID NO: 98971 - DNA, 50 bp, homo sapien
cagaccctgctctaagcactttacarctaagtcattgaaatctcccagca

SEQ ID NO: 98972 - DNA, 50 bp, homo sapien
gttcacacttgaaaacataaatacawtaaaacatttcaaactgcatttat

SEQ ID NO: 98973 - DNA, 50 bp, homo sapien
cgacgggcacactttaatttctatargcatggagatagcatggtgtagtg

SEQ ID NO: 98974 - DNA, 50 bp, homo sapien
tgaaagtaatccaaagccagttctckaaattacgcagattgtgcctcttc

SEQ ID NO: 98975 - DNA, 50 bp, homo sapien
acgatattttgaacattccttacacyacttaacttcacaaaaaggcgcaa

SEQ ID NO: 98976 - DNA, 50 bp, homo sapien
ttaagtctctagatttgttcatctakgtggagttaaaaatttcattggca

SEQ ID NO: 98977 - DNA, 50 bp, homo sapien
gaaagaagatgaatataatggttgtkaaaagatagacttgtataatatgt

SEQ ID NO: 98978 - DNA, 50 bp, homo sapien
atacatccaacttgaggtataggtargttgcccaagaagaaatgtctagt

SEQ ID NO: 98979 - DNA, 50 bp, homo sapien
agtctagaaggggtagaaggaaactyacaaggtcataagaacttgtccac

SEQ ID NO: 98980 - DNA, 50 bp, homo sapien
agtataattttttatttctagctaamccaattttaagctattttgaagat

SEQ ID NO: 98981 - DNA, 50 bp, homo sapien
acattgaaacattgggcacggaaaarcatttaatttgatgaggtaacttg

SEQ ID NO: 98982 - DNA, 50 bp, homo sapien
tgcagagggacaggtcagattgtgtsaaggttctatgcaaactgcccaag

SEQ ID NO: 98983 - DNA, 50 bp, homo sapien
tatttgtacaaaagtttctaagtacrcaagaggaacttgcaggtcatttt

SEQ ID NO: 98984 - DNA, 50 bp, homo sapien
aaaggctaaaatattttccacttgamtaaggcagtattaaaaacgaatta

SEQ ID NO: 98985 - DNA, 50 bp, homo sapien
ttcctgtttcaatcatggtaagttasacgtgatcaaaaatttataccttt

SEQ ID NO: 98986 - DNA, 50 bp, homo sapien
ccagttgagaatgagttcctattacmggtgaagaaaccattccaattgca

SEQ ID NO: 98987 - DNA, 50 bp, homo sapien
gataaaatcgacttgttttggattayctgttttgaatgaaaaacaaatat

SEQ ID NO: 98988 - DNA, 50 bp, homo sapien
cacctactgaaagccatcctggaaaytgtcaggtaataggagcagaaaag

SEQ ID NO: 98989 - DNA, 50 bp, homo sapien
gggggaacttaatttggaaactttarttgatgtaattaacgcttatggaa

SEQ ID NO: 98990 - DNA, 50 bp, homo sapien
aggatcagcctgatcaaatgttcaamgcgcttgcaacctgctgttaagga

SEQ ID NO: 98991 - DNA, 50 bp, homo sapien
tccagtatagggagagaaactattarcactttctttcctaacccacattc

SEQ ID NO: 98992 - DNA, 50 bp, homo sapien
ctgctcataagactgtgagtagttayagcagtgaaacaggatcagcctga

SEQ ID NO: 98993 - DNA, 50 bp, homo sapien
atactggaagatggcacgttaaagaragaaagatggcttggtcagattaa

SEQ ID NO: 98994 - DNA, 50 bp, homo sapien
aatcactaagctagttcataaaccaygacacaattgtagtatatcagata

SEQ ID NO: 98995 - DNA, 50 bp, homo sapien
aagatctgttttcttctcatggagaytagactgtatcagttctcctggga

SEQ ID NO: 98996 - DNA, 50 bp, homo sapien
cccctgtaatatacttaaatggtaaygatgcttacttacttactgtcaat

SEQ ID NO: 98997 - DNA, 50 bp, homo sapien
aaataccaactatgcaaatagttgasctgtttaagcatgagatatatctg

SEQ ID NO: 98998 - DNA, 50 bp, homo sapien
cttccttaaggcttcctgttcaagaygatgacttccagactttactggga

SEQ ID NO: 98999 - DNA, 50 bp, homo sapien
gctgtatgagtgatgctggagtcaartaactggtataaaaatgagccttg

SEQ ID NO: 99000 - DNA, 50 bp, homo sapien
cccatctaacttaaagaaccttataygtgcatgtggtgagctctttagaa

SEQ ID NO: 99001 - DNA, 50 bp, homo sapien
ctttgatacttattctttgtgaaatratacctctaatcttagaatattta

SEQ ID NO: 99002 - DNA, 50 bp, homo sapien
tgcaatttctaagcaataagaaatawgaagattgaatctactcagtaaat

SEQ ID NO: 99003 - DNA, 50 bp, homo sapien
tagaattgatgggcaataaacggtaratgttttggactccctgataaaat

SEQ ID NO: 99004 - DNA, 50 bp, homo sapien
gactttaataattcctgtcctggttyatctttgagtaatttgtgaagagc

SEQ ID NO: 99005 - DNA, 50 bp, homo sapien
ttctcaaactgaaatttagccgaaaragtatatcaaaagcaagacaatat

SEQ ID NO: 99006 - DNA, 50 bp, homo sapien
aaagtgttatatccatataatgtaaygctacttaccaactaaaaggaata

SEQ ID NO: 99007 - DNA, 50 bp, homo sapien
ttgagcgggcttggagaaatgatcargagggccttacctaaagggcacaa

SEQ ID NO: 99008 - DNA, 50 bp, homo sapien
ctagaagtaaatgaaataagtcaaartccttgatctcaagtggcttataa

SEQ ID NO: 99009 - DNA, 50 bp, homo sapien
agatggaggctcacactgaagattaygccctgattcatgtaaaaatattt

SEQ ID NO: 99010 - DNA, 50 bp, homo sapien
atgagatattttgtttgttcatatamaatttcctatctctgacccttcag

SEQ ID NO: 99011 - DNA, 50 bp, homo sapien
atcctttctgccaagtttatttgtartcaagagtggccgctcaatgaata

SEQ ID NO: 99012 - DNA, 50 bp, homo sapien
tttattttcttctcattcttcatagscattaaatggtagctgcatatggc

SEQ ID NO: 99013 - DNA, 50 bp, homo sapien
tactgaattaaacagggaagatatasaacagaatgcattgatcatcacag

SEQ ID NO: 99014 - DNA, 50 bp, homo sapien
tatgagtaatattacaatggtttacyaaggacccatgtaaaaatgtgtgg

SEQ ID NO: 99015 - DNA, 50 bp, homo sapien
agtggggaattcatggagaaatgatmatcagaaattgactatccttgcct

SEQ ID NO: 99016 - DNA, 32 bp, homo sapien
aaaagttctagttctaygcatcctgaatgagt

SEQ ID NO: 99017 - DNA, 50 bp, homo sapien
taaaataggggcatatttagcatagwcaatttattattattatttttttc

SEQ ID NO: 99018 - DNA, 50 bp, homo sapien
gatgatagttttccttagagaagtcmatctatttggttgaatgactagaa

SEQ ID NO: 99019 - DNA, 50 bp, homo sapien
catgctgggtgaaaaagaattggtgraaaatgtctttgtcatacacttaa

SEQ ID NO: 99020 - DNA, 50 bp, homo sapien
taagatcataaaagctagagaaagasacgcttattaaggaaacaaataat

SEQ ID NO: 99021 - DNA, 50 bp, homo sapien
ccttctagatatttatagccaaaccrcttaattcaaagtttactaagagg

SEQ ID NO: 99022 - DNA, 50 bp, homo sapien
atgcctttggctgttagatgcaaaaygctctgaactagtttgttcaataa

SEQ ID NO: 99023 - DNA, 50 bp, homo sapien
gttaacttttatacaatgaataacayatctacttaatactcaaaatattg

SEQ ID NO: 99024 - DNA, 50 bp, homo sapien
ccatgctgaacacttttcttacaacrcagaggtttccttgttttctgtct

SEQ ID NO: 99025 - DNA, 50 bp, homo sapien
aatagtgagctgctgaatcaggctayacccaaactgcactagaaggcaac

SEQ ID NO: 99026 - DNA, 50 bp, homo sapien
cccactctaaaaaagctttagaataygcctgaaaaatatgctgatctgca

SEQ ID NO: 99027 - DNA, 50 bp, homo sapien
aaattggccctgttactctaaatgamcttgactaataaagattttgttgt

SEQ ID NO: 99028 - DNA, 50 bp, homo sapien
tacatgtttataactttcttgaaaayacctcagtgtatacaatgggatgt

SEQ ID NO: 99029 - DNA, 50 bp, homo sapien
caataaatggcaccatataaaacagraactgttggagagcattttatctg

SEQ ID NO: 99030 - DNA, 50 bp, homo sapien
tgctcacgaatacaggcgttttataygaacatctctaaatctcacttttt

SEQ ID NO: 99031 - DNA, 50 bp, homo sapien
aggatggtttatttccaaaatactaragtgtgttcaaatatggaaacccg

SEQ ID NO: 99032 - DNA, 50 bp, homo sapien
tattgcatatcatatctgtttaggtkcaactttgcttttcttttaaacac

SEQ ID NO: 99033 - DNA, 50 bp, homo sapien
aattgcttttggtgattatgtcatgmaatctttgtttgcacctatgtcct

SEQ ID NO: 99034 - DNA, 50 bp, homo sapien
aaatgtgtgtgctatctttacctcarattaattcaaaagggaaattaatg

SEQ ID NO: 99035 - DNA, 50 bp, homo sapien
aattccactgccctacctgttcctaygcagagattaaaacttcagctctt

SEQ ID NO: 99036 - DNA, 50 bp, homo sapien
cttttaccattattttacagagtagscttgtgtttactttgagtaacttg

SEQ ID NO: 99037 - DNA, 50 bp, homo sapien
gtaaagaaaaatgtaaacataatgayagaaccaaatagaacttctagaga

SEQ ID NO: 99038 - DNA, 50 bp, homo sapien
aaaaaaactctcagagattctaaaakgctgccagggttgaaaatcactac

SEQ ID NO: 99039 - DNA, 50 bp, homo sapien
aaaaaaagacaaactattaacgaatyatggttggtatcatgaaagaaaac

SEQ ID NO: 99040 - DNA, 50 bp, homo sapien
ttcaagtgaatactggatgccaaaasaacacacacaccttagagtgagtt

SEQ ID NO: 99041 - DNA, 50 bp, homo sapien
tgctttttttttttttcttagaggamtatcatgaacaaaggactaaggga

SEQ ID NO: 99042 - DNA, 50 bp, homo sapien
gttccttggagcacatgttaagtggyaatgttccatgcaatagaggttcc

SEQ ID NO: 99043 - DNA, 50 bp, homo sapien
tgaaggttaatagcagtgtttattcwaggtaatgttacaatgtgcttaag

SEQ ID NO: 99044 - DNA, 50 bp, homo sapien
aggctctgtcatgtgtggagaactaygaacacatgtgtgtgggtaggtag

SEQ ID NO: 99045 - DNA, 50 bp, homo sapien
gtgaactaagtaattaattcatgttscaaaggtgacttattgacttgcaa

SEQ ID NO: 99046 - DNA, 50 bp, homo sapien
ctatttacatttcagctttctcatamgtaaatggtcacctgtttctaaca

SEQ ID NO: 99047 - DNA, 50 bp, homo sapien
ttggggataataagaggcatgaagawctcttccaggatgaattgtttgtg

SEQ ID NO: 99048 - DNA, 50 bp, homo sapien
tactaacaagacagtctaaataactyaggaatagctgctgtgtcaaatct

SEQ ID NO: 99049 - DNA, 50 bp, homo sapien
accattggaagactcaacattgttcraatattattattattaaaatatct

SEQ ID NO: 99050 - DNA, 50 bp, homo sapien
ttaagatcagcaaaggtctacttacyatcacattaaaatgatgcacctct

SEQ ID NO: 99051 - DNA, 50 bp, homo sapien
tctgttatttgtacctagatccaccrataatctcagaaggctatatatgc

SEQ ID NO: 99052 - DNA, 50 bp, homo sapien
aacaatttagtggaagtatcaaaagrattgaagcaaatactgtaacagtt

SEQ ID NO: 99053 - DNA, 50 bp, homo sapien
gctgctctagagctgagaactgaaaygaattgtcttatgggttctcaagg

SEQ ID NO: 99054 - DNA, 50 bp, homo sapien
ccagtgtagaattgcagacgtggaargttaaaacaaggtacattgatata

SEQ ID NO: 99055 - DNA, 50 bp, homo sapien
ggcctttgtcttctcccatttctaayttactttgtttacttttcgttgaa

SEQ ID NO: 99056 - DNA, 50 bp, homo sapien
ctagatgaaaatttacaatgtaagasgagtatcatgccacaagaaattct

SEQ ID NO: 99057 - DNA, 50 bp, homo sapien
atatgtgattactggcttcaaagtaygtgtaacaactaccctttttgaat

SEQ ID NO: 99058 - DNA, 50 bp, homo sapien
agactttaagttacttttgaactacraacatgtgaaaaattacaaatagg

SEQ ID NO: 99059 - DNA, 50 bp, homo sapien
atgttgggaactaatgcaataataaraactttggtccaaaatcacacaaa

SEQ ID NO: 99060 - DNA, 50 bp, homo sapien
accacctccgatgaaacctctaaacyatgtttcccaattactttttaata

SEQ ID NO: 99061 - DNA, 50 bp, homo sapien
aactggatgtcaattagaaggtccasgcttcctggagtggcttctcttcc

SEQ ID NO: 99062 - DNA, 50 bp, homo sapien
aaggagatcaccagggcttggctagrtcacagctctgtggctgcatctag

SEQ ID NO: 99063 - DNA, 50 bp, homo sapien
aattttctgagtaacgactcagtacmatcagtaaagtagtagaatacaaa

SEQ ID NO: 99064 - DNA, 50 bp, homo sapien
taagccaagaaaatcttcagtcttgsaatggttggatttcttaaaagtag

SEQ ID NO: 99065 - DNA, 50 bp, homo sapien
aattacttagtaaataataggaagakatgttgaaatacaaactttctgcc

SEQ ID NO: 99066 - DNA, 50 bp, homo sapien
ccactgctcctgcacttgttcagaamctcatcacttcttctcagaaaatg

SEQ ID NO: 99067 - DNA, 50 bp, homo sapien
ttcaaaacatctctgctcagctcaaygatctcccacactcctgaataacg

SEQ ID NO: 99068 - DNA, 50 bp, homo sapien
agagaggtgggggaaaaaagttaaasatcatgcccaggtcacgaggtata

SEQ ID NO: 99069 - DNA, 50 bp, homo sapien
aattgggaaatgcattattttcagayagaaagcaagaaaaatattatgat

SEQ ID NO: 99070 - DNA, 50 bp, homo sapien
ataaatgaggtctggcagagtttgayggcaggtttatgatataagctcta

SEQ ID NO: 99071 - DNA, 50 bp, homo sapien
acaagatggtgtatatatttgcagawgagaagaatcaaataattgaagtt

SEQ ID NO: 99072 - DNA, 50 bp, homo sapien
agatagcattggagaaaaactgtcaygaagaaaattaaatggtaacatgg

SEQ ID NO: 99073 - DNA, 50 bp, homo sapien
tcttaaggaaataaaaagatctaaamattgcaccatgtcaaatgaaaatg

SEQ ID NO: 99074 - DNA, 50 bp, homo sapien
catgactagttaaccaaacattacaytaaaacaaataatcttctaattgt

SEQ ID NO: 99075 - DNA, 50 bp, homo sapien
caggaaatatgatacttaataaaagycctacagaaaacactgaaattcca

SEQ ID NO: 99076 - DNA, 50 bp, homo sapien
aaatatttgaagcagcttacaataaygtatatactaatagacaatcagaa

SEQ ID NO: 99077 - DNA, 50 bp, homo sapien
aacgttcatcagagctagagcatgargaaacatagcataattttcaaggc

SEQ ID NO: 99078 - DNA, 50 bp, homo sapien
tttactttgttctgtggtcacagacrgatacctcatcctatccagctgtc

SEQ ID NO: 99079 - DNA, 50 bp, homo sapien
gtacttaggactgttttctgtagcayaatgcatcttcactgtcactttat

SEQ ID NO: 99080 - DNA, 50 bp, homo sapien
caaggttaatgtacatgctatttcayggaaccaaacaaaaatatatgatg

SEQ ID NO: 99081 - DNA, 50 bp, homo sapien
cttactggtatatcagaacaaaatcrttcaagcccatgaatcagaagata

SEQ ID NO: 99082 - DNA, 50 bp, homo sapien
ccaaaacaagcttacatctggtgtasgaaagttttaatattaaattataa

SEQ ID NO: 99083 - DNA, 50 bp, homo sapien
ggaatgttgaagactcccaggattamagttggacttgagtagaaagaagc

SEQ ID NO: 99084 - DNA, 50 bp, homo sapien
ctccaattctacccctcacagagcawatggtattggtcattgaaatggtt

SEQ ID NO: 99085 - DNA, 50 bp, homo sapien
agataaaactcaaaacttcattagaraggtactgagacatcatttagtcc

SEQ ID NO: 99086 - DNA, 50 bp, homo sapien
ggaagctgtagatgagagaggacctyacctaatttaatgctttgttttaa

SEQ ID NO: 99087 - DNA, 50 bp, homo sapien
aatctcatcctggcatctgcttctcyaataaggactgatgcactgaggaa

SEQ ID NO: 99088 - DNA, 50 bp, homo sapien
ctagagtgattctatgattttcaagscttaagtaaattcagtagcctttt

SEQ ID NO: 99089 - DNA, 50 bp, homo sapien
tgcctcaaatatttacacccaaatamggcatcatcacagggaattaacct

SEQ ID NO: 99090 - DNA, 50 bp, homo sapien
acttgaattagttatgaaagagcaaytagttatgggaaaagagcaagaga

SEQ ID NO: 99091 - DNA, 50 bp, homo sapien
tgcttgttattattttaattaatagyaaatgcagtgtggtggttttataa

SEQ ID NO: 99092 - DNA, 50 bp, homo sapien
aacatcttgttgtccttactgttgckagtatgtccgctgccaccctttca

SEQ ID NO: 99093 - DNA, 50 bp, homo sapien
aagcaataatgcgtattaagagcacrgtattattgttgattaaattctca

SEQ ID NO: 99094 - DNA, 50 bp, homo sapien
cttacaatccagatattaaatgggargaaagtaacattaagaagcaggaa

SEQ ID NO: 99095 - DNA, 50 bp, homo sapien
tataaattccaagttttcctacatcrctcctactttgtagaacatttggt

SEQ ID NO: 99096 - DNA, 50 bp, homo sapien
taactttgggctttcggtggaaatcyatataggcttaaaagatgcagaga

SEQ ID NO: 99097 - DNA, 50 bp, homo sapien
aattccttttctatcttcctgacaaygctatttgcaaataaatgaaagaa

SEQ ID NO: 99098 - DNA, 50 bp, homo sapien
tatcttggaggcttgtgcttttacaraattataagtggtgtaaaccatct

SEQ ID NO: 99099 - DNA, 50 bp, homo sapien
ctaccaacaaagattctgacatacayggattttctggtccaaagaatcct

SEQ ID NO: 99100 - DNA, 50 bp, homo sapien
ttttcgtttgtttgttttgagcccakgtacacactactttaataaacttt

SEQ ID NO: 99101 - DNA, 50 bp, homo sapien
actttaatatcaggtttggacactcyacaattataataccagaaacctgg

SEQ ID NO: 99102 - DNA, 50 bp, homo sapien
caacaattcatgttggattacctatrcaggctgacattttcaatctcaac

SEQ ID NO: 99103 - DNA, 50 bp, homo sapien
tgccaattttatgttagagctgaaaytgtaaaagtgcaatccttggtttc

SEQ ID NO: 99104 - DNA, 50 bp, homo sapien
caatagctgaggaactagaatttcasaagagtagagaaaaatacagttgg

SEQ ID NO: 99105 - DNA, 50 bp, homo sapien
atggagaagttaggtaactcttccaygatcaacacacacacacacaccag

SEQ ID NO: 99106 - DNA, 50 bp, homo sapien
agctgctccaccaagtttgggatcargtattttggctaatggaagacaaa

SEQ ID NO: 99107 - DNA, 50 bp, homo sapien
ttctttcatcactaatgagactgaayatatgcactgaacatatgttaatt

SEQ ID NO: 99108 - DNA, 50 bp, homo sapien
tccattgagctgccactccagtcctraactacgtaccgaaaccttgatgt

SEQ ID NO: 99109 - DNA, 50 bp, homo sapien
ggtactgtgccactcatacacatcaratcttcctcacgtccttcccaata

SEQ ID NO: 99110 - DNA, 50 bp, homo sapien
ccactacaaagtgtaggtagttaagrgaaagtcaggcacactttttaaac

SEQ ID NO: 99111 - DNA, 50 bp, homo sapien
aataacccctatatatgctttagaaratgttactgtctcgtagggagatg

SEQ ID NO: 99112 - DNA, 50 bp, homo sapien
gggataaataatgctacagcctatamaaataatctgaggacatgttaatc

SEQ ID NO: 99113 - DNA, 50 bp, homo sapien
atgccatgcagttcctacggttaggraagtcaaggttttgtcatagttac

SEQ ID NO: 99114 - DNA, 50 bp, homo sapien
agtggcagaaaaagcagaggtttacrggtcagaaaatgaaagtgaacgga

SEQ ID NO: 99115 - DNA, 50 bp, homo sapien
tctaacaatgacttctcatataacaygctgaaatttcattttaatgccac

SEQ ID NO: 99116 - DNA, 50 bp, homo sapien
taaaaagtagaaataaagcaataaamtttaaacactattttcaagtattt

SEQ ID NO: 99117 - DNA, 50 bp, homo sapien
ctagtaaagtctttgtcatctaaaawtaacatactctctcttaagacttt

SEQ ID NO: 99118 - DNA, 50 bp, homo sapien
gatcttatgacaaggctttagcttcraagacggaaataaccagatagtta

SEQ ID NO: 99119 - DNA, 50 bp, homo sapien
tctttcactgtaattaccatctttcrctatttatatatgacctggagttt

SEQ ID NO: 99120 - DNA, 50 bp, homo sapien
ttatccacagatccatagctgctctsaaacatacgctagaaatcctattc

SEQ ID NO: 99121 - DNA, 50 bp, homo sapien
aacaaatgcaataaatacctaagaawcatgtctaacacacaattattgac

SEQ ID NO: 99122 - DNA, 50 bp, homo sapien
aaagcccaagacatcaagggaatagkcctttctgtggaatataaggccca

SEQ ID NO: 99123 - DNA, 50 bp, homo sapien
ttatggttttataattcaaatttcaraaaagttgttcaccctgtcactgt

SEQ ID NO: 99124 - DNA, 50 bp, homo sapien
ttttagtggatagaaatcctgcgccwtttaattgagtgaataccaggtaa

SEQ ID NO: 99125 - DNA, 50 bp, homo sapien
atatatttcattggtttttaaagtawcagataactaggctatgtaggtaa

SEQ ID NO: 99126 - DNA, 50 bp, homo sapien
ctgactttctttggtttctcttctaygactaatcctacacttttatgttc

SEQ ID NO: 99127 - DNA, 50 bp, homo sapien
atagttcgaacctgggaccattaacraaaaacatgttttgcctcaggctg

SEQ ID NO: 99128 - DNA, 50 bp, homo sapien
tgtacatacatttaaaattaggctckatatttgaaaatggagattctaag

SEQ ID NO: 99129 - DNA, 50 bp, homo sapien
agatctctggattttttcaagaaagrctacagctctgggttgttacatga

SEQ ID NO: 99130 - DNA, 50 bp, homo sapien
aactagtacaaccactatggaaagcwgcatgaagatttttttaaagaact

SEQ ID NO: 99131 - DNA, 50 bp, homo sapien
attgtaggtgatttctttaaagcacrttatcacagatgtacatatttaga

SEQ ID NO: 99132 - DNA, 50 bp, homo sapien
agggagttatacagggaaaacaaaartagttcaattagacaagagtacaa

SEQ ID NO: 99133 - DNA, 50 bp, homo sapien
tttagaaaagccacatacataaatcrcgtaaccacatattttctgtacaa

SEQ ID NO: 99134 - DNA, 50 bp, homo sapien
cagtctaaacgtgcactttgatctgyagacagttaaggttctctgcaact

SEQ ID NO: 99135 - DNA, 50 bp, homo sapien
actgtcaatatgtaaagttctgagartatctccaatggaactcaacttcc

SEQ ID NO: 99136 - DNA, 50 bp, homo sapien
gggaagaatcatcattggagtaatayagtagtttgaaaatctgaataaac

SEQ ID NO: 99137 - DNA, 50 bp, homo sapien
acctggccctaggaacaatcaactcratgacctctatcagcttccttaat

SEQ ID NO: 99138 - DNA, 50 bp, homo sapien
aaataatctggttcagaaagctgcartaatgtaaaaagatggatcacttg

SEQ ID NO: 99139 - DNA, 50 bp, homo sapien
agtgaacaatgccaaagatcacgaarcttttataaagaaaattattttag

SEQ ID NO: 99140 - DNA, 50 bp, homo sapien
ggaatgagggtgatataatcaaggayctcagaaagtttggcacagagctg

SEQ ID NO: 99141 - DNA, 50 bp, homo sapien
cttgagaatcattgactataaaataycagtaggtggcagtagaagattta

SEQ ID NO: 99142 - DNA, 50 bp, homo sapien
ctttggggctcatgaaactatccaamacatttttctcattaaaaattaag

SEQ ID NO: 99143 - DNA, 50 bp, homo sapien
ggtaacacctcctgcagttataatcratgctttggacactttcaaggaac

SEQ ID NO: 99144 - DNA, 50 bp, homo sapien
ttacaatctataaacctataaagcamtgaaagaaaaataaacttctttat

SEQ ID NO: 99145 - DNA, 50 bp, homo sapien
agaatagaacacagggatgtaccaaytcaagatctgaaaacttcaagaag

SEQ ID NO: 99146 - DNA, 50 bp, homo sapien
caaccaaagcaagtgggtagaaccayggggctttatgtccaaatgagcac

SEQ ID NO: 99147 - DNA, 50 bp, homo sapien
ttaataaaatgctcaaggatcccaartctgattaatcactaaaaaaagta

SEQ ID NO: 99148 - DNA, 50 bp, homo sapien
gtctatttggagacttgtcaaaggayagaccctaattataaaatggaaag

SEQ ID NO: 99149 - DNA, 50 bp, homo sapien
aatctagaaactactgaataaagcartctctaggaacaaaaaagccaaga

SEQ ID NO: 99150 - DNA, 50 bp, homo sapien
ataaagtcaggcaaggtgatatttarggtagcttactgatctaatattca

SEQ ID NO: 99151 - DNA, 50 bp, homo sapien
accctatcttccttgaaataaattaygtttgataatagaaatccatcttc

SEQ ID NO: 99152 - DNA, 50 bp, homo sapien
ttacaggccattgtgcccggcctgamatatcctcttcacggccagattca

SEQ ID NO: 99153 - DNA, 50 bp, homo sapien
tccacccttgaaaatataggaatgaygacctagaagcaccagagcaaatg

SEQ ID NO: 99154 - DNA, 50 bp, homo sapien
aattattcacaggcttattcttataracattacattcttatcaatagccc

SEQ ID NO: 99155 - DNA, 50 bp, homo sapien
accctattataatgccattatggtakgaaaatgattttagtgcaagttaa

SEQ ID NO: 99156 - DNA, 50 bp, homo sapien
acaacaaagcatcaacattactttarctgtctttgtaatgtgctgctatg

SEQ ID NO: 99157 - DNA, 50 bp, homo sapien
cacagcatactttataaaccaacaayaatcacttctcaaataactagatg

SEQ ID NO: 99158 - DNA, 50 bp, homo sapien
aatccagtgctaggaagtttatttaygttgtcccacagagatcattttct

SEQ ID NO: 99159 - DNA, 50 bp, homo sapien
tccaagccttgtgttgcataaccccsagaggaaaccctggaactgattta

SEQ ID NO: 99160 - DNA, 50 bp, homo sapien
tcacagagcacttccctacaaacaaytggcagaaagattagaaatcccca

SEQ ID NO: 99161 - DNA, 50 bp, homo sapien
aaactctgtcaaaaaaatttttttaratgagaatcacaacaggttcttga

SEQ ID NO: 99162 - DNA, 50 bp, homo sapien
gccttgtcatcactgctgatgatcaraattctctttgttggacttatgtg

SEQ ID NO: 99163 - DNA, 50 bp, homo sapien
atctggcagcaccaaaattctccagragattctgatccagcctgtctcct

SEQ ID NO: 99164 - DNA, 50 bp, homo sapien
cttctaattatttcccctcagattgsactttctctactctcctcttccca

SEQ ID NO: 99165 - DNA, 50 bp, homo sapien
ccaacatatttttggcagtaaaatamaacagatatggtctttttatttcc

SEQ ID NO: 99166 - DNA, 50 bp, homo sapien
cactttaaaaaagattttagatttarcattgcttttggaatcatttctgt

SEQ ID NO: 99167 - DNA, 50 bp, homo sapien
tggaaacccagcatgtctatttagayagaaactgtgacatacattacttg

SEQ ID NO: 99168 - DNA, 50 bp, homo sapien
ggaaaggtgatctttcctaaacacaytctaccatcttagatatctttaca

SEQ ID NO: 99169 - DNA, 50 bp, homo sapien
tgcttctgcttgccacatcctgaacyctggttagtccttggttaagaata

SEQ ID NO: 99170 - DNA, 50 bp, homo sapien
gataagggtatataaaaaagctctayggcagtaatttgctagatgagaac

SEQ ID NO: 99171 - DNA, 50 bp, homo sapien
gctgtttattatagaaaaactcttamacagtggagcaaaaaaacagtatc

SEQ ID NO: 99172 - DNA, 50 bp, homo sapien
gaagacaatttatttatctgttccartgatgggcatctaggttgtttcca

SEQ ID NO: 99173 - DNA, 50 bp, homo sapien
cctggggctctaggtcctttgtccaygtctcctattgaaacacctcaatt

SEQ ID NO: 99174 - DNA, 50 bp, homo sapien
cacattgacatgtagattggcaccascgcaaattcacagtgaccaacctc

SEQ ID NO: 99175 - DNA, 50 bp, homo sapien
ttttctgtaaaatgacactcagtagyatgatgatgatgttagctgttgtc

SEQ ID NO: 99176 - DNA, 50 bp, homo sapien
tcatcatatatcctggtactttacayagaggaaaaaataagaataattga

SEQ ID NO: 99177 - DNA, 50 bp, homo sapien
taaaaatagcaaagccacatccataygtatacgcttctaccaatatcctt

SEQ ID NO: 99178 - DNA, 50 bp, homo sapien
atgattttaaaaattgcacatgaaaycttttggtcatattgctggaaaag

SEQ ID NO: 99179 - DNA, 50 bp, homo sapien
atttagagttagaaaatgctacaccygatctatgttgcttcgatattgcc

SEQ ID NO: 99180 - DNA, 50 bp, homo sapien
taatttaccaaagaagatatgcaaaygaaaaataagcacatgaaaagata

SEQ ID NO: 99181 - DNA, 50 bp, homo sapien
taaaacaacactaaaataagcaaaaraagttcagtgggggaaaaagtcaa

SEQ ID NO: 99182 - DNA, 50 bp, homo sapien
tgatttataatctgcaaagaatgtayggtattgttattttatattaatca

SEQ ID NO: 99183 - DNA, 50 bp, homo sapien
tatgggactggatgtatgattatagyatcctcaagtataagaaagtaaag

SEQ ID NO: 99184 - DNA, 50 bp, homo sapien
caaggaaccccaaagattgcaaccaycagaacctaggaagaagcacagaa

SEQ ID NO: 99185 - DNA, 50 bp, homo sapien
agaattatgtccctagtgtctacgaygatttccaagctctatctgatgtc

SEQ ID NO: 99186 - DNA, 50 bp, homo sapien
cagcagtcagcagtaatgatcgggcragtctcattaacaatgcatttcag

SEQ ID NO: 99187 - DNA, 50 bp, homo sapien
atctaagtaagtcaatggaagaaacrgtaaagagaagaccttctttagga

SEQ ID NO: 99188 - DNA, 50 bp, homo sapien
ctgtttagtctatcagatgtgtaagsactagaatagagttaaatatgtaa

SEQ ID NO: 99189 - DNA, 50 bp, homo sapien
atggacaaatacaatggaaaggaacrgcaagaggtataaatgagccataa

SEQ ID NO: 99190 - DNA, 50 bp, homo sapien
agttttagcatatgggattcattgayggtgattccaggttaattcaaagg

SEQ ID NO: 99191 - DNA, 50 bp, homo sapien
gtgcttcccagatacttcatcatcartagaagagagaatgtgcatcccag

SEQ ID NO: 99192 - DNA, 50 bp, homo sapien
aacccaagaaatgtaatgcaaacaayttgggcctgtgtcacttagtcttc

SEQ ID NO: 99193 - DNA, 50 bp, homo sapien
catttcaccttcaaaattggaattaygtggaattgaaatatctgtgaaaa

SEQ ID NO: 99194 - DNA, 50 bp, homo sapien
ggtatgagttaagaagagttaaggakaaaagaaagacaaccttcaaatat

SEQ ID NO: 99195 - DNA, 50 bp, homo sapien
acgacggcaaatttttaagtatttcratatctcctcataaaaacagagta

SEQ ID NO: 99196 - DNA, 50 bp, homo sapien
tatatacaaagatctatgtctcccaygggttctaatttggttttgaggat

SEQ ID NO: 99197 - DNA, 50 bp, homo sapien
cactagcacagaggggctccttagargcttggcagtcaggagattgtcag

SEQ ID NO: 99198 - DNA, 50 bp, homo sapien
agcaactaactgtatgatgtgctaartgttgccagatgaaaagctaggga

SEQ ID NO: 99199 - DNA, 50 bp, homo sapien
ttaatacaaggacatgttttttagtsagggtgaatggagaagagagggta

SEQ ID NO: 99200 - DNA, 50 bp, homo sapien
atatgacagtgaggggaaaatagtcrctcctaaggattaatattctgaat

SEQ ID NO: 99201 - DNA, 50 bp, homo sapien
tgattataacaatgtggctggaatcraggttaatatacaaatgtaattgc

SEQ ID NO: 99202 - DNA, 50 bp, homo sapien
agtaaaagcaattatgcagcagttaygttagtcagtttgtgttattcaaa

SEQ ID NO: 99203 - DNA, 50 bp, homo sapien
cgtgtttttgtgtagacagcttttarattcaattggctaaatacctagca

SEQ ID NO: 99204 - DNA, 50 bp, homo sapien
ttttgtgtaaatgtagagtcagcctmgtatatgagcatcagatctagatt

SEQ ID NO: 99205 - DNA, 50 bp, homo sapien
gttctatttcctatttgattgttagratttatctgtaaaaggctcttgaa

SEQ ID NO: 99206 - DNA, 50 bp, homo sapien
ggataattaaacgtttaattattcaycacattttagagaacagtagccac

SEQ ID NO: 99207 - DNA, 50 bp, homo sapien
catggtcacttatctagctacctaayagttggccagatcgaagccaagcc

SEQ ID NO: 99208 - DNA, 50 bp, homo sapien
tgtaatcatttgtcccttatactccrataaaaatacagtggaagaagcac

SEQ ID NO: 99209 - DNA, 50 bp, homo sapien
ataatagctatcactttattttatamgcaaaaggaatgttgggatcaaaa

SEQ ID NO: 99210 - DNA, 50 bp, homo sapien
gtaattggaagcaagtttctcagtayatctacctttttaagtctcctttc

SEQ ID NO: 99211 - DNA, 50 bp, homo sapien
tggaatgaattttctatttgaagtawctgatgacatgacataaaattgac

SEQ ID NO: 99212 - DNA, 50 bp, homo sapien
gaaaagaggcttttccaatttattaygtatattttgtgtactagctgata

SEQ ID NO: 99213 - DNA, 50 bp, homo sapien
agcatacaggatgaagttgaattaartctctcaaaaccagcttgtttact

SEQ ID NO: 99214 - DNA, 50 bp, homo sapien
aaggaaaagatattaactacattatwagctgctcagaaatgaattagctt

SEQ ID NO: 99215 - DNA, 50 bp, homo sapien
agaaaaggaagtccacaaagtcaaakcgaaagccatctaaaaggcagtag

SEQ ID NO: 99216 - DNA, 50 bp, homo sapien
catgcacatagacaactggagcatayggtagaaaacattaagcctagtag

SEQ ID NO: 99217 - DNA, 50 bp, homo sapien
tagttatctcctctttacaaaaacaygcctggaggaaaagtacatccttg

SEQ ID NO: 99218 - DNA, 50 bp, homo sapien
agctctctcatcattacctgttaaarcattttatcatagtctgaatcctt

SEQ ID NO: 99219 - DNA, 50 bp, homo sapien
aagaactaatgaactaaaaactggaygaaaatactatccagaatgtggca

SEQ ID NO: 99220 - DNA, 50 bp, homo sapien
gattttggtggactagcaacacttcrataaatatgtgttatttagatata

SEQ ID NO: 99221 - DNA, 50 bp, homo sapien
cacattatacacctactatgtttgarggtctgaatcaaaaaggagtgtac

SEQ ID NO: 99222 - DNA, 50 bp, homo sapien
cgtttttaatagtaatgtttctctawccctgggcaagtaatatggaaaga

SEQ ID NO: 99223 - DNA, 50 bp, homo sapien
ttccagaatatactgtatttagcaaygaatccatgtattactattttttg

SEQ ID NO: 99224 - DNA, 50 bp, homo sapien
atgcagatatttacagtaatgcaaaygaaattataataacctattaggtt

SEQ ID NO: 99225 - DNA, 50 bp, homo sapien
cccatctcagagccaaggtactacarggtaaaatatgccttctcattcgt

SEQ ID NO: 99226 - DNA, 50 bp, homo sapien
gccaatcaaggcaaaatattgtaacrctgccaaacttcaagagctatttg

SEQ ID NO: 99227 - DNA, 50 bp, homo sapien
caaactcctatgacccatactccatraaacctaattcaaatcacaaaaca

SEQ ID NO: 99228 - DNA, 50 bp, homo sapien
tcttaaccaagcatactcaaaaccaratttgtacctatcaagcatgttta

SEQ ID NO: 99229 - DNA, 50 bp, homo sapien
gctcccaacagaccatctagctgaawgaatctgcatgagacagcccagga

SEQ ID NO: 99230 - DNA, 50 bp, homo sapien
tcaaaatcccagacttcattacttayaagcagaaaatagctttatccttt

SEQ ID NO: 99231 - DNA, 50 bp, homo sapien
taaatctagatgagctgagcactcaratgtttctaataacaacacttggc

SEQ ID NO: 99232 - DNA, 50 bp, homo sapien
agaattatatagcagaaagttatacygatcttttgataaaacaatgtaat

SEQ ID NO: 99233 - DNA, 50 bp, homo sapien
aaaatggaataaatgctgacaaaaakacaatttacaagatttgggcagga

SEQ ID NO: 99234 - DNA, 50 bp, homo sapien
gtctagacaaattttgcactcggacygcttcacaggtgtccacattttca

SEQ ID NO: 99235 - DNA, 50 bp, homo sapien
aacgaagagtgttgaattagggaagsctaaacataagtctagtgaaaact

SEQ ID NO: 99236 - DNA, 50 bp, homo sapien
tctgttttaatattgttccatttccyttctctttgccctgaaggcaggct

SEQ ID NO: 99237 - DNA, 50 bp, homo sapien
cattttagtaatccactcgagatgamagggactgaaaaccaaggttgctt

SEQ ID NO: 99238 - DNA, 50 bp, homo sapien
acagagttgctttgctctgaagatasagtgacctgtcttattagtcaata

SEQ ID NO: 99239 - DNA, 50 bp, homo sapien
ttccactatttaggacatgtgaatcmataagcaagatgaatcccagcact

SEQ ID NO: 99240 - DNA, 50 bp, homo sapien
atgctaccttataattattagttaaygtaagggataagtattgtaaaagt

SEQ ID NO: 99241 - DNA, 50 bp, homo sapien
atataaatgctatatgttgtttttamatttttgaatccatatatagacac

SEQ ID NO: 99242 - DNA, 50 bp, homo sapien
tctaccaaccacaaataacttaaagratctacagcaatgtctattcctct

SEQ ID NO: 99243 - DNA, 50 bp, homo sapien
actaaaattgtggcttgatgctaaaktgttttgtctcagaggtctttggg

SEQ ID NO: 99244 - DNA, 50 bp, homo sapien
acattattttttccataaaaactatmagaccatttcattcaatttaaaaa

SEQ ID NO: 99245 - DNA, 50 bp, homo sapien
tgcacattttattattatgtatcacyatgttgtgacaagtttagatattc

SEQ ID NO: 99246 - DNA, 50 bp, homo sapien
cctctctgttgcggactaccaaatgmaaagttgtaatgaatataccatct

SEQ ID NO: 99247 - DNA, 50 bp, homo sapien
attttgtgtttaccctatttattacragagtacactttaacaaactactg

SEQ ID NO: 99248 - DNA, 50 bp, homo sapien
attcaactttttgaaaacaaacgaartgaggcataggtttctcagtaaaa

SEQ ID NO: 99249 - DNA, 50 bp, homo sapien
taatttgtaaattttgacacattacytacattacttataaaatatttgtt

SEQ ID NO: 99250 - DNA, 50 bp, homo sapien
caatggggaacttcttcccaagtccraatcagtttcttaggtgtctaggg

SEQ ID NO: 99251 - DNA, 50 bp, homo sapien
aaactacggatttcactcatctttcmaattcctcagtatttgacagatag

SEQ ID NO: 99252 - DNA, 50 bp, homo sapien
gttttatgtcctaacatatattgtawcctaaagaacgttccatgtgcaat

SEQ ID NO: 99253 - DNA, 50 bp, homo sapien
agatccattctctacccaaatctacycatttctactctttttttctcaga

SEQ ID NO: 99254 - DNA, 50 bp, homo sapien
aaatagtacaggaatggagactgaasaaatactggccccaccctaggtta

SEQ ID NO: 99255 - DNA, 50 bp, homo sapien
ctgtaaacgccatcaatacagtcaayggaagaagaaaagtgtgccaagcc

SEQ ID NO: 99256 - DNA, 50 bp, homo sapien
tgaaagtagacagaaattgagtttayaagatcacagagaaaactgaaatg

SEQ ID NO: 99257 - DNA, 50 bp, homo sapien
gactggacccagaagacagataacaytggacacacttatagaaatgcaaa

SEQ ID NO: 99258 - DNA, 50 bp, homo sapien
tatcacaaacaaaataaattcaaaastgtgcaaaatctatgtcagattat

SEQ ID NO: 99259 - DNA, 50 bp, homo sapien
aatggacaatgctgttacctcagaaygcagtagagaacctgaataaattc

SEQ ID NO: 99260 - DNA, 50 bp, homo sapien
atttgaagaaggaattttttcagaakacaatatcaataattttctagaac

SEQ ID NO: 99261 - DNA, 50 bp, homo sapien
gataaattaaactccacaatctgaargtggtctatcttttaaaagtatta

SEQ ID NO: 99262 - DNA, 50 bp, homo sapien
caggcttttgaaatacatcatcagcraatcaatattctgtcagaaggaca

SEQ ID NO: 99263 - DNA, 50 bp, homo sapien
ttatgacgtcattataagaaagaccrtatgcaagctaaaactataagata

SEQ ID NO: 99264 - DNA, 50 bp, homo sapien
atatctctctctttactcacacttcygaaacaaaaagcaatgattcttct

SEQ ID NO: 99265 - DNA, 50 bp, homo sapien
atataaataatttattcctatggctycaaaggtcttaataatgaattcat

SEQ ID NO: 99266 - DNA, 50 bp, homo sapien
aactgttttatatttaccatgttcayatatgtagaaatgttgttaaagtc

SEQ ID NO: 99267 - DNA, 50 bp, homo sapien
cttgttttatctctcaaaatagagamtataactgggatattgtctgataa

SEQ ID NO: 99268 - DNA, 50 bp, homo sapien
ttctagagatgtcacataaaatacarggctcccagttacattcaaatttc

SEQ ID NO: 99269 - DNA, 50 bp, homo sapien
ggccctgttttgagcactaacatgaraagatgaaaagaaatccccagaaa

SEQ ID NO: 99270 - DNA, 50 bp, homo sapien
attaaaagacaataataacctaggaratggaagaatattatgcttttcta

SEQ ID NO: 99271 - DNA, 50 bp, homo sapien
tttagtgatttttacaatgcaagcasaggtagcactctataattgaacat

SEQ ID NO: 99272 - DNA, 50 bp, homo sapien
aagttagtttgtagcactgggagaartgttttttgtttgtttgtttgtct

SEQ ID NO: 99273 - DNA, 50 bp, homo sapien
agaaatctagaccaagaacctgtaaygttataactaaacacaccattcca

SEQ ID NO: 99274 - DNA, 50 bp, homo sapien
cctgatgctcacatataacataaacrgtcacaaacaataaatccatgaaa

SEQ ID NO: 99275 - DNA, 50 bp, homo sapien
tgctagaatattttgggacggatcaycaatgaagaaagagttactcagag

SEQ ID NO: 99276 - DNA, 50 bp, homo sapien
aagtatatgttgggaacaactgctayagttaaaaatgtccttacatataa

SEQ ID NO: 99277 - DNA, 50 bp, homo sapien
accccaaaggccttacataaagagarctgttaagactcatgagcactaat

SEQ ID NO: 99278 - DNA, 50 bp, homo sapien
cagaagatacatacagctaatgacartctaagggagaatttcaggaagga

SEQ ID NO: 99279 - DNA, 50 bp, homo sapien
atctcaggagataccagcaaaaaaayacagggaaaatattcaatatggtt

SEQ ID NO: 99280 - DNA, 50 bp, homo sapien
gaaatttgttgattagtgtaatgaayggatgtcagggaagaacttgttca

SEQ ID NO: 99281 - DNA, 50 bp, homo sapien
tagaatgcttgctgtaaaacctgccrgagaagaagatgaaatactgaagt

SEQ ID NO: 99282 - DNA, 50 bp, homo sapien
atctgctaggttgtggcttatttcaycactgtactgaatctcactacttt

SEQ ID NO: 99283 - DNA, 50 bp, homo sapien
tcttagggttctacatttcttcaaakatctcaaggtgatgccattactaa

SEQ ID NO: 99284 - DNA, 50 bp, homo sapien
agaaaataaacattgtttcagtaggwatataacaccagaggagggagagt

SEQ ID NO: 99285 - DNA, 50 bp, homo sapien
taaagccagaaaatagagataagacwgaggaaatataagaattatgtaac

SEQ ID NO: 99286 - DNA, 50 bp, homo sapien
acaactattcataaaaagcagaatayggtgatcctaaaacctcattcaag

SEQ ID NO: 99287 - DNA, 50 bp, homo sapien
aataaaaagtaattttggagttgcartaaatctaagaaatgcaaaagaaa

SEQ ID NO: 99288 - DNA, 50 bp, homo sapien
ccttttacaaatcatttccaggaaartccttagttctggcagagaccttt

SEQ ID NO: 99289 - DNA, 50 bp, homo sapien
ctgtgttcactcttttctaacactasgacttgactaatgtaacaaatctt

SEQ ID NO: 99290 - DNA, 50 bp, homo sapien
acaggctttctatcagttcctatatyactcatgatctttataccctctat

SEQ ID NO: 99291 - DNA, 50 bp, homo sapien
actgttttcttatccactgtccttayggtgttcttgattagtacctcata

SEQ ID NO: 99292 - DNA, 50 bp, homo sapien
tcttctgaatatagtagtatagcaartaaacactgtagattatcaaataa

SEQ ID NO: 99293 - DNA, 50 bp, homo sapien
aataaaaataaggtggaactgggaayctggatctacaacccaagacaagt

SEQ ID NO: 99294 - DNA, 50 bp, homo sapien
tctcagaaataaaagaaggcttgaartatctttcgtagatcaatgttggt

SEQ ID NO: 99295 - DNA, 50 bp, homo sapien
aagatgcatatattataaaccaaaayataaatgtgcatgcatgattgtat

SEQ ID NO: 99296 - DNA, 50 bp, homo sapien
caatcatcatgttctcagaaaaatgycatcatacaatttgggccagacac

SEQ ID NO: 99297 - DNA, 50 bp, homo sapien
ttttctgtctttcaatatccatgtcrattatttttcaaatttaaaaggaa

SEQ ID NO: 99298 - DNA, 50 bp, homo sapien
ctttctaagacctttccatttgtcawtagtcagctcatctgctgaacgct

SEQ ID NO: 99299 - DNA, 50 bp, homo sapien
gaaaaatcatctacaaatatggagargttgaaactcatgtgtataagttt

SEQ ID NO: 99300 - DNA, 50 bp, homo sapien
aatgacaaatggaaaggtcttagaargaatgagctgggcatgttacagaa

SEQ ID NO: 99301 - DNA, 50 bp, homo sapien
gttgtttttaatgttcagccaataamgaaccactggattcaatgagcttt

SEQ ID NO: 99302 - DNA, 50 bp, homo sapien
cactatggtgatagttgggtgaacaraaggaaccaagaagagaaaataag

SEQ ID NO: 99303 - DNA, 50 bp, homo sapien
aaaaaatcagatcgagttctgcccaytgaattaaaaagtcagatagggtc

SEQ ID NO: 99304 - DNA, 50 bp, homo sapien
ttgaaaaagaaaaaaaatgctgagartgtaaaatactgggaaaaaaactg

SEQ ID NO: 99305 - DNA, 50 bp, homo sapien
gatacttgttatgcatagatagtackcctggaaattaattgtaaaaaggt

SEQ ID NO: 99306 - DNA, 50 bp, homo sapien
ctacatgcttaccacactttatgaaytgagtaaaatgtttcagttatttg

SEQ ID NO: 99307 - DNA, 50 bp, homo sapien
tgaattccacatctgcatagctgaamagcattttataatatcagagtctc

SEQ ID NO: 99308 - DNA, 50 bp, homo sapien
taatgaaaagtaaaacaacattacartgagttaaaatgcacaatcttgtt

SEQ ID NO: 99309 - DNA, 50 bp, homo sapien
gattattaacctaatcatttaaaaakaacttttcactgcattaatcccat

SEQ ID NO: 99310 - DNA, 50 bp, homo sapien
cccatttaaatttaagatggaaacaytgaataaagatgaaactctattag

SEQ ID NO: 99311 - DNA, 50 bp, homo sapien
tgaaactctattagctgcacaatatraattaaatgggactacagataggc

SEQ ID NO: 99312 - DNA, 50 bp, homo sapien
ctacctgccttaaaacttgaacagastcactgatagagaaaatacttact

SEQ ID NO: 99313 - DNA, 50 bp, homo sapien
tagcaaactttgtgcttttggtacgyaatcagctcagaaagtgatgtctt

SEQ ID NO: 99314 - DNA, 50 bp, homo sapien
atagcccaggagaataaactcagaaragaatcaaagataatcttagaggg

SEQ ID NO: 99315 - DNA, 50 bp, homo sapien
ttccttgtctttctcatagtagcacrtgactttgaaaggacatttatttt

SEQ ID NO: 99316 - DNA, 50 bp, homo sapien
gacagtcttcaatgtcaccaattaaygcacaggcaggaaattgaggaaaa

SEQ ID NO: 99317 - DNA, 50 bp, homo sapien
ccaaattgagttatgacagcatatakattagttcatagaggggaaaagta

SEQ ID NO: 99318 - DNA, 50 bp, homo sapien
agtgtaggacttttctggaatcctcmaaacatgagagccagactttagga

SEQ ID NO: 99319 - DNA, 50 bp, homo sapien
aatgtggagtccgaacacaacagacragctaagggagaggttccatttgg

SEQ ID NO: 99320 - DNA, 50 bp, homo sapien
attttattgagtctgaatttttcackataaaatgaagatgtttcagtaat

SEQ ID NO: 99321 - DNA, 50 bp, homo sapien
acccagaatttttaatgtgtatgaaygaaacaaaggcaaatcttctttga

SEQ ID NO: 99322 - DNA, 50 bp, homo sapien
tcaaggcttcatatttctaagaattyaatgatgactacttgaagagagaa

SEQ ID NO: 99323 - DNA, 50 bp, homo sapien
tgccttacccaacccatcaacaaatsctatcaattttacctcctaattta

SEQ ID NO: 99324 - DNA, 50 bp, homo sapien
tctgggatataacatctgtggaatcygatataacatgtgttatatcccag

SEQ ID NO: 99325 - DNA, 50 bp, homo sapien
caaaatcttagagtggcctccatctygattgccatctcctgccttaccca

SEQ ID NO: 99326 - DNA, 50 bp, homo sapien
tattctcccaaatatttattaaacamccgaagctatctgatataagaaaa

SEQ ID NO: 99327 - DNA, 50 bp, homo sapien
tttttcttctactcaattcctttaakcctgcatggaaagtagctccacaa

SEQ ID NO: 99328 - DNA, 50 bp, homo sapien
aagattccaaaacagccaggtatcayagagtgcttaagttctaagtggag

SEQ ID NO: 99329 - DNA, 50 bp, homo sapien
tcagagtttaggagcaggagatataygatgtgctatttttagggtcatag

SEQ ID NO: 99330 - DNA, 50 bp, homo sapien
aatataggaaattgactaatagcacraacatcaaatcagagtctcaaatt

SEQ ID NO: 99331 - DNA, 50 bp, homo sapien
ttgaaaagaaaactatacatttagaraagagcaaaccgtagaggaaatta

SEQ ID NO: 99332 - DNA, 50 bp, homo sapien
tcttatgttttatcaatatcttgaarcttaattcaaaccaccctttataa

SEQ ID NO: 99333 - DNA, 50 bp, homo sapien
tttctgccctcgtgtctcactgtacrcacttaaaactagctaaaaagcag

SEQ ID NO: 99334 - DNA, 50 bp, homo sapien
ataaattatgaacagcaacaatttgmaaaatctgtaaaccatcacataat

SEQ ID NO: 99335 - DNA, 50 bp, homo sapien
gataaactggaaaacgagctctatarccaaattgacgttaacaaatttca

SEQ ID NO: 99336 - DNA, 50 bp, homo sapien
cccatatattttaaatcacctctgarttacttgtaatacctaatacaata

SEQ ID NO: 99337 - DNA, 50 bp, homo sapien
ttaagtatactttcatgtacgtaaarttattagtgttactttttctatga

SEQ ID NO: 99338 - DNA, 50 bp, homo sapien
gttgtaagtcagaaactagtttagaygaggcaaaattaggaaaaagctac

SEQ ID NO: 99339 - DNA, 50 bp, homo sapien
acagtgatggctttagggaaaaaagwacagcagtgcgacatcaatcacaa

SEQ ID NO: 99340 - DNA, 50 bp, homo sapien
agctaaaaatatttgctaatcagttsaaacaaaggtgtctgaattcagca

SEQ ID NO: 99341 - DNA, 50 bp, homo sapien
agacaaataatgggctaaattgccayagtgataagttatttgttgaataa

SEQ ID NO: 99342 - DNA, 50 bp, homo sapien
atatttaactcaaggaaaacaggtaygcttctgaccatttactctcatct

SEQ ID NO: 99343 - DNA, 50 bp, homo sapien
acaattttagttcattaattaggtaygagggacaacatatattcacacat

SEQ ID NO: 99344 - DNA, 50 bp, homo sapien
tgatccctatatttctgtggtatcartaatagtttcttccccattatctc

SEQ ID NO: 99345 - DNA, 50 bp, homo sapien
tgatgaagattgttatctattaatayaccagtcctaaaaaaacatgctcc

SEQ ID NO: 99346 - DNA, 50 bp, homo sapien
aacatcacaggtttagaagatgataragcacagactagagtccttctcca

SEQ ID NO: 99347 - DNA, 50 bp, homo sapien
catcttccattaagccaatcaagaakcaaattggaaagaaatttattatt

SEQ ID NO: 99348 - DNA, 50 bp, homo sapien
ctattgtagtttgagatttatgtaaygtgtaaattggaatagaggcagac

SEQ ID NO: 99349 - DNA, 50 bp, homo sapien
aaattgttctaaagaccttctggttwaaaagctattgtagtttgagattt

SEQ ID NO: 99350 - DNA, 50 bp, homo sapien
ccctagaagatagtttttgtgaccarcaattaatgcacaagataattgaa

SEQ ID NO: 99351 - DNA, 50 bp, homo sapien
gtatgtctcccagaacatttattaargacaaagaaggatacagtaacttt

SEQ ID NO: 99352 - DNA, 50 bp, homo sapien
aatagctacataatattctaacctakgagtctagtctaattcatttaagt

SEQ ID NO: 99353 - DNA, 50 bp, homo sapien
tcgtctaaactagtttctgacttacmacctaggttacttttatataaata

SEQ ID NO: 99354 - DNA, 50 bp, homo sapien
cactgtcaccaccaccattatgattrtgccaggttacaccagaagccagc

SEQ ID NO: 99355 - DNA, 50 bp, homo sapien
agatacaattgtatatggaatcccartaataaagcagatagaaagtgcag

SEQ ID NO: 99356 - DNA, 50 bp, homo sapien
ataatttgtacaagggagatactaawttaacttctaataatttggctggt

SEQ ID NO: 99357 - DNA, 50 bp, homo sapien
ccgatatggaatagtccaatttatcrcctcagaaatcttcttcttcgcca

SEQ ID NO: 99358 - DNA, 50 bp, homo sapien
atagatgccgtcgtcagagatggtaragggcgtttcgaaatactctgagg

SEQ ID NO: 99359 - DNA, 50 bp, homo sapien
attgtgtttttctttctcctgctacwtttcacttcttaattcaagttttt

SEQ ID NO: 99360 - DNA, 50 bp, homo sapien
ccatgagccctacaaacaaccaactwaccactaacagtcatatcatccct

SEQ ID NO: 99361 - DNA, 50 bp, homo sapien
ttggagttttaatagttctacacatwagtatcctaaaatacttaatctta

SEQ ID NO: 99362 - DNA, 50 bp, homo sapien
gaaagaagagaattgcaacaaattayggtctctgaaacaaattataacta

SEQ ID NO: 99363 - DNA, 50 bp, homo sapien
ttgcagagctcgagaaaagatggcaraattatatgtcttttcctttttct

SEQ ID NO: 99364 - DNA, 50 bp, homo sapien
gagtgtgctttggagagtaacaaatkatactttaacagcaacataccttg

SEQ ID NO: 99365 - DNA, 50 bp, homo sapien
taaaattctcttcttcatgtaatccrgaagttagagaaagagatcagata

SEQ ID NO: 99366 - DNA, 50 bp, homo sapien
gccataaaatgagagagtgagaaaayaatatttgttacatttgatattgc

SEQ ID NO: 99367 - DNA, 50 bp, homo sapien
cctcttgagctcttattatatttccwctgtatatctgagtgctccagtgt

SEQ ID NO: 99368 - DNA, 50 bp, homo sapien
ttttgaagaaaataaaatagaacgaygtaaaagagtccagagttggaggt

SEQ ID NO: 99369 - DNA, 50 bp, homo sapien
tatctcagaaggaaatcacacattaraagaaataaattgcaacattgtgc

SEQ ID NO: 99370 - DNA, 50 bp, homo sapien
tcataaagaaaatcaactcaagagasatcaaagactacctatcaggccta

SEQ ID NO: 99371 - DNA, 50 bp, homo sapien
tagtcattgagaagctaagcaggaayaaatgatcccctagaattctcttg

SEQ ID NO: 99372 - DNA, 50 bp, homo sapien
cgtagaacattatgaataatatcgcyggctgtttacatacatggggtaca

SEQ ID NO: 99373 - DNA, 50 bp, homo sapien
tttgttatttggaaaactagaagcakaaaatattcacatacatttttcat

SEQ ID NO: 99374 - DNA, 50 bp, homo sapien
aagaatatcagaagctgaagcacacraatagtggagtcaggaaaaaccat

SEQ ID NO: 99375 - DNA, 50 bp, homo sapien
gttttcctatttataataaatatacmaaaacttctcagaaaaggtctatt

SEQ ID NO: 99376 - DNA, 50 bp, homo sapien
aaaggtctttcctcctctaaccagasaaataaatcttaaaatatgaagat

SEQ ID NO: 99377 - DNA, 50 bp, homo sapien
ctctagagttttatggagaaaaatgraaagagcctttggagagtacaact

SEQ ID NO: 99378 - DNA, 50 bp, homo sapien
agttctgttgagacagatgaaattaygtcccttaagcttaattactttca

SEQ ID NO: 99379 - DNA, 50 bp, homo sapien
atcttagtaataatactgagaaatayggttaagtatcagttgctctctag

SEQ ID NO: 99380 - DNA, 50 bp, homo sapien
ctttctcagaattctatgccattcaytctctttccatgctgattcttccc

SEQ ID NO: 99381 - DNA, 50 bp, homo sapien
ttttttttttttttttggtgctaaasccattctaagaccactggtaccaa

SEQ ID NO: 99382 - DNA, 50 bp, homo sapien
aaaatccataaactgtcttctcctasaaagtataaaggcatggcaaatag

SEQ ID NO: 99383 - DNA, 50 bp, homo sapien
aaaggaaagcccttttaccactgcgrcatttcagttgttttggtttcaaa

SEQ ID NO: 99384 - DNA, 50 bp, homo sapien
ataacttattggcaggcacttagaasaaaatactataaaacaccttgtac

SEQ ID NO: 99385 - DNA, 50 bp, homo sapien
ccttaaattttagggagcatttatcmgaatcaactcttgtatcgtacaag

SEQ ID NO: 99386 - DNA, 50 bp, homo sapien
caagaaaataaatctaacccagatarataatgcttttaactatatctgat

SEQ ID NO: 99387 - DNA, 50 bp, homo sapien
aaataggataggacaacattttaacygaaatgacatatgacaactcaaaa

SEQ ID NO: 99388 - DNA, 50 bp, homo sapien
ctaacgggtaggagaggacaatttayggaacaactttataaatatgttac

SEQ ID NO: 99389 - DNA, 50 bp, homo sapien
cttcttctattatttgtatctgttayctcctggtctttcacttccaactc

SEQ ID NO: 99390 - DNA, 50 bp, homo sapien
tttagagtgagtaaatgcttttaagraaaaatatatcatatgcacacaca

SEQ ID NO: 99391 - DNA, 50 bp, homo sapien
tttattgatagtaatcagccaattarcattttcattgagtattctcatag

SEQ ID NO: 99392 - DNA, 50 bp, homo sapien
gagagagaggagtggaagcctataarttaaaagagacttaagaagcacat

SEQ ID NO: 99393 - DNA, 50 bp, homo sapien
cacttagctcccagtacctagttggyaggccactgaatagaaaggttcca

SEQ ID NO: 99394 - DNA, 50 bp, homo sapien
actatttttgcaatttactctcctckattgttatttaggcttacagaatg

SEQ ID NO: 99395 - DNA, 50 bp, homo sapien
atttcctgctgtcagtcaattccaastcttaatcttctgtggataagtag

SEQ ID NO: 99396 - DNA, 50 bp, homo sapien
cagcaaaaggttgcatctttccttascagttctttgatatattgggaact

SEQ ID NO: 99397 - DNA, 50 bp, homo sapien
ataataagttatactagatgtgaagragaaagaaccacttaatttttaaa

SEQ ID NO: 99398 - DNA, 50 bp, homo sapien
ttcagattctgggagcagtttactaygcccttattctcagtcactactgt

SEQ ID NO: 99399 - DNA, 50 bp, homo sapien
atggctgggctagcctgagtatgaawtaggttggaattaaaacacagatt

SEQ ID NO: 99400 - DNA, 50 bp, homo sapien
tctataagcaagtgattttaatttargcctacatataacaaaggtttcca

SEQ ID NO: 99401 - DNA, 50 bp, homo sapien
gatattctatagcctatgagcattawaaaatgataaattggtcaggggtt

SEQ ID NO: 99402 - DNA, 50 bp, homo sapien
gtgttagtgatttagaaagtgatgawctgacataatgttacaaagcaatg

SEQ ID NO: 99403 - DNA, 50 bp, homo sapien
attatgcaattacaatgtgatgtcayaatatttcatgattctctgaagac

SEQ ID NO: 99404 - DNA, 50 bp, homo sapien
aaattctcttttgctattgttgttaygcttattaatggaagtctgcacag

SEQ ID NO: 99405 - DNA, 50 bp, homo sapien
ttgatctcctacaattgcctggtaawgttagattttgaaacacagcatgg

SEQ ID NO: 99406 - DNA, 50 bp, homo sapien
agaagagagggtcatccatgaagtayaaatcaaaggagagaatttgtaaa

SEQ ID NO: 99407 - DNA, 50 bp, homo sapien
gttgctttcactttaagctggcagaygctgttaaaatctctaaacattga

SEQ ID NO: 99408 - DNA, 50 bp, homo sapien
ttatagaattaaaatgtttatcatamaatacatacaaaataaggaaagaa

SEQ ID NO: 99409 - DNA, 50 bp, homo sapien
caggcatacaacatctatagccttaytaaagcaaatgaaaatatattatt

SEQ ID NO: 99410 - DNA, 50 bp, homo sapien
tttttctgcctactgagataatcatmatcgcatggtttttgttctttttt

SEQ ID NO: 99411 - DNA, 50 bp, homo sapien
atctggtcctgggcatttcactgtcrgaaggctttttattactgattcaa

SEQ ID NO: 99412 - DNA, 50 bp, homo sapien
aactttaaaactcgtcaatcagttaycgaagtatacccatagaaattgta

SEQ ID NO: 99413 - DNA, 50 bp, homo sapien
actatttcaatcaatcaaaaagacartatatgcaaaattcaatcttattt

SEQ ID NO: 99414 - DNA, 50 bp, homo sapien
cactatatttgaatcaattccctaamagtggctaatgaaaagtgaaagag

SEQ ID NO: 99415 - DNA, 50 bp, homo sapien
ccataggatactggaagatatataakgaggttaatgcctctttctatgag

SEQ ID NO: 99416 - DNA, 50 bp, homo sapien
tttaaaaatgatcaaatacctctcaraactttccagaatataaattccca

SEQ ID NO: 99417 - DNA, 50 bp, homo sapien
atcatctgtgacatttttaaaaccastagtgactcgattgcacccactga

SEQ ID NO: 99418 - DNA, 50 bp, homo sapien
agccagcgtatatttcaaatattgamtaacacatgacaactgatatgcaa

SEQ ID NO: 99419 - DNA, 50 bp, homo sapien
gtggatgggacatgtaatttgtcacygattagagattcacagaagagatt

SEQ ID NO: 99420 - DNA, 50 bp, homo sapien
aactgtaactttagcaggctttgacrgtagactattgtgtttttaactgg

SEQ ID NO: 99421 - DNA, 50 bp, homo sapien
cctcattgtagtctttgtgccctcayataatcaatctttctactcaaagg

SEQ ID NO: 99422 - DNA, 50 bp, homo sapien
gagtagtttttcacagcatagacacrattgcagtgttgggtgcagtaggg

SEQ ID NO: 99423 - DNA, 50 bp, homo sapien
catttttattaggtatttctcgagcmagtcttaaaattaggcttatatca

SEQ ID NO: 99424 - DNA, 50 bp, homo sapien
cagcctaaatcagtgaacttatctcrgacaacagaaaaagataataaaac

SEQ ID NO: 99425 - DNA, 50 bp, homo sapien
catttattcttattgacctcatctcyagcttgtggatgatcaatgtggac

SEQ ID NO: 99426 - DNA, 50 bp, homo sapien
atgatcttggattatgttcccttgargtaaatcccactacaaagctgaat

SEQ ID NO: 99427 - DNA, 50 bp, homo sapien
aatcgatagcatagtgagaagaggtyaccacaatctggtccctgcctagc

SEQ ID NO: 99428 - DNA, 50 bp, homo sapien
ttgtaatgacttactctcattttaawcacaatttgaggtgctttgttaaa

SEQ ID NO: 99429 - DNA, 50 bp, homo sapien
atacatccttcatttcctgctgtatraaaaataagggttctttaaatatt

SEQ ID NO: 99430 - DNA, 50 bp, homo sapien
atttcatacattttgaagctaaaaartataatgtcttggtaatttcccat

SEQ ID NO: 99431 - DNA, 50 bp, homo sapien
ttttaaaatatctctcctttgaaaamaatttaatgctaacacaactagaa

SEQ ID NO: 99432 - DNA, 50 bp, homo sapien
gtaaagtgtcatttcatatgttcagkatatttgctatgtacagcattacc

SEQ ID NO: 99433 - DNA, 50 bp, homo sapien
aagatcaggaattggcttggaaagcragagcgtagtgaatagtcgcttat

SEQ ID NO: 99434 - DNA, 50 bp, homo sapien
ttatcttggttctttataatccttakgctgatggagaattgttaaaaatg

SEQ ID NO: 99435 - DNA, 50 bp, homo sapien
gagctgcaagttacaaacgactttakattgtacaaagaaaaatcggggag

SEQ ID NO: 99436 - DNA, 50 bp, homo sapien
tggatctgtatctgtcatttatcaamaagtttaagaaacagggaaagatt

SEQ ID NO: 99437 - DNA, 50 bp, homo sapien
gagaaaaaaagggctaaaagggagtraatacatagattagagggagcttg

SEQ ID NO: 99438 - DNA, 50 bp, homo sapien
tgaagaaaataaaacatacagttcaygtcctacaaataaagtttacatat

SEQ ID NO: 99439 - DNA, 50 bp, homo sapien
tgggtttctattggaccccaggtacraagagttaatcatattcaattcaa

SEQ ID NO: 99440 - DNA, 50 bp, homo sapien
tgatcaaatatcctataatgttagaygaagatgaaagattttattttact

SEQ ID NO: 99441 - DNA, 50 bp, homo sapien
tcaatattctaaatagataaaaggayagtaaattgcatttaaattttggc

SEQ ID NO: 99442 - DNA, 50 bp, homo sapien
cctattctaacatgtttaatacatayctttccttacaccaaaggaaaaga

SEQ ID NO: 99443 - DNA, 50 bp, homo sapien
agcaggcagttatgtgttttcaagamagtaatttaccaagttgaaattcc

SEQ ID NO: 99444 - DNA, 50 bp, homo sapien
catagcatgaataatatttctcttgracaacatccatatagaatgctatg

SEQ ID NO: 99445 - DNA, 50 bp, homo sapien
ctcaatagaaagagaaacattatcargaacacatccatttaaacagactc

SEQ ID NO: 99446 - DNA, 50 bp, homo sapien
tataggaagtaccagtgtgagtttaygaggtattttatctttaatatgaa

SEQ ID NO: 99447 - DNA, 50 bp, homo sapien
ctgtagtgtgggtagttcaaattgamataagtgccagctacataccagat

SEQ ID NO: 99448 - DNA, 50 bp, homo sapien
tgatagaggaagcatagcttgcctayagtttatgtgttgttcggaagcga

SEQ ID NO: 99449 - DNA, 50 bp, homo sapien
tttaactaggatagaagtggatgctyacctagatattgaaggagagtcct

SEQ ID NO: 99450 - DNA, 50 bp, homo sapien
ttgatgactatgagagtgaattctgmagaaaagaatccagtcattgaaga

SEQ ID NO: 99451 - DNA, 50 bp, homo sapien
cctaaaactctataccaaactatcaytcagtattaagagagaaatgaata

SEQ ID NO: 99452 - DNA, 50 bp, homo sapien
gcaggattaaaaacaatgactcatayagtgagaaagtgattgctattccg

SEQ ID NO: 99453 - DNA, 50 bp, homo sapien
aaaggcactaagaagaaaggacggartatattacacctctgtcagacttg

SEQ ID NO: 99454 - DNA, 50 bp, homo sapien
cctgagaagcatttccttgttaactyacatatacccaaatccctgcctca

SEQ ID NO: 99455 - DNA, 50 bp, homo sapien
gggagaggccaataaatactgaacamacactcagagaccaaaccagtcca

SEQ ID NO: 99456 - DNA, 50 bp, homo sapien
gtagaaaatagaggatactgatacayttttttgcagatgtaagtgtggtg

SEQ ID NO: 99457 - DNA, 50 bp, homo sapien
tagttatatctaaaagaacacattaratggatgtttttccccgacacaac

SEQ ID NO: 99458 - DNA, 50 bp, homo sapien
tccttcacagcactttgtacaactaygatcaccaaattaattcttgaaaa

SEQ ID NO: 99459 - DNA, 50 bp, homo sapien
agcaagaaaatgattatcattaaaakgagtgtagctgtttccttcggaag

SEQ ID NO: 99460 - DNA, 50 bp, homo sapien
cttaagaaattatttaaatccagagraaacaagtcatgaaaaaaaaaaac

SEQ ID NO: 99461 - DNA, 50 bp, homo sapien
gtttaagtacactttgcaacatttgracaatgatgaagtcacctaccaca

SEQ ID NO: 99462 - DNA, 50 bp, homo sapien
acttctagaatgtagaaagatgaagrttcaggcattacctgcttcccagc

SEQ ID NO: 99463 - DNA, 50 bp, homo sapien
agtaggaactagggttcctaaatgasgtaatgatgtagagcttcctacat

SEQ ID NO: 99464 - DNA, 50 bp, homo sapien
tcaaattgtatggcaccacaatgtayataattcaactgatgaaacaactg

SEQ ID NO: 99465 - DNA, 50 bp, homo sapien
tataagaatacaaatatccatatagkaacatttccataaactatttataa

SEQ ID NO: 99466 - DNA, 50 bp, homo sapien
attgaatgtagacaatagagtttccrgctttattggctttttttatttta

SEQ ID NO: 99467 - DNA, 50 bp, homo sapien
ttaatactcctctgctaattcttaawcatccttcagtttccaagttagag

SEQ ID NO: 99468 - DNA, 50 bp, homo sapien
gcttgtcagcaaatgtttaactacartgaaattcatgcctacctctagta

SEQ ID NO: 99469 - DNA, 50 bp, homo sapien
gcaatattatgctactgagattcaaytaaatattactacaatacaaagct

SEQ ID NO: 99470 - DNA, 50 bp, homo sapien
tggttctttcagatgaaaagaacaartagtcatcttaaagagtctgtaaa

SEQ ID NO: 99471 - DNA, 50 bp, homo sapien
ttcttctaaaacacagcaccagtacmgaactgtttcttcaagtttaggac

SEQ ID NO: 99472 - DNA, 50 bp, homo sapien
atactgttgtaaagctctgacactayataaaatgtggtatagtattgctt

SEQ ID NO: 99473 - DNA, 50 bp, homo sapien
ccctcaccaagactctagtaaaaccrgcattgtatcagctctggtcaggg

SEQ ID NO: 99474 - DNA, 50 bp, homo sapien
ctggtttcaatcatatctcgagcacygtgatgataataacacatgcctca

SEQ ID NO: 99475 - DNA, 50 bp, homo sapien
agcacaaaaagttcaatttctcttaraagtcatacttgtgagcagtattt

SEQ ID NO: 99476 - DNA, 50 bp, homo sapien
agaagataatatggctttgttcacastattacataaagaagattaaagac

SEQ ID NO: 99477 - DNA, 50 bp, homo sapien
tgatgatttcactcttctaaccctgyaaaggacttgcgcatactatccca

SEQ ID NO: 99478 - DNA, 50 bp, homo sapien
ctaaatttccactacatgttttatastaattccaccctgaatttgcacat

SEQ ID NO: 99479 - DNA, 50 bp, homo sapien
aaagaggcacacctgctggtaaatasagattaaagggtgttgcttttcct

SEQ ID NO: 99480 - DNA, 50 bp, homo sapien
tgtgtctaggtagtattaacaaacamacgccatataacaagagttaacat

SEQ ID NO: 99481 - DNA, 50 bp, homo sapien
aatgaatgacacccttgtataatctmtccataagtgtgtgtgacatgtga

SEQ ID NO: 99482 - DNA, 50 bp, homo sapien
gtttcagtagccagtgagaggtaaarttggtaggagaatcagtatgaggg

SEQ ID NO: 99483 - DNA, 50 bp, homo sapien
acagcagttaactgcactttttcagyatcttgttcaaacttgcccacaga

SEQ ID NO: 99484 - DNA, 50 bp, homo sapien
gccataaatccttctctacctctaaygatcagaacctactgatgtttacc

SEQ ID NO: 99485 - DNA, 50 bp, homo sapien
taaagtactgtcagcatttccattcrccctatgatgctatgttagataaa

SEQ ID NO: 99486 - DNA, 50 bp, homo sapien
ttatacgagagaagccaataagggamaaagagaacagcaagcagagaaaa

SEQ ID NO: 99487 - DNA, 50 bp, homo sapien
caccttaacctccaagtacaataacrcctgtgctgactctgggaaagctg

SEQ ID NO: 99488 - DNA, 50 bp, homo sapien
atgaataggagacttagcaccttaamctccaagtacaataacacctgtgc

SEQ ID NO: 99489 - DNA, 50 bp, homo sapien
ccattgcttttggaataaaacccaasttcttttgaatatctggaaagcct

SEQ ID NO: 99490 - DNA, 50 bp, homo sapien
gtaaccctaatgatagaaatgtaaasatgcttaaatcttataaattttaa

SEQ ID NO: 99491 - DNA, 50 bp, homo sapien
gtgctaagtctcctattcatcacggyatctttcattgcagtcttaattta

SEQ ID NO: 99492 - DNA, 50 bp, homo sapien
gtcttgttttgttctaaaagatttgyaataggtctaagttcatctaaagt

SEQ ID NO: 99493 - DNA, 50 bp, homo sapien
tataaatctagacattgtccttacasatttcacagatacgaacacgaaat

SEQ ID NO: 99494 - DNA, 50 bp, homo sapien
cacatgtattagaatacaataagaarcacattgcaaaattcctgcctcta

SEQ ID NO: 99495 - DNA, 50 bp, homo sapien
ctaaatctaggtattataggcatccragatgtacctaagtagaaggtcac

SEQ ID NO: 99496 - DNA, 50 bp, homo sapien
atataaaatttaactataacacttayggattacttggataattttttaca

SEQ ID NO: 99497 - DNA, 50 bp, homo sapien
gaccacatgcatgactttaagcaaaraagtggctaaagctctgtgtctaa

SEQ ID NO: 99498 - DNA, 50 bp, homo sapien
tcatcccttcctctctgccttttctwgtctaaagacaggcccctttacaa

SEQ ID NO: 99499 - DNA, 50 bp, homo sapien
ttgcttctagtttttgctactaaaarttaataataggaattcccacttga

SEQ ID NO: 99500 - DNA, 50 bp, homo sapien
ggaactctggtcaagtttcaaactgkattcaaatgttattaccataaatg

SEQ ID NO: 99501 - DNA, 50 bp, homo sapien
agctgtgtttatcttggcttaataaygtcttgttttgttctaaaagattt

SEQ ID NO: 99502 - DNA, 50 bp, homo sapien
ccttaatcttagcctgtaccttttamatcaaaactcagggaaggctgggc

SEQ ID NO: 99503 - DNA, 50 bp, homo sapien
tgctttccctttctttctaacagaaycctgattttgtgtttagatagtgg

SEQ ID NO: 99504 - DNA, 50 bp, homo sapien
aattgtttctccttttaggaaaacasagagcaagatgtttttccctctgt

SEQ ID NO: 99505 - DNA, 50 bp, homo sapien
tctctgcctgtcctctttgtctgcaytgatttcttgggtctcagtgacaa

SEQ ID NO: 99506 - DNA, 50 bp, homo sapien
tttggaatatggaattcagttattcmcaagcattttcatcaaatcattaa

SEQ ID NO: 99507 - DNA, 50 bp, homo sapien
cctccactggactgagaactccataragacaaagaatccccagatactac

SEQ ID NO: 99508 - DNA, 50 bp, homo sapien
aattaatgagttcaagaaaaaataayagtcccaggcaaatcatcaattat

SEQ ID NO: 99509 - DNA, 50 bp, homo sapien
aaattgagttatttattaatcattcraaagcgtttactgaatgcatagtt

SEQ ID NO: 99510 - DNA, 50 bp, homo sapien
catagattgccacgatgtaagcacarcattttctattttaatattttaac

SEQ ID NO: 99511 - DNA, 50 bp, homo sapien
gagaagaaaaatgagtatgaagtcartaggtgagaaagaaggctgcagca

SEQ ID NO: 99512 - DNA, 50 bp, homo sapien
tgggatttctggccatttttagtgawaaccaccgaaatacatgagcaggg

SEQ ID NO: 99513 - DNA, 50 bp, homo sapien
aaaccgataagaatattttaactgcragatcagaagaaagaatttcatct

SEQ ID NO: 99514 - DNA, 50 bp, homo sapien
cacattttcttcttggttcaaatacmatgtttcataatgtttgacttttt

SEQ ID NO: 99515 - DNA, 50 bp, homo sapien
gtcctgccaaaagtcacaagttgaarttgaataaccactgtaatagtatt

SEQ ID NO: 99516 - DNA, 50 bp, homo sapien
ggctaaagaagtagtgatgtacctarctgtaataatacactagggagaag

SEQ ID NO: 99517 - DNA, 50 bp, homo sapien
ttgtagtggctaaaaatattgaggartacctgtataaactgatatggagt

SEQ ID NO: 99518 - DNA, 50 bp, homo sapien
caatgtatagacagagggtctccaayaggatgggcttaacttacaatttt

SEQ ID NO: 99519 - DNA, 50 bp, homo sapien
attttgatcttttcctgaactatacrtggtaggatactctctctgatgct

SEQ ID NO: 99520 - DNA, 50 bp, homo sapien
agctactgggatgtgcagaactttayaatgtattgaaatccttggaagag

SEQ ID NO: 99521 - DNA, 50 bp, homo sapien
cttatggtgaatgagatcatgtctargttgaatcttaaatttgagctgga

SEQ ID NO: 99522 - DNA, 50 bp, homo sapien
aactgaggcagaagaaaattacatcrgatggaaacttggatctagacaga

SEQ ID NO: 99523 - DNA, 50 bp, homo sapien
gttaaccttcttctcaaataatgtamgagatgtcagaattatctgtaacg

SEQ ID NO: 99524 - DNA, 50 bp, homo sapien
ggtaaggaatacattgaaatgcttayagaagtctcaacaagtctctatca

SEQ ID NO: 99525 - DNA, 50 bp, homo sapien
tcttctgtcatgcagctgacaatccwagtgggagtgacagtgaagaacca

SEQ ID NO: 99526 - DNA, 50 bp, homo sapien
atgaactttgttaaacataaggttasatttgcaaatattctagctcagag

SEQ ID NO: 99527 - DNA, 50 bp, homo sapien
ttatacgtacaggcacttacactctytcacatattcacacgtgtgcacat

SEQ ID NO: 99528 - DNA, 50 bp, homo sapien
cattatacattttctagctataaacygaacatgttatattgacatttaat

SEQ ID NO: 99529 - DNA, 50 bp, homo sapien
tattgggatctatacagtgtctacayatttgatgataatgcctttttctc

SEQ ID NO: 99530 - DNA, 50 bp, homo sapien
tttttgaatggaatggaatatccacrggtaatagagcagtagcaatgtaa

SEQ ID NO: 99531 - DNA, 50 bp, homo sapien
ccaatttcacaatctttggctcctasaagttgtcccttggttcactgatg

SEQ ID NO: 99532 - DNA, 50 bp, homo sapien
aaaatatattttctatatttcttctraaagtttcaaagttagttttttca

SEQ ID NO: 99533 - DNA, 50 bp, homo sapien
tattaagtctgttttacatgtctcarataataccatatactgttagggtc

SEQ ID NO: 99534 - DNA, 50 bp, homo sapien
agcctgtaaccttttataagaaatakaggctcctttccaaatttatagat

SEQ ID NO: 99535 - DNA, 50 bp, homo sapien
aataattgtcatcaggaaatgtacaygtgtaggtaactggcaggggttag

SEQ ID NO: 99536 - DNA, 50 bp, homo sapien
ttataactgcagtttattgtctcacsacttccaaaaaggctttagcactc

SEQ ID NO: 99537 - DNA, 50 bp, homo sapien
ccagtatattcaaagaaattggaccyaatggtatcaacaagtggtacact

SEQ ID NO: 99538 - DNA, 50 bp, homo sapien
tagctgtctcatcaaaactggatatkctttctacattgtatcagggatcc

SEQ ID NO: 99539 - DNA, 50 bp, homo sapien
gcagttctctattactagaagctacytttttcctaggagctacaagcgtt

SEQ ID NO: 99540 - DNA, 50 bp, homo sapien
ctgtttacgtagtttatatggctgaycattgtatttttaagaggattcat

SEQ ID NO: 99541 - DNA, 50 bp, homo sapien
ggtgcctgtctcccagtgttcccaayagtagcaaagcaaattgctagagt

SEQ ID NO: 99542 - DNA, 50 bp, homo sapien
gtaccccacagtccaaggtgatacawagcacatagttaaagctcagggaa

SEQ ID NO: 99543 - DNA, 50 bp, homo sapien
aatttgtgaacaaagaatattagcayacaatgtgatatgtgagtacacaa

SEQ ID NO: 99544 - DNA, 50 bp, homo sapien
agcgaggagcttcttggatttagtasaggtctttcagatttttctttagg

SEQ ID NO: 99545 - DNA, 50 bp, homo sapien
caataaatatgatatgatcaacgtakagtagaaaatagtgtggtttagag

SEQ ID NO: 99546 - DNA, 50 bp, homo sapien
tcttagagttgttttaaggagcaaaygaattaacatatgtgaagtgaaca

SEQ ID NO: 99547 - DNA, 50 bp, homo sapien
gtgatgtttgcttttaacgtaccacmagaaatctccctgtgtttggtgtt

SEQ ID NO: 99548 - DNA, 50 bp, homo sapien
ttctttacatctctgaagaatcaacygttaagcaggaatgaacaccaaac

SEQ ID NO: 99549 - DNA, 50 bp, homo sapien
tgagagaaaagatctgtgacccaatragcaagaaatcacagatggtatcc

SEQ ID NO: 99550 - DNA, 50 bp, homo sapien
tgactaaaaaggggcttgtgtttctyacataacaggagtctggaagcagg

SEQ ID NO: 99551 - DNA, 50 bp, homo sapien
aagcaggccatccagtgcagttccayggtgctaagaggggcctaatctcc

SEQ ID NO: 99552 - DNA, 50 bp, homo sapien
ttcccaactactcttcacaggcaccraagattctaaatcaagccaatctc

SEQ ID NO: 99553 - DNA, 50 bp, homo sapien
cgaaagaaccaaatcacaacaaaaartctccaatcttggccgggcatggt

SEQ ID NO: 99554 - DNA, 50 bp, homo sapien
aaaaaagacaagatgatcagggtagscccataatttattgtccaaactaa

SEQ ID NO: 99555 - DNA, 50 bp, homo sapien
ggttagaaatccctccaacaacttcscattgcactgtcaataaaatccaa

SEQ ID NO: 99556 - DNA, 50 bp, homo sapien
tccataatgcttttaataaactacaytgtagatcattagtctgtgggaga

SEQ ID NO: 99557 - DNA, 50 bp, homo sapien
aaaattttgtttagaaaagcatcatragcaatcagttaacagaagccata

SEQ ID NO: 99558 - DNA, 50 bp, homo sapien
tatttcaagttatatttacatattcyaggaacaaaaataaatatacctga

SEQ ID NO: 99559 - DNA, 50 bp, homo sapien
gctaactggagaaacttattaagaaygccaggagcagttgagattaatgg

SEQ ID NO: 99560 - DNA, 50 bp, homo sapien
ttagcacatccttaggatcataaaarctctttctgcctttgtgatttata

SEQ ID NO: 99561 - DNA, 50 bp, homo sapien
tgatataattaatcttcaggaaccamattacattcattctgatccatcac

SEQ ID NO: 99562 - DNA, 50 bp, homo sapien
gtacacagacatggtggagcagtcaraatacatacatttaagttctccct

SEQ ID NO: 99563 - DNA, 50 bp, homo sapien
ggtctctgtcaaagactgctaactgrtttgaacatgaagttgtggtaaac

SEQ ID NO: 99564 - DNA, 50 bp, homo sapien
tggttctaacaagcatcatctctaarcaaacaaatgcagacagagggatt

SEQ ID NO: 99565 - DNA, 50 bp, homo sapien
ataccacccttaaaataaagattgaygaattctatgtccaaattcttaag

SEQ ID NO: 99566 - DNA, 50 bp, homo sapien
atgttgcctaaggatacaatgtaaayagtagaaacaggatttaaaaccag

SEQ ID NO: 99567 - DNA, 50 bp, homo sapien
taaattagttattggtatctacgcakgaaattctatagcacaactacttt

SEQ ID NO: 99568 - DNA, 50 bp, homo sapien
aaacagtagaaacaggatttaaaacyagatgtcactgaccctaaactttc

SEQ ID NO: 99569 - DNA, 50 bp, homo sapien
taccagactggcacaggagaagaaakgtagtgaatactaatttgaatacc

SEQ ID NO: 99570 - DNA, 50 bp, homo sapien
aagccaatctcctccaggattcaaarccttcataagcaccgtactttaca

SEQ ID NO: 99571 - DNA, 50 bp, homo sapien
cctgtagagcatcggaacattgaagmctgagaatgtgaatcattcttaga

SEQ ID NO: 99572 - DNA, 50 bp, homo sapien
cccagaaccctgagcatccgaagaaygggtcaccggaagtggtggtacaa

SEQ ID NO: 99573 - DNA, 50 bp, homo sapien
gggctgagttgtgaagaatgactacractgcactggtgaagggcctgaga

SEQ ID NO: 99574 - DNA, 50 bp, homo sapien
tatggggtgagtgtgaatgtgtaaargttcaacccccttgtcccaaagta

SEQ ID NO: 99575 - DNA, 50 bp, homo sapien
aaaaatgtaacatcccaagagcccaycataatgacatcacaaatgaaagg

SEQ ID NO: 99576 - DNA, 50 bp, homo sapien
atagaataattctaataacaatgtaygtgaccaccagtagtataaagata

SEQ ID NO: 99577 - DNA, 50 bp, homo sapien
aataacaatctccccctttcagctayagaacacttaatcatggcatgcaa

SEQ ID NO: 99578 - DNA, 50 bp, homo sapien
atagcaggacttagaggatcaatgakaacttttcatcaaactttctcacc

SEQ ID NO: 99579 - DNA, 50 bp, homo sapien
tcttgagtacatcacagagcatttaygaaagttggaattttaaataacca

SEQ ID NO: 99580 - DNA, 50 bp, homo sapien
tattgctctccaagataagtatagamatggccaagctttatgagctgaga

SEQ ID NO: 99581 - DNA, 50 bp, homo sapien
tctctccttttttttcttatttgccraggagacaaaaattcaccctgagt

SEQ ID NO: 99582 - DNA, 50 bp, homo sapien
taccaatagtgaaataacatgtacayaatttttttaaatgcagacacaca

SEQ ID NO: 99583 - DNA, 50 bp, homo sapien
tgtttcatgcttttatcaattatagrcaaaatttttggagcaaaagtaga

SEQ ID NO: 99584 - DNA, 50 bp, homo sapien
aatagctttcactttgcgggatacargaactcacatgcatcttctgatca

SEQ ID NO: 99585 - DNA, 50 bp, homo sapien
ttttagtttttgttttgcaaattaaytaaaacctgtcaggcctcagcttc

SEQ ID NO: 99586 - DNA, 50 bp, homo sapien
atatctgcactttaaagctactatgmaagtatctcattgaatgttgtctt

SEQ ID NO: 99587 - DNA, 50 bp, homo sapien
actagtaaaaactaaattaacaggakagaccaaatgaacagaattatatt

SEQ ID NO: 99588 - DNA, 50 bp, homo sapien
catccttacatagccattagaacctscagatgtcttctgagactgttaat

SEQ ID NO: 99589 - DNA, 50 bp, homo sapien
ttgtgcacatctcaacataggtcaayggcttcacacacaacaacgattga

SEQ ID NO: 99590 - DNA, 50 bp, homo sapien
cttaagtgaaatctcagctgggttarcaagagagcaatgggtggtcaagc

SEQ ID NO: 99591 - DNA, 50 bp, homo sapien
tcggacagaaaggatcattaaagcayattcgtattttatccatactctgt

SEQ ID NO: 99592 - DNA, 50 bp, homo sapien
ctgagcagtcagggttaccaacataktacagttatcagtgaacttaaagt

SEQ ID NO: 99593 - DNA, 50 bp, homo sapien
ctttccctatctctttacttagctaygagccttagacaagttatttaacc

SEQ ID NO: 99594 - DNA, 50 bp, homo sapien
gacaaaggatagcactaccaaatgaycttcaatgtaggtgtagagtgaaa

SEQ ID NO: 99595 - DNA, 50 bp, homo sapien
ttttaaaatgtcatctttatataacragggaaatttgacaccactaagtt

SEQ ID NO: 99596 - DNA, 50 bp, homo sapien
aataaatagtcgtcgattcatacaayggaataatagacaacaacaaaaag

SEQ ID NO: 99597 - DNA, 50 bp, homo sapien
gtagagaaaatagaaggcttagagaraatgtatttaaaagtaaacaagca

SEQ ID NO: 99598 - DNA, 50 bp, homo sapien
aatcatattattcaatgattaagtcraaaaatataaaaaatagattaggc

SEQ ID NO: 99599 - DNA, 50 bp, homo sapien
tcttagtctacttaaaaatttctcartctactattcctgaaaatgtaagc

SEQ ID NO: 99600 - DNA, 50 bp, homo sapien
gatcaaggaataactctattgggaaygcagaaacttattgatgaaaaagt

SEQ ID NO: 99601 - DNA, 50 bp, homo sapien
ttttgctctttagcttctgatttaayatctctagctgatgaatttcaaat

SEQ ID NO: 99602 - DNA, 50 bp, homo sapien
attaaaatcacaaatgttgaatgagraaaatagtttctgagaatttcttt

SEQ ID NO: 99603 - DNA, 50 bp, homo sapien
cacagccacctctttacctcacacaytgcattcaggaaaagcactgcatg

SEQ ID NO: 99604 - DNA, 50 bp, homo sapien
atactatgcacacaatatgtccttayctagcctgatgcatgctctaaaac

SEQ ID NO: 99605 - DNA, 50 bp, homo sapien
acaataagtgatcctggaccaaggaraaaggctataaaagacatcatttg

SEQ ID NO: 99606 - DNA, 50 bp, homo sapien
aagaaagataactcatgagacattcrcaattaatagaaattgagtattct

SEQ ID NO: 99607 - DNA, 50 bp, homo sapien
ataagactaacaagtgtgcattcagrctacatgtataagagggtaagagg

SEQ ID NO: 99608 - DNA, 50 bp, homo sapien
tctcttcaaaaatagtatggttatcraagtatcaagtaactgttctacaa

SEQ ID NO: 99609 - DNA, 50 bp, homo sapien
tacaaccataacttttatatcctaaktattagccttggtgaaatgatcgt

SEQ ID NO: 99610 - DNA, 50 bp, homo sapien
ttttaatttggtggtagtaattacaytggccatattatagttaataactt

SEQ ID NO: 99611 - DNA, 50 bp, homo sapien
agaaaacctttccttagtttcagatmacatccttcatctgtgatttgcga

SEQ ID NO: 99612 - DNA, 50 bp, homo sapien
tataaatacccagtttctcaaatacrcttggaatcagctttctatattac

SEQ ID NO: 99613 - DNA, 50 bp, homo sapien
agaaaatgaaatgtgattagtccaawtattcaagcaaaaaaaattaatgt

SEQ ID NO: 99614 - DNA, 50 bp, homo sapien
ttaattgtgggtagatttttgacaaygtatgtagtgaaggatttatatgt

SEQ ID NO: 99615 - DNA, 50 bp, homo sapien
aaatcgtagaatttagaactggaatraaccttaacagatgaaagaaacca

SEQ ID NO: 99616 - DNA, 50 bp, homo sapien
gtcaaaaatctacccacaattaagcmgccagatagaacatcttcaaacat

SEQ ID NO: 99617 - DNA, 50 bp, homo sapien
aaatcccaaatatggtattacatcayaatctcctgtggaattaaatattt

SEQ ID NO: 99618 - DNA, 50 bp, homo sapien
agtgtagacagtgagtgtaacatcargcataagataaatgagactctgct

SEQ ID NO: 99619 - DNA, 50 bp, homo sapien
ctacttaatacctgatcacttcaaartagcgagttgtagaaaactgtttg

SEQ ID NO: 99620 - DNA, 50 bp, homo sapien
atttgttaatggtagggacatatacrggaatataaagcatcaccaataaa

SEQ ID NO: 99621 - DNA, 50 bp, homo sapien
aaatcatagcatttgccactcaaaasatgtaaatatccaacagttaatgt

SEQ ID NO: 99622 - DNA, 50 bp, homo sapien
tgtggcatttacaccatatctactgmagaaatggcaagaagaatttttca

SEQ ID NO: 99623 - DNA, 50 bp, homo sapien
aatccagagactgccagataaaaacyaggggtgcttttgggaaattgcta

SEQ ID NO: 99624 - DNA, 50 bp, homo sapien
tcatctgagcattggtatatgtttgsaatgagcatgctttctgtcttagt

SEQ ID NO: 99625 - DNA, 50 bp, homo sapien
gagggatactgtagttgaaaacaaaygagcaaatacaaaagccctatttg

SEQ ID NO: 99626 - DNA, 50 bp, homo sapien
ccatctcacattctagtgtttccatsactcaaagcctggaccacatggat

SEQ ID NO: 99627 - DNA, 50 bp, homo sapien
attcatttgcttcttgtatcaactaycatggctttcctccttccttactt

SEQ ID NO: 99628 - DNA, 50 bp, homo sapien
ccaaagcctaacaaggtgactggcayatcataataggtacataaaatgta

SEQ ID NO: 99629 - DNA, 50 bp, homo sapien
taagtgccacagacttgccagcctgyaacaagatggtttggaaaatgggg

SEQ ID NO: 99630 - DNA, 50 bp, homo sapien
gaagtgtgctctttgttagttttcckaaaaatgcctcaagctaattaatg

SEQ ID NO: 99631 - DNA, 50 bp, homo sapien
cttacaaagagtgacatcctgaaggyaaaatgcaatgcaaatgttttatg

SEQ ID NO: 99632 - DNA, 50 bp, homo sapien
aatgaatgaatcagtttgagacagasgattttttttacacagtgtgtgct

SEQ ID NO: 99633 - DNA, 50 bp, homo sapien
cttttcctccatgattaccagctagractgtgaaactaagggaagtggcg

SEQ ID NO: 99634 - DNA, 50 bp, homo sapien
ccccagcttactttttaaatctcaarcgaatcacaactatactggagcca

SEQ ID NO: 99635 - DNA, 50 bp, homo sapien
ttcacttgaggtaagccacctaagcrctcattccaaaaatttgaaatatg

SEQ ID NO: 99636 - DNA, 50 bp, homo sapien
ctggacagggaatttaaggcctttgyatatgactttatatgggattttag

SEQ ID NO: 99637 - DNA, 50 bp, homo sapien
ctcttctctcagagctgaacattgargttgattaccaatacatctgaaag

SEQ ID NO: 99638 - DNA, 50 bp, homo sapien
gtagcatcccaggcatcatggaggaraaatggattattaacaaatggagc

SEQ ID NO: 99639 - DNA, 50 bp, homo sapien
ctcttctttttcacttaactcctttyggatgtcacactgtcatcaaaaag

SEQ ID NO: 99640 - DNA, 50 bp, homo sapien
gttatggtagctttttaatggcttayaccaactggaaggacagattgctc

SEQ ID NO: 99641 - DNA, 50 bp, homo sapien
ataagtgcagagctgcatagcaacaygatttctgaaaatgaaaaacgtca

SEQ ID NO: 99642 - DNA, 50 bp, homo sapien
atggaatactatttagtcataaaaamctatgaaatcatatcatttgtagc

SEQ ID NO: 99643 - DNA, 50 bp, homo sapien
tggctgcaaattgggggcaaagagartaaactcaaaaagaaattatggag

SEQ ID NO: 99644 - DNA, 50 bp, homo sapien
gagagtttaaaactttcaagcttaaygtgaaaaatttgtttccagcaggg

SEQ ID NO: 99645 - DNA, 50 bp, homo sapien
cagcctgtcttcttgcaagactcaayagatgtgctttggagtattactga

SEQ ID NO: 99646 - DNA, 50 bp, homo sapien
catgtttatttcaactgaagaaacakggcattatgaaattttgtaaaata

SEQ ID NO: 99647 - DNA, 50 bp, homo sapien
tgtgcaactgcttattgtctaagagraaagagcctttagtgtggtgaaat

SEQ ID NO: 99648 - DNA, 50 bp, homo sapien
aaataagattatttctatagagaagsctgaaatatgatcatacttgctca

SEQ ID NO: 99649 - DNA, 50 bp, homo sapien
aaatgaacaaagttaatgcaaaagartatcgagggtactctgatagaagt

SEQ ID NO: 99650 - DNA, 50 bp, homo sapien
acaaatttatcatgtatccagtatawgctaaacattatcccagatacaaa

SEQ ID NO: 99651 - DNA, 50 bp, homo sapien
ttcctgcaggccccaggagacaacckaaaaactctgaagacaaaggacat

SEQ ID NO: 99652 - DNA, 50 bp, homo sapien
aaatgggatggacacttggaactgastaaagaaacagatcaatttgacat

SEQ ID NO: 99653 - DNA, 50 bp, homo sapien
agaaaggctggcaataaataagctayggataagaggaagaaagcagtagc

SEQ ID NO: 99654 - DNA, 50 bp, homo sapien
acaggttcatcttagaaataacaacygagaaagaacattcaaacttgtta

SEQ ID NO: 99655 - DNA, 50 bp, homo sapien
ttttgaaataatgattgcttgataarttaaaggaggctttaagttaaata

SEQ ID NO: 99656 - DNA, 50 bp, homo sapien
acacatttactatagaaaattaaacyaatacaagtaaatacatagaagaa

SEQ ID NO: 99657 - DNA, 50 bp, homo sapien
acctctagagagtacaaggaaatcargagagagaggtcaaagggagaact

SEQ ID NO: 99658 - DNA, 50 bp, homo sapien
aagcaattatcaattcctacaaaatraatatggaatatctgatcttagta

SEQ ID NO: 99659 - DNA, 50 bp, homo sapien
cacaccagactgggccaggatgaccmgaagtggtacctggagtatatgcc

SEQ ID NO: 99660 - DNA, 50 bp, homo sapien
cttcaggcctagctaactagactackatgttcaatactggagaaggaaga

SEQ ID NO: 99661 - DNA, 50 bp, homo sapien
acgagatgtaatggaagggtgataastgattagtaaccatccagacctcc

SEQ ID NO: 99662 - DNA, 50 bp, homo sapien
tcaaggagagttttaatctggccctyagaatggtttatgggttttgcttt

SEQ ID NO: 99663 - DNA, 50 bp, homo sapien
aactttgaagtggagtatttctaaakcaacgtcacacaacagtggaactc

SEQ ID NO: 99664 - DNA, 50 bp, homo sapien
caagtagctgtttagctattctttaraaactgttcatactgaattcaaat

SEQ ID NO: 99665 - DNA, 50 bp, homo sapien
caaagttgcaggctgaagtgcatcaragtagggtgttaaagaaaaattat

SEQ ID NO: 99666 - DNA, 50 bp, homo sapien
aggtcaagtttgtatcactgtagcaytgacatgtttgttttcacaccata

SEQ ID NO: 99667 - DNA, 50 bp, homo sapien
aactctaactgccctagcatacccasggtctacagaattgcttgtcatac

SEQ ID NO: 99668 - DNA, 50 bp, homo sapien
ctcaagatacacagacaaacccatarggattcaccatcaccatttagctg

SEQ ID NO: 99669 - DNA, 50 bp, homo sapien
aatcactactggttttcctaatcacygcttaactgttttgatttagatac

SEQ ID NO: 99670 - DNA, 32 bp, homo sapien
gttcaatgagtgaatayggagaacttgatcca

SEQ ID NO: 99671 - DNA, 50 bp, homo sapien
attactcacaaaatcacacaaataarctccaattacacaaacaatagtgt

SEQ ID NO: 99672 - DNA, 50 bp, homo sapien
cttgttactcttccaaagatgaaaasagaattcctagtactctttttata

SEQ ID NO: 99673 - DNA, 50 bp, homo sapien
tactcccggtaaccaccagaagaaastaaataggctcagatctctttcag

SEQ ID NO: 99674 - DNA, 50 bp, homo sapien
ttcaattttcttgctgataacttctrtatctaaaaatgctgataacacat

SEQ ID NO: 99675 - DNA, 50 bp, homo sapien
catgtaacctcagctgttctataatraggcttaacctttgtccactctgg

SEQ ID NO: 99676 - DNA, 50 bp, homo sapien
gatttatatttttgacacccagtgakgtaaagccaagatctggggtgttt

SEQ ID NO: 99677 - DNA, 50 bp, homo sapien
tgttataactcataaaccagccctgwattaaataatgttataatcctact

SEQ ID NO: 99678 - DNA, 50 bp, homo sapien
gatggttttcttattcttgatagatwagtcaccacaagcatttcattatc

SEQ ID NO: 99679 - DNA, 50 bp, homo sapien
ttggaaataggcacagtattaaaaastcaagtcttaccactttcccatcc

SEQ ID NO: 99680 - DNA, 50 bp, homo sapien
gctacaaacaagttttcacaaataasataaacaagttagaagctgatata

SEQ ID NO: 99681 - DNA, 50 bp, homo sapien
ggtgacctagcttttgcgacacacgsaggctgaaagatcatattgctgtt

SEQ ID NO: 99682 - DNA, 50 bp, homo sapien
aataaaaaatccttcaactaaccacratcacatatttaaatgagtactgt

SEQ ID NO: 99683 - DNA, 50 bp, homo sapien
ctgtgattataagctgtacccagtcrttagggaaaagcactaggcaaagt

SEQ ID NO: 99684 - DNA, 50 bp, homo sapien
gttgtttccccagtacagtgtttacraatactgaaatagacttaaatgtt

SEQ ID NO: 99685 - DNA, 50 bp, homo sapien
ccagtcattagggaaaagcactaggmaaagtccaagtttgtggacttgcc

SEQ ID NO: 99686 - DNA, 50 bp, homo sapien
gtataatattctgtcttattctactsactctctcagattataatcaaaat

SEQ ID NO: 99687 - DNA, 50 bp, homo sapien
acttccatgtaagataaattattgawctcaaactgtgataaactttactt

SEQ ID NO: 99688 - DNA, 50 bp, homo sapien
caataaactgtgtgtccatcatctascttcaataattattaacatcttgc

SEQ ID NO: 99689 - DNA, 50 bp, homo sapien
agaatcaggatcagaaaaatcaagawgtttcttttgtcactatttcaagg

SEQ ID NO: 99690 - DNA, 50 bp, homo sapien
taacttaatgaattaataataccgtkttagatgcaaatggcagcttgtta

SEQ ID NO: 99691 - DNA, 50 bp, homo sapien
tcctttacaactcctaacctagtgaygaattagtaatattgtgttggctg

SEQ ID NO: 99692 - DNA, 50 bp, homo sapien
ctgccattctttggataggttttcayggaaagagtccatattaagcccac

SEQ ID NO: 99693 - DNA, 50 bp, homo sapien
cccatcgataacagcttcagagataygatccactgtagatgcacactaca

SEQ ID NO: 99694 - DNA, 50 bp, homo sapien
gaaacaaacatgcttccgcctagtgsaatttagtgggagaatcagtcaag

SEQ ID NO: 99695 - DNA, 50 bp, homo sapien
ctgaactttagcttcaggtttttcartaactcacactgtgaccatgacca

SEQ ID NO: 99696 - DNA, 50 bp, homo sapien
agattgtaggtctgaatcttgaaacyagcctaatctttaattatttttag

SEQ ID NO: 99697 - DNA, 50 bp, homo sapien
ctgtttatctattggtggatttttgsattcgttccagtttggggctatta

SEQ ID NO: 99698 - DNA, 50 bp, homo sapien
ttcagtaagttttgaaaaatgtctayacagattcatgtaactgccaccaa

SEQ ID NO: 99699 - DNA, 50 bp, homo sapien
aaaaggtatctagccaaaatattacrgagctaggattgaagccaggattt

SEQ ID NO: 99700 - DNA, 50 bp, homo sapien
ttattaagcacttatgtatatgtagraaacatgtaactataccataattt

SEQ ID NO: 99701 - DNA, 50 bp, homo sapien
tgaagagctcagagctttgcagttayaggaacattaaaaagacagttttg

SEQ ID NO: 99702 - DNA, 50 bp, homo sapien
tctgtagaacaaaatagtcatagatratacattaacaaatggatgagact

SEQ ID NO: 99703 - DNA, 50 bp, homo sapien
cctggtaggttgtgtcaagcatgagyagtttcttagatggctttctctca

SEQ ID NO: 99704 - DNA, 50 bp, homo sapien
gtccatttcagagtctgctctttcamctttgtcctcaaatggtttatgac

SEQ ID NO: 99705 - DNA, 50 bp, homo sapien
taaggtaagtccagttagataacaarctatatggtaacaccttgttatgt

SEQ ID NO: 99706 - DNA, 50 bp, homo sapien
ggagaggacacagttaagtcaatagmagtcatatacagatgaaattaccc

SEQ ID NO: 99707 - DNA, 50 bp, homo sapien
gaaaaaagacagtggaacctatagawtagaagctaattaagagaagactt

SEQ ID NO: 99708 - DNA, 50 bp, homo sapien
atactatagagcagagttagcatcasaaactagatggacataaagtaaaa

SEQ ID NO: 99709 - DNA, 50 bp, homo sapien
aaagattctcaatttgttttataaaygaaggctctcatatgttctgtata

SEQ ID NO: 99710 - DNA, 50 bp, homo sapien
ttgtttttgtttgcatgctcttttayaaattctaaaattccagcttttcc

SEQ ID NO: 99711 - DNA, 50 bp, homo sapien
aagaaggtagcagtcggcattaagcrctgaagagaaagaaagaaatgtgt

SEQ ID NO: 99712 - DNA, 50 bp, homo sapien
caaagaatgaactatcaaaggattaycttgagcctgtaggctagagagat

SEQ ID NO: 99713 - DNA, 50 bp, homo sapien
aaccaaggacataaggccaagaagasgtatgccaccaggataatagcagg

SEQ ID NO: 99714 - DNA, 50 bp, homo sapien
gacacaatcaactgatgaaaattcamctctacctgccacagcatcctaaa

SEQ ID NO: 99715 - DNA, 50 bp, homo sapien
tgctttccagaagcaaaagctacccraatgatttaatatggcacttctgt

SEQ ID NO: 99716 - DNA, 50 bp, homo sapien
tcactggctcaattgcctcctgaacraagttagcaactcccagccaggag

SEQ ID NO: 99717 - DNA, 50 bp, homo sapien
tgggagatcttgacccacgtgtctayctttatctatatgtctgtctgtct

SEQ ID NO: 99718 - DNA, 50 bp, homo sapien
tttttttttttttttttggtcaacawaatctgtcttgtgtcttaacattt

SEQ ID NO: 99719 - DNA, 50 bp, homo sapien
tatggatggtgtaacaaactaccatsaatttggtggcttaaaagaataga

SEQ ID NO: 99720 - DNA, 50 bp, homo sapien
gaactgcaatgcactttcatttcaastcacttttttctttcaaatttggt

SEQ ID NO: 99721 - DNA, 50 bp, homo sapien
tgtattgatacataatcaatgtccartaaattacacatatttaaactaca

SEQ ID NO: 99722 - DNA, 50 bp, homo sapien
tattttggttgtaagaaatatacatsaaggagtgaagcagtaacctattg

SEQ ID NO: 99723 - DNA, 50 bp, homo sapien
atgtgaagttacatctatctattcgsgaacaaaaggaagttatgtttttg

SEQ ID NO: 99724 - DNA, 50 bp, homo sapien
tttctctattttattatctgaggtargaactcaaaacttaagagtcaaaa

SEQ ID NO: 99725 - DNA, 50 bp, homo sapien
gccagtaaggcagtctgttgtgatgmagtagaatgtgtttgacattatga

SEQ ID NO: 99726 - DNA, 50 bp, homo sapien
aaagctctgattagaaaaaggaagaraagtgataaagaatacatttcata

SEQ ID NO: 99727 - DNA, 50 bp, homo sapien
attaattgttttcaagccttaaaggwcagtatcattcaagcttagttgtt

SEQ ID NO: 99728 - DNA, 50 bp, homo sapien
tttcatgttaattctatgacatcacrgaacctttctttttctttgggcaa

SEQ ID NO: 99729 - DNA, 50 bp, homo sapien
acatttaattggatgccagatatatwaacttgttcggtactggtttctgt

SEQ ID NO: 99730 - DNA, 50 bp, homo sapien
ttgactctcagtggacaatggaacastggtaagcttttgaagaaattagt

SEQ ID NO: 99731 - DNA, 50 bp, homo sapien
atatgtctcatcaaacatcagctacrcaacttatttagtacaaggaggct

SEQ ID NO: 99732 - DNA, 50 bp, homo sapien
catcttgaaatttactaaattggtcraattgttcttcaaaacaatagaac

SEQ ID NO: 99733 - DNA, 50 bp, homo sapien
ctcaactcaattgaattaaataagayggaatttctgtgtatgtgtgtttg

SEQ ID NO: 99734 - DNA, 50 bp, homo sapien
cccacttaatgaatcctcttttaccracctccaaatgtcagaaagacacg

SEQ ID NO: 99735 - DNA, 50 bp, homo sapien
taatgggtgtaacgctaaataaagckatcctggtgtgtttacagagcagc

SEQ ID NO: 99736 - DNA, 50 bp, homo sapien
gagcctgttttctgatctttagataygctgacagtaccttacatgaaaag

SEQ ID NO: 99737 - DNA, 50 bp, homo sapien
cattttgcattcccagcaacaatcaragaaagttcttgttgctccatgtg

SEQ ID NO: 99738 - DNA, 50 bp, homo sapien
aacatcataaactgttaggtgttackcttttactattacctaaactctag

SEQ ID NO: 99739 - DNA, 50 bp, homo sapien
aacttccatttcattgtacttattgsataactctctaaatttctgcttca

SEQ ID NO: 99740 - DNA, 50 bp, homo sapien
ttgaaagagtgttgcataggcaacartatatggctgtcagttttaaccta

SEQ ID NO: 99741 - DNA, 50 bp, homo sapien
tagttgccaaaactttgaagcatccragatggcctgccgtaggtgtgcag

SEQ ID NO: 99742 - DNA, 50 bp, homo sapien
ccaggtactcaggcaaacatgacacraatgaatataggaagaaggagaat

SEQ ID NO: 99743 - DNA, 50 bp, homo sapien
atttttcaagccattattttaaaaaygttgagatagtttatgattcaacc

SEQ ID NO: 99744 - DNA, 50 bp, homo sapien
caattcagggagtagcttctagtaartgccaagacccagacctgccctca

SEQ ID NO: 99745 - DNA, 50 bp, homo sapien
ctagattatgtgacatataaaactcyacttcaaggaccctagcagatgcc

SEQ ID NO: 99746 - DNA, 50 bp, homo sapien
tcacaaagcctctttctagcactaartgtgaagtaatgaagccatcacac

SEQ ID NO: 99747 - DNA, 50 bp, homo sapien
ctcccctcttttctttgggtttcgckagatactctctcttaattagagac

SEQ ID NO: 99748 - DNA, 50 bp, homo sapien
cagaatcttattgcatctataaactragactcagataaaattcaaatggc

SEQ ID NO: 99749 - DNA, 50 bp, homo sapien
ttttacagaatgtgcttcaaaatggwaactgttgagttctatcaaccagg

SEQ ID NO: 99750 - DNA, 50 bp, homo sapien
tctccagtgtcctaagcttccttcartctcctttatttgtttccttttgc

SEQ ID NO: 99751 - DNA, 50 bp, homo sapien
ggttctatatttgactctatttgggktgttatcttttggttaatttctca

SEQ ID NO: 99752 - DNA, 50 bp, homo sapien
agtctagatagttactaattaaataygtctctcttccttgcagatgtgta

SEQ ID NO: 99753 - DNA, 50 bp, homo sapien
tgaaggaagcttaggacactggagayaaattagcagaatattcagaggag

SEQ ID NO: 99754 - DNA, 50 bp, homo sapien
gacagggatccaaatgtttgaaaaaktaataggtccaaagagtccttcta

SEQ ID NO: 99755 - DNA, 50 bp, homo sapien
agaggagaaactcatccatcttcatyacctgaattatctggcatgttgat

SEQ ID NO: 99756 - DNA, 50 bp, homo sapien
tccatttatcaataaaataagaatartaagaaatcatgcctggaagagag

SEQ ID NO: 99757 - DNA, 50 bp, homo sapien
ttgtcatatattttggaaataagaaygaagagctctaagtcagaaaacta

SEQ ID NO: 99758 - DNA, 50 bp, homo sapien
gcaggggcactgaattttggtcacaytgatcttttagattaggtaaaatg

SEQ ID NO: 99759 - DNA, 50 bp, homo sapien
ctccagtcttcctggatgtttctaamcctgtcgagacacagaccttctcc

SEQ ID NO: 99760 - DNA, 50 bp, homo sapien
ctcctttggtggggatgtttagcccsatagtaagtaactccagccaacta

SEQ ID NO: 99761 - DNA, 50 bp, homo sapien
acctccaaagccacagtttatcaacrcttaacatagaatgaaaattttaa

SEQ ID NO: 99762 - DNA, 50 bp, homo sapien
atctaattttgacaggtagatggaaytgttactttagattttggcaaatt

SEQ ID NO: 99763 - DNA, 50 bp, homo sapien
ataagctctttcacttcagaagcaartaaattatctataggtaatcaggg

SEQ ID NO: 99764 - DNA, 50 bp, homo sapien
tttgtatacatttgtatctccagcayccaacagaatattcgcatatagca

SEQ ID NO: 99765 - DNA, 50 bp, homo sapien
tctcatatgtgagttcatacactgaygaggaaagccagggaggccagacc

SEQ ID NO: 99766 - DNA, 50 bp, homo sapien
gtattttgtcttaaggtagtattaawctattggttcattcattcaatgtt

SEQ ID NO: 99767 - DNA, 50 bp, homo sapien
taatgaaaatggtgctctagctctgmaagttataagattaatcaatgtgc

SEQ ID NO: 99768 - DNA, 50 bp, homo sapien
caatgtcatttccttcttgttaccakctgttctcttgatcattgtagttg

SEQ ID NO: 99769 - DNA, 50 bp, homo sapien
acttaagatggagaaaaagtgttggraataagacttagtgtttatagctg

SEQ ID NO: 99770 - DNA, 50 bp, homo sapien
aaaacacgaacaacctcattttaaaytgcacaaaagatctgaacagaaaa

SEQ ID NO: 99771 - DNA, 50 bp, homo sapien
atattctgaatggtaaagatacaaakttcttctcccatgtggtatttgaa

SEQ ID NO: 99772 - DNA, 50 bp, homo sapien
gaaaaacaatagcaaaacgacatcartataacagaatgttctgaatatta

SEQ ID NO: 99773 - DNA, 50 bp, homo sapien
aatttcattatgcatctctgacttaycaacgcctaaactcgcccagactt

SEQ ID NO: 99774 - DNA, 50 bp, homo sapien
tcaagcagcattctcttctgtttaamtgtaaaattgggctaacacttcaa

SEQ ID NO: 99775 - DNA, 50 bp, homo sapien
atgccttccacttccacaagcctatwactttttattcttgttcttttttt

SEQ ID NO: 99776 - DNA, 50 bp, homo sapien
gagacaggcaaaatttaagtctttcraagtgcagcatctagtgagaattt

SEQ ID NO: 99777 - DNA, 50 bp, homo sapien
atgcatgttttatagtatttgctaawtggacgtggctaataaacctgcaa

SEQ ID NO: 99778 - DNA, 50 bp, homo sapien
gtttattacacagctaagaaagaatmaaagcgatcctttgaaatgttggt

SEQ ID NO: 99779 - DNA, 50 bp, homo sapien
taagaacccacatgatctaaactcakgctgcctatttgatttcacctctt

SEQ ID NO: 99780 - DNA, 50 bp, homo sapien
ggtggataagaaagattagtgttcayggagcgacatgtattgtttgcatg

SEQ ID NO: 99781 - DNA, 50 bp, homo sapien
aacgtccatatttcttagctggatarcatttaagtgtactactgtttctc

SEQ ID NO: 99782 - DNA, 50 bp, homo sapien
gggtactttaaagagccatttatttsttgcattgttatgtttttttctct

SEQ ID NO: 99783 - DNA, 50 bp, homo sapien
aaattgaaaatcaacttgagtttatyactgacagacaaaaaattatggat

SEQ ID NO: 99784 - DNA, 50 bp, homo sapien
ttggaacttctgttctcttgagggartagtgtttgtgctgattgaagtga

SEQ ID NO: 99785 - DNA, 50 bp, homo sapien
taccagaatataaatcaaaacaataratactagcaactttgaagttcatg

SEQ ID NO: 99786 - DNA, 50 bp, homo sapien
catgtgttagaactgttactgtcccygtaaaggtaatgattcttttacat

SEQ ID NO: 99787 - DNA, 50 bp, homo sapien
gagaggaattatgagaaaagcaaacyggagtattttcaatagcaaaattc

SEQ ID NO: 99788 - DNA, 50 bp, homo sapien
cttttctgattaatcgttcacatgayagggaatttaatttgttcagttct

SEQ ID NO: 99789 - DNA, 50 bp, homo sapien
gaactctgaatggattcttggcaackactatacttttttcatcttgtcta

SEQ ID NO: 99790 - DNA, 50 bp, homo sapien
aggaagtctgacagctctgttgcgayggttgagggaagagtcaagtttct

SEQ ID NO: 99791 - DNA, 50 bp, homo sapien
agggtatgtgactagcagatcaaaarcatcccgattccccccagcttaca

SEQ ID NO: 99792 - DNA, 50 bp, homo sapien
agctctgaagtgagatccacaagatrattctgtgagccgtcacaaggaat

SEQ ID NO: 99793 - DNA, 50 bp, homo sapien
caacttctttaatgacttcctaccartggaatttgagaacctcacctttc

SEQ ID NO: 99794 - DNA, 50 bp, homo sapien
tatttttggcatcctattattctcaktaagtagaaattgcgatagagatt

SEQ ID NO: 99795 - DNA, 50 bp, homo sapien
gaatccagtgctcaccctactcgccrcagaaatgactgctgtccacgcag

SEQ ID NO: 99796 - DNA, 50 bp, homo sapien
tcctgtgaaggttcttaccaattaartcatataaaagcaatggttggaaa

SEQ ID NO: 99797 - DNA, 50 bp, homo sapien
caagtaaatgctccagtttagccacractcaatctacacaccatgaaggc

SEQ ID NO: 99798 - DNA, 50 bp, homo sapien
agcgaagcaggagatgatgagtaccrcgcaattatcagtatattttgcag

SEQ ID NO: 99799 - DNA, 50 bp, homo sapien
ctcattcactcactaacagaagagaygacatagaattgtgtacaattgga

SEQ ID NO: 99800 - DNA, 50 bp, homo sapien
tgagtgttcactatgtactcagagarcttaacttgcattttctaatttga

SEQ ID NO: 99801 - DNA, 50 bp, homo sapien
tcccaggatcactattttcacataargttctggaagacaatcactactgg

SEQ ID NO: 99802 - DNA, 50 bp, homo sapien
ctcgcacaaaactctgaggagtctayaaattctacacatgaatctgccct

SEQ ID NO: 99803 - DNA, 50 bp, homo sapien
ttttcttgctaataatttcctcatamcttgtttctaaatttttaaaaatt

SEQ ID NO: 99804 - DNA, 50 bp, homo sapien
aaaataaaaaatcttatgcagttcamgttagaaaaattggattagtccaa

SEQ ID NO: 99805 - DNA, 50 bp, homo sapien
taagatgttagctgttaacatacacrcagatagccttttatatttggcct

SEQ ID NO: 99806 - DNA, 50 bp, homo sapien
cctataaagtaaaatgtgaaagtcayaaggagaaatcacaccatttaacg

SEQ ID NO: 99807 - DNA, 50 bp, homo sapien
gttctaagatttccttgataattacygactgaagttttacaaagcaaata

SEQ ID NO: 99808 - DNA, 50 bp, homo sapien
tattcctatcatacacttataacaaygtgctcaaatttcctttgtagtag

SEQ ID NO: 99809 - DNA, 50 bp, homo sapien
tctgttgtgatttgttcaagccaagkaacttttgattaatgagaaggctg

SEQ ID NO: 99810 - DNA, 50 bp, homo sapien
gatactaaatatccttatgtttaagscatttgaaactgcaggttctatta

SEQ ID NO: 99811 - DNA, 50 bp, homo sapien
tttatatggtattcctatgctcacasgctggatgattcttcctttgcctt

SEQ ID NO: 99812 - DNA, 50 bp, homo sapien
gagcaggtttagacataatttgtcasataagtggtaggaggcagatagag

SEQ ID NO: 99813 - DNA, 50 bp, homo sapien
taagctcattttccctccagtgcaakgtatccagtaaaaatgtttataat

SEQ ID NO: 99814 - DNA, 50 bp, homo sapien
agtgcctttgtccttctcacatcaaycaagatgagcccaattttaattac

SEQ ID NO: 99815 - DNA, 50 bp, homo sapien
ttaaaaagcagttaagcccaatagayaacaagtggattcccaacagataa

SEQ ID NO: 99816 - DNA, 50 bp, homo sapien
taagatgcaactggcccagagttgasagttgaaggtagaaaaatacaaaa

SEQ ID NO: 99817 - DNA, 50 bp, homo sapien
tcttgtcttgcctaagcaagtacaastcacctaaggtcagctttgttcct

SEQ ID NO: 99818 - DNA, 50 bp, homo sapien
ctccaaaaaattcaatattccatttwaaatatctgaattcttttaggatc

SEQ ID NO: 99819 - DNA, 50 bp, homo sapien
agactggtgcctgatatacatatgasagtgataaatgaaactgtgttggt

SEQ ID NO: 99820 - DNA, 50 bp, homo sapien
atttaaaacagtgaatcaacattaaktattagacacatatttttataatg

SEQ ID NO: 99821 - DNA, 50 bp, homo sapien
ctgtttcttgacccatagaagaccamgtattgacaaatgcttcagctttg

SEQ ID NO: 99822 - DNA, 50 bp, homo sapien
tgaagttgggacgtggttaataaaastgacacatacccaattcacaaaag

SEQ ID NO: 99823 - DNA, 32 bp, homo sapien
aggaggtataactaacrcatatgaactgctga

SEQ ID NO: 99824 - DNA, 50 bp, homo sapien
gcaataattactaactcgtccacccsaagtacagttttagtggcatcaaa

SEQ ID NO: 99825 - DNA, 50 bp, homo sapien
gagagtaggatgctttctaactagakagggttgatggtaaactacaaaac

SEQ ID NO: 99826 - DNA, 50 bp, homo sapien
agtgaaagaatgatcctacaagatarcagtgattaacaaccacaactata

SEQ ID NO: 99827 - DNA, 50 bp, homo sapien
tgttagagccacaagattgaggctcyctgaaaaaaccaaaatgggcaaac

SEQ ID NO: 99828 - DNA, 50 bp, homo sapien
ttctgggtcttttctgccttgccacygtacttggaaacacattaccagat

SEQ ID NO: 99829 - DNA, 50 bp, homo sapien
ctgagagaaggaggaaagaaagaccrgatgctttattaagaggctggagc

SEQ ID NO: 99830 - DNA, 50 bp, homo sapien
gacacaaaatcctctgtgcctaagcsactatgaaatagttgcacataatt

SEQ ID NO: 99831 - DNA, 50 bp, homo sapien
aggagatacgtaattacatttcactyaaggtcttagttttgtgaacgcaa

SEQ ID NO: 99832 - DNA, 50 bp, homo sapien
agtttgtgctcttgagtactaactayaaagctgtcatataatagatacct

SEQ ID NO: 99833 - DNA, 50 bp, homo sapien
agccttttacctttagatcacaacaratattaggtatcaccctatacatc

SEQ ID NO: 99834 - DNA, 50 bp, homo sapien
ggttacactgacatgttataagatasgaaaagtctttagtgcaaaaatag

SEQ ID NO: 99835 - DNA, 50 bp, homo sapien
cttgttagtcagtcagggcaaggtamaactatgactttttcaaagaggtt

SEQ ID NO: 99836 - DNA, 50 bp, homo sapien
atgggggagcgtcatggctccagcaygtaatacggtgacatagtgctgag

SEQ ID NO: 99837 - DNA, 50 bp, homo sapien
aagcccttgtcattgaagaaatgggyttaaatctgcatttgagaatgaat

SEQ ID NO: 99838 - DNA, 50 bp, homo sapien
gcctcaaaataataagagccatacawggaaaacccacagctgatatcata

SEQ ID NO: 99839 - DNA, 50 bp, homo sapien
agtcttcagggttggaggttccaacractctgggctggaggttgactagg

SEQ ID NO: 99840 - DNA, 50 bp, homo sapien
ctatattattttggtcctggctggartcaacctctaccttcaatctacat

SEQ ID NO: 99841 - DNA, 50 bp, homo sapien
cctgatggctacttgacttctgtgartatttagttcttttccatctacaa

SEQ ID NO: 99842 - DNA, 50 bp, homo sapien
gcactagaacataagtctcatgagartaagaactgtagtgtattttgttc

SEQ ID NO: 99843 - DNA, 50 bp, homo sapien
ttctgtatctaaaatattcttcctcrgaaacattgctgtattatttcctg

SEQ ID NO: 99844 - DNA, 50 bp, homo sapien
aattgactgcctcacttgctaggtgsaaagctctgtgagaggagggacca

SEQ ID NO: 99845 - DNA, 50 bp, homo sapien
ctgagtggctcatacaattttaagarcataccacacagatctatgaaagg

SEQ ID NO: 99846 - DNA, 50 bp, homo sapien
tggaaacttaaggatcctgacccaaraggtagactggacactgatggtga

SEQ ID NO: 99847 - DNA, 50 bp, homo sapien
gatggtggactaactattttctcccyatctttcagatctaaaccccacat

SEQ ID NO: 99848 - DNA, 50 bp, homo sapien
aaatacgaattctgtacagttttgaragcaaagacaatggagtttcatgt

SEQ ID NO: 99849 - DNA, 50 bp, homo sapien
aaacaggagatgcttctgaaggccayaagtttggagcttactttaacctg

SEQ ID NO: 99850 - DNA, 50 bp, homo sapien
atttctaggggtttttatacctcacmatttctaaaatcttcattaagctt

SEQ ID NO: 99851 - DNA, 50 bp, homo sapien
cctattatttgaatatgtgctatacrcttgaattagaaaaacctgcttga

SEQ ID NO: 99852 - DNA, 50 bp, homo sapien
gtagtcatgctgtcttattgcaagawgagctagaggtaagtatgtggttt

SEQ ID NO: 99853 - DNA, 50 bp, homo sapien
tggaattcatgatgaagtttatcagrcatgtttcatccacattatgcaca

SEQ ID NO: 99854 - DNA, 50 bp, homo sapien
gaataaattaaatatatgcaaagtaygagattctgaagataacgagaaga

SEQ ID NO: 99855 - DNA, 50 bp, homo sapien
aagtattagtctttgcttgagttgastatatacagttgaccctccatatc

SEQ ID NO: 99856 - DNA, 50 bp, homo sapien
ctgattattatttagaccagatgaamccctatttttttctagatgcttct

SEQ ID NO: 99857 - DNA, 50 bp, homo sapien
ctacaaaacatcagtggaatgcgtckctttataaactaactactcaccca

SEQ ID NO: 99858 - DNA, 50 bp, homo sapien
tttttctcctcccagcctgtagaagrcattcatttacttattgatgtgaa

SEQ ID NO: 99859 - DNA, 50 bp, homo sapien
tggtctccagcatgactgtagaacaytgaaggaactagactgagtgaaga

SEQ ID NO: 99860 - DNA, 50 bp, homo sapien
gggtggaaagttacaaaatattgaartgtacagttgagagccacatattc

SEQ ID NO: 99861 - DNA, 50 bp, homo sapien
tttttcttcttttatttcaaaggcartctaaactttcccacaagctgatt

SEQ ID NO: 99862 - DNA, 50 bp, homo sapien
cctcaaagtctggcctcaacgactayccttgcaaagaggcttgaatttaa

SEQ ID NO: 99863 - DNA, 50 bp, homo sapien
ctgtacttttgttcacatagaagacratttaggagcctttctcataatgt

SEQ ID NO: 99864 - DNA, 50 bp, homo sapien
atcatgtttctagagtggagagaaaygagcatcaacaagagtgtggcttg

SEQ ID NO: 99865 - DNA, 50 bp, homo sapien
tgaatcagatgggagataagcaaaaytaaagcatccttggattaatgtat

SEQ ID NO: 99866 - DNA, 50 bp, homo sapien
gtttagacaatactgttgttttatasaattatttagatttgcccacatat

SEQ ID NO: 99867 - DNA, 50 bp, homo sapien
aggttcaatcgtaggcttatttatckccaaactattaagattgtattagt

SEQ ID NO: 99868 - DNA, 50 bp, homo sapien
tgcaaccaatcaaatattttctttgyattacttttgagtttgtcctataa

SEQ ID NO: 99869 - DNA, 50 bp, homo sapien
tttgaacactaaattattcttataartggtagttaggctcctagacttgt

SEQ ID NO: 99870 - DNA, 50 bp, homo sapien
cttaactatttccttcctttcactcygacttctactgtatttaatcctcc

SEQ ID NO: 99871 - DNA, 50 bp, homo sapien
ggacactatcagtcaggattttctcrttgcctggctggtgttcaaatggg

SEQ ID NO: 99872 - DNA, 50 bp, homo sapien
gagtatagcagagatggaatgatcckgagtgcattatgccaataaaccac

SEQ ID NO: 99873 - DNA, 50 bp, homo sapien
gccaagctggactcactgtcagttargagttcctttgtagacatatggga

SEQ ID NO: 99874 - DNA, 50 bp, homo sapien
gcagttgtccatgtccattcaataarttagtctgaagctttagacaacac

SEQ ID NO: 99875 - DNA, 50 bp, homo sapien
tagatgtttataaggatcaggtacakacccaagtttcaagatgggaccag

SEQ ID NO: 99876 - DNA, 50 bp, homo sapien
atataagtaaatgaaactgtagacaygaattatagattcctcttttgttt

SEQ ID NO: 99877 - DNA, 50 bp, homo sapien
aagtaagaatataatttagcagtcasgtacggaaattaatctaagatcaa

SEQ ID NO: 99878 - DNA, 50 bp, homo sapien
tgcctaagagaaaattggagatggtraacaatagagttttgattgatgca

SEQ ID NO: 99879 - DNA, 50 bp, homo sapien
gtccaaagtcccacaatacatattaycacagtgttcccttacaaaattaa

SEQ ID NO: 99880 - DNA, 50 bp, homo sapien
ctgtataaatagtaagattagaaaayccaagtcaataaatcagagcaaga

SEQ ID NO: 99881 - DNA, 50 bp, homo sapien
accaacaaagctccagtaattgaacsagaaaatttgaaaacctattaaat

SEQ ID NO: 99882 - DNA, 50 bp, homo sapien
aaagtatcttctgaaacatgatacastgggtaacgttcagttcagtttaa

SEQ ID NO: 99883 - DNA, 50 bp, homo sapien
ctgaggctagcataacatatatgagwatacaacttgcctatttccagaaa

SEQ ID NO: 99884 - DNA, 50 bp, homo sapien
tccgttataatataatgatcagatarctaagtataatattatatggctaa

SEQ ID NO: 99885 - DNA, 50 bp, homo sapien
gggcataatccacagcttactttcaygtccacaaaagtgtaagaagaata

SEQ ID NO: 99886 - DNA, 50 bp, homo sapien
atccgaatattgggaatgtttataartgtgactatcctatgagatttcaa

SEQ ID NO: 99887 - DNA, 50 bp, homo sapien
tcacttacctactatcaagatttaasaaatgtcaaaatgttgccatattt

SEQ ID NO: 99888 - DNA, 50 bp, homo sapien
agtatacaattcacagcatgattgastaagcagcaccttttaatttaaaa

SEQ ID NO: 99889 - DNA, 50 bp, homo sapien
gcaaagtaaagataatccgctagtcraggagattatttatattccctaaa

SEQ ID NO: 99890 - DNA, 50 bp, homo sapien
ctaattagctccagggatctgcaacwtttcatttaatatttgagggctaa

SEQ ID NO: 99891 - DNA, 50 bp, homo sapien
taattgcaatccaacacttataaaayacatggaagaagaacatgcaatgg

SEQ ID NO: 99892 - DNA, 50 bp, homo sapien
taaaagtatcacatgtattaggtaayatggacttaataaatagatcttta

SEQ ID NO: 99893 - DNA, 50 bp, homo sapien
actggaaaaatttaatggatgacagmattcaccttagagtaattttgtga

SEQ ID NO: 99894 - DNA, 50 bp, homo sapien
agcctagcatacatgtatatacaatyatgtttttcttttaacattgcaca

SEQ ID NO: 99895 - DNA, 50 bp, homo sapien
caaagtcttcaaatcagcctgccaakgttccaataaatgctgtgctgttt

SEQ ID NO: 99896 - DNA, 50 bp, homo sapien
taaattacttcatatataaattaaarttagttgatagctggagtgctgtg

SEQ ID NO: 99897 - DNA, 50 bp, homo sapien
agattaggtatttgaaaagaatatartaagtgaaagcataaggttctgga

SEQ ID NO: 99898 - DNA, 50 bp, homo sapien
agaggatgtctgtttatgtgcaagaygttttatccacatgaacaatcata

SEQ ID NO: 99899 - DNA, 50 bp, homo sapien
tacttggagtcaacaaaatacaaaayagagactggttctgttggatgtac

SEQ ID NO: 99900 - DNA, 50 bp, homo sapien
gatatcttctgccaaaaatggggcaycataattccttgtacatccaacag

SEQ ID NO: 99901 - DNA, 50 bp, homo sapien
taaaatctttgtgatcttgtgggtaragatttcctagattggacatcaaa

SEQ ID NO: 99902 - DNA, 50 bp, homo sapien
gacaactataattcctgattgtgtcmagatttctactttatgtgattatt

SEQ ID NO: 99903 - DNA, 50 bp, homo sapien
ggaaaaatgtccactgaaaaatcacyatcctttccccaggttccagatct

SEQ ID NO: 99904 - DNA, 50 bp, homo sapien
cttcacaagtattttcaagagctcartccaccttaaataagtggattaaa

SEQ ID NO: 99905 - DNA, 50 bp, homo sapien
agcatgaagcctgcgctgtctctacrcttctggttactatatagtcagtg

SEQ ID NO: 99906 - DNA, 50 bp, homo sapien
gagacaggcacagacatattacagasggaagaccacgtgaagacacagag

SEQ ID NO: 99907 - DNA, 50 bp, homo sapien
tttttggagtacaagaaaattgagtytgaattaatttctgccaataattt

SEQ ID NO: 99908 - DNA, 50 bp, homo sapien
tctgtcatttagaaatagtgatttaygggagcctcatttttcaatgaatg

SEQ ID NO: 99909 - DNA, 50 bp, homo sapien
taaagcaacaataagataccaactaygctggctttaatagtaacagacta

SEQ ID NO: 99910 - DNA, 50 bp, homo sapien
agaagcttctgtttctgctatggccrctgcaagtagggaaaatcactgac

SEQ ID NO: 99911 - DNA, 50 bp, homo sapien
gctccatacactttttggcatcatayaataagtgacaaaactttcagaat

SEQ ID NO: 99912 - DNA, 50 bp, homo sapien
cagtggaaaaaattgagattctctcmacaagacagagactttgtgctgaa

SEQ ID NO: 99913 - DNA, 50 bp, homo sapien
tatacattgtggtttcaataaaccayggtaaagagttgtaataaagccag

SEQ ID NO: 99914 - DNA, 50 bp, homo sapien
agattaacaaacctttgtgtcgttcraaaattaatcaacacacagtttaa

SEQ ID NO: 99915 - DNA, 50 bp, homo sapien
tcattttattatatattgtaattgasatctattgattgccagacagacat

SEQ ID NO: 99916 - DNA, 50 bp, homo sapien
gacaatgtgacaactaaaacaaagcratatgttcctggctttgaagatag

SEQ ID NO: 99917 - DNA, 50 bp, homo sapien
caaaattagacacacactgacaaaaytgcttatggatcccacagatgact

SEQ ID NO: 99918 - DNA, 50 bp, homo sapien
tttcaacctacctgcttttatttttragaagatcaaagtaggaggaggat

SEQ ID NO: 99919 - DNA, 50 bp, homo sapien
acatcagagatgacagcatccaccayggaaatcgtattgcaggggaaatg

SEQ ID NO: 99920 - DNA, 50 bp, homo sapien
ttaactagactatgagttagctacasactctgtttttatttaaaattctc

SEQ ID NO: 99921 - DNA, 50 bp, homo sapien
taattaatgaatttttgaataggtaycctgtttacatagtataaaaatca

SEQ ID NO: 99922 - DNA, 50 bp, homo sapien
atcaaatggcatagtataatacatgraaatatggacaaattccatgtaag

SEQ ID NO: 99923 - DNA, 50 bp, homo sapien
atagatgggaacaagacttttcaggraacacttataaatattattttgat

SEQ ID NO: 99924 - DNA, 50 bp, homo sapien
agtgactctatatctcagatgataaracttggatctaaatttaacttctg

SEQ ID NO: 99925 - DNA, 50 bp, homo sapien
acaaaaaatagtagtcttacgttcargaagaattcataattcctgaagtt

SEQ ID NO: 99926 - DNA, 50 bp, homo sapien
cagaaactatgagtatattatctcamatggcacaagggactttgcattaa

SEQ ID NO: 99927 - DNA, 50 bp, homo sapien
agttcacacagacttgaaggataatsaatgtggagattttattgagcagt

SEQ ID NO: 99928 - DNA, 50 bp, homo sapien
gtcttagactctgctaaataaaggawcatacgctaggatgaaaagtctta

SEQ ID NO: 99929 - DNA, 50 bp, homo sapien
aggcatgggtatgattattcacagtkaaatgctgacaggcccttctcttc

SEQ ID NO: 99930 - DNA, 50 bp, homo sapien
cagatgagtaagctgttccatttgtyaaggttgaaagatttactcaaact

SEQ ID NO: 99931 - DNA, 50 bp, homo sapien
ttctttctattattgttaaaaacagmagtccagagaaaacatgtatttcc

SEQ ID NO: 99932 - DNA, 50 bp, homo sapien
gtgtgtctataggaacattccggaasgcagcggctttggtaaagcctgat

SEQ ID NO: 99933 - DNA, 50 bp, homo sapien
attacccttgattggcaaagtaacaytgggcttctctgagtgtggtgact

SEQ ID NO: 99934 - DNA, 50 bp, homo sapien
caagagacaggatccacataaaatgmatataggagattccctagatggaa

SEQ ID NO: 99935 - DNA, 50 bp, homo sapien
cactattatagctgttgaagtgactyacaatatagtggtaggctgaaaaa

SEQ ID NO: 99936 - DNA, 50 bp, homo sapien
taattatgaactaaacttccctcaartcctcaaactttcttagttccaaa

SEQ ID NO: 99937 - DNA, 50 bp, homo sapien
taacaaacacaaaatctttgcatcarattaacataatgcaggactgaatc

SEQ ID NO: 99938 - DNA, 50 bp, homo sapien
tgtctgcaagtaacatggaggaaatrtctactgggtaaatgtccagctgt

SEQ ID NO: 99939 - DNA, 50 bp, homo sapien
tttgagagcacctgttaaagttctayacctcattataaaccatcttttga

SEQ ID NO: 99940 - DNA, 50 bp, homo sapien
ggtttaaaaatagttgcactgtaaaratgtgattactcctttatccaagt

SEQ ID NO: 99941 - DNA, 50 bp, homo sapien
aaagatatgaaaatctgtgggtataytaataacatgataaaaagctcaag

SEQ ID NO: 99942 - DNA, 50 bp, homo sapien
tgattatggtatatcatgtaactagsagaatctctttgtttggggtaaaa

SEQ ID NO: 99943 - DNA, 50 bp, homo sapien
tgatccctctactttttgtgtaagtsaaatagaggccagatgctcatgtg

SEQ ID NO: 99944 - DNA, 50 bp, homo sapien
catttcccactgaattatttcatgcraatctcagatatcatattatttca

SEQ ID NO: 99945 - DNA, 50 bp, homo sapien
ctttaagcatgtaaggctcaaaataygtggtcacttgcctctactagcaa

SEQ ID NO: 99946 - DNA, 50 bp, homo sapien
gggccagggatttggatgtccttcayagataaagagtgaatctctgggtt

SEQ ID NO: 99947 - DNA, 50 bp, homo sapien
atgcttttttctctactgtattggayaaaactagaggggaaatgcaacct

SEQ ID NO: 99948 - DNA, 50 bp, homo sapien
tggattgcttttggaacccagaaaakaggttgcatttcccctctagtttt

SEQ ID NO: 99949 - DNA, 50 bp, homo sapien
acaagtgattatagcaaggttataaratacaaagttaatacacaagtcaa

SEQ ID NO: 99950 - DNA, 50 bp, homo sapien
aaatactaagaatcaactattattarggaacaaatctaagaatagaagag

SEQ ID NO: 99951 - DNA, 50 bp, homo sapien
ttggcaggtacatgctagaataaccwattagagggtgatatatcagggcc

SEQ ID NO: 99952 - DNA, 50 bp, homo sapien
ttacttagtgcttcccttttttttgkaatcatcaaactttttataactga

SEQ ID NO: 99953 - DNA, 50 bp, homo sapien
gcataagtttaacacaatttggcaawgaataaaattgaaggagagagagc

SEQ ID NO: 99954 - DNA, 50 bp, homo sapien
attaaggaaactagccaaagtcccawagttgtagtgatagatatgggatg

SEQ ID NO: 99955 - DNA, 50 bp, homo sapien
atgtttttttactgagcttagaatgyagatcactccaatcatactgcgtt

SEQ ID NO: 99956 - DNA, 50 bp, homo sapien
ctttgctaaatccccagttccttaawatggtagcctatgggtcacataga

SEQ ID NO: 99957 - DNA, 50 bp, homo sapien
cattgatgtaagctctcagagaaccrgatctcactcctttggattacaca

SEQ ID NO: 99958 - DNA, 50 bp, homo sapien
tgaaatagctctggacctcaaataawatttaacaggcaatcatataagaa

SEQ ID NO: 99959 - DNA, 50 bp, homo sapien
atcttttcttgtcacttatagagaargttagattaataaagttgaccaaa

SEQ ID NO: 99960 - DNA, 50 bp, homo sapien
attttgagatattattggaaatataygtttgtgattgctttgtcttgatg

SEQ ID NO: 99961 - DNA, 50 bp, homo sapien
gaccagtgttcatctgcattaagtgsatactaaggaaagcattgcttaaa

SEQ ID NO: 99962 - DNA, 50 bp, homo sapien
cctgtgggtcactgagggaccattayagggaattgtgtgtttagtttaga

SEQ ID NO: 99963 - DNA, 50 bp, homo sapien
atcagctgtagagctattggttagcmaaattgccaaaagttctcaactac

SEQ ID NO: 99964 - DNA, 50 bp, homo sapien
aagtgagatgaaaattttaaaagctsaacacagtgtataagttgagcaaa

SEQ ID NO: 99965 - DNA, 50 bp, homo sapien
aatattcatttgacaaaaactacagraaaatctaataaatattgtcaatg

SEQ ID NO: 99966 - DNA, 50 bp, homo sapien
aattggctctgaaatctcagcgaccraacacaatgtatgtttgtcaccct

SEQ ID NO: 99967 - DNA, 50 bp, homo sapien
caaaaaaaaaagattcttagaattascatgttcagagcctactaaaacat

SEQ ID NO: 99968 - DNA, 32 bp, homo sapien
attctgagtgctttccrtttgctaattcatgg

SEQ ID NO: 99969 - DNA, 50 bp, homo sapien
tatgttccagcaacatgacaaaaatratggaagttctcagaaacttgctg

SEQ ID NO: 99970 - DNA, 50 bp, homo sapien
tcagcagtttatactatatattggawgtattgccacctctcttgacaggc

SEQ ID NO: 99971 - DNA, 50 bp, homo sapien
gaaaagagatggggagttgctggaastataaaaggtaagttttgagatgt

SEQ ID NO: 99972 - DNA, 50 bp, homo sapien
ggtgattaatattcgtcattgtcctrtgatgatacttcacaaaatcattt

SEQ ID NO: 99973 - DNA, 50 bp, homo sapien
taatatgccattacacatctttttgratctactacacccacttctaccca

SEQ ID NO: 99974 - DNA, 50 bp, homo sapien
agaggcacaggtccatctaactgagyccattacagagcacacagcactgc

SEQ ID NO: 99975 - DNA, 50 bp, homo sapien
ggacaactaaataatggtcctatgaytcaaaatatctggtgagtgaataa

SEQ ID NO: 99976 - DNA, 50 bp, homo sapien
tttggtgattggtggagataatgtgraagttaaagcttctccatgcacct

SEQ ID NO: 99977 - DNA, 50 bp, homo sapien
ggtccactacaaatatgtgccttaawacttccaggttgattcctggttgt

SEQ ID NO: 99978 - DNA, 50 bp, homo sapien
tgtaacatacacccacaaatagaaasacctacatagcctatatggccaaa

SEQ ID NO: 99979 - DNA, 50 bp, homo sapien
acattcacatgtagaagttattttcraccatctgtttttaacaggagata

SEQ ID NO: 99980 - DNA, 50 bp, homo sapien
caccctttcctccatttcaacagaaygagaattgcaaagaactggcctca

SEQ ID NO: 99981 - DNA, 50 bp, homo sapien
ataatagtgtttaaagattcttgtcyaactaattcaatcatctgtatttc

SEQ ID NO: 99982 - DNA, 50 bp, homo sapien
caggcttgtcttcctttagccgttayatgttggacttcctccaagctcag

SEQ ID NO: 99983 - DNA, 50 bp, homo sapien
aagatttacttctttatattaacacraaataagtaacatgtaacatggga

SEQ ID NO: 99984 - DNA, 50 bp, homo sapien
acagagagcattaagactgatgatayagaatagatggaatgagacctcta

SEQ ID NO: 99985 - DNA, 50 bp, homo sapien
tctctatcctaagatggaaattttgstgtgagaatgtcagtagcaattcc

SEQ ID NO: 99986 - DNA, 50 bp, homo sapien
ggggatcttgactcatttgagattayaagggagacagacctcagttggtg

SEQ ID NO: 99987 - DNA, 50 bp, homo sapien
tgtaagaaaaaaaccaatgaattcasagtgagactacacattaaaggaaa

SEQ ID NO: 99988 - DNA, 50 bp, homo sapien
ttgttttcttgctgtttaaaataackgtatcacccaatatgcactcctaa

SEQ ID NO: 99989 - DNA, 50 bp, homo sapien
gattcaagagatctagtatggaggaygtaaaacaagaaaatattcactta

SEQ ID NO: 99990 - DNA, 50 bp, homo sapien
ctagaaagtagttttccttgcataarccataatcaaaacttggcaaatcc

SEQ ID NO: 99991 - DNA, 50 bp, homo sapien
tcttccacatgttccagttgcctccrtaagttaagattttaaaaaaccaa

SEQ ID NO: 99992 - DNA, 50 bp, homo sapien
tcagatgctcagatttctagttattyaagcacatattatttttgtggcta

SEQ ID NO: 99993 - DNA, 50 bp, homo sapien
caaatgatgtgaacagacaatttgcraaagaagatatttatgcagccaac

SEQ ID NO: 99994 - DNA, 50 bp, homo sapien
taactagaaatctgagcatctgatayagaaatgagtatagtagctggata

SEQ ID NO: 99995 - DNA, 50 bp, homo sapien
atgggattaaggtcttgagccactgraaaaaagttttctttaattaaata

SEQ ID NO: 99996 - DNA, 50 bp, homo sapien
attcatcatacatatctaatctacaytggaatttttcaagaaagataagc

SEQ ID NO: 99997 - DNA, 50 bp, homo sapien
actggggttgaggtttcaaacaccaygacatcctgggtgactctcacagc

SEQ ID NO: 99998 - DNA, 50 bp, homo sapien
aattatccttttaaaacaaaagtccrgtcaagtcacttgtgttttaaaaa

SEQ ID NO: 99999 - DNA, 50 bp, homo sapien
caaatatttgttaagtaaatgctccragggttatttcttcagtttaagtg

SEQ ID NO: 100000 - DNA, 50 bp, homo sapien
cagaggctacaattagtaagttaatyatcacaaggttatttcaatttaaa

SEQ ID NO: 100001 - DNA, 50 bp, homo sapien
gtcccttctttatgagcgagtaatcyttttaagggaaatgagatgtaagc

SEQ ID NO: 100002 - DNA, 50 bp, homo sapien
tcaagaagaatgtgggtgtctacttwtgctaggtgtcgggaatatgaggg

SEQ ID NO: 100003 - DNA, 50 bp, homo sapien
attatactggtttatcttggtaggcrcaatataatcacatgagcccttaa

SEQ ID NO: 100004 - DNA, 50 bp, homo sapien
ttaagttctcatacattgataatggratgttaaactgtaatttcaaaaat

SEQ ID NO: 100005 - DNA, 50 bp, homo sapien
ttctagatgcagtgaataatcagaaraatcccctttctcacatagctcac

SEQ ID NO: 100006 - DNA, 50 bp, homo sapien
catttcaacgaacaggaaaagcaaaraggcccaagtgttaatctgtgttt

SEQ ID NO: 100007 - DNA, 50 bp, homo sapien
gagaacatcctatccccaaaattaaygcttagcttcagtaaatctccatc

SEQ ID NO: 100008 - DNA, 50 bp, homo sapien
aggcctggtgaaattcagcatagacrattccagagcttgggaatgtggta

SEQ ID NO: 100009 - DNA, 50 bp, homo sapien
tcctctaggtgttacaaagaacctcrgaaagggataccactttattagct

SEQ ID NO: 100010 - DNA, 50 bp, homo sapien
acatgaaaaactgtgtacaaaataaygttaagaggaaacagaacattaaa

SEQ ID NO: 100011 - DNA, 50 bp, homo sapien
tttcacaagatctggttctctaaaaytgtgtatcacgtccccttccctct

SEQ ID NO: 100012 - DNA, 50 bp, homo sapien
aggtgacaatgttttaggactcctaygtgttatcattctttggaggtcat

SEQ ID NO: 100013 - DNA, 50 bp, homo sapien
tttattctcagaaataacttaccaawggcatctgcattaattacattttt

SEQ ID NO: 100014 - DNA, 50 bp, homo sapien
tgctggtatgggcctaaagggtaccrcagttcactctgatctcattaatc

SEQ ID NO: 100015 - DNA, 50 bp, homo sapien
tgactctttgctcctaagaatcttcragacaaataaggacttgggttaaa

SEQ ID NO: 100016 - DNA, 50 bp, homo sapien
aaaagtgaacactccaaaaatccaasttcctaaacaccagccaagtgcca

SEQ ID NO: 100017 - DNA, 50 bp, homo sapien
agagaagaaatcttctctgagttgaygacaaaattgggacagatgaatga

SEQ ID NO: 100018 - DNA, 50 bp, homo sapien
aaatacctgcccacaatggctaaagyacatcatgacagaaggatgcactg

SEQ ID NO: 100019 - DNA, 50 bp, homo sapien
gatgcactgtgtccaaagacatgccragcttcagaggcaaacacctgtcc

SEQ ID NO: 100020 - DNA, 50 bp, homo sapien
tatatttgcccttaatacatagcaayggtgaagaatcaaacattcactga

SEQ ID NO: 100021 - DNA, 50 bp, homo sapien
ggcaatatcatcatgcttaaccgacsagatgaaagtgttctcgatcccca

SEQ ID NO: 100022 - DNA, 50 bp, homo sapien
aagtcaagctgatattccaggaaccratgaagtagatacttctggaaatg

SEQ ID NO: 100023 - DNA, 50 bp, homo sapien
ctcactctgtacagatattaatctayactaaaggcaatatcatcatgctt

SEQ ID NO: 100024 - DNA, 50 bp, homo sapien
ttgacaaaattattttagcatgatcyaattgagcctttttgtaaagtcca

SEQ ID NO: 100025 - DNA, 50 bp, homo sapien
ttagcacaaaaaaagtcttatagaaytaccataaaatctacaaatctata

SEQ ID NO: 100026 - DNA, 50 bp, homo sapien
aaactaatgatatttctgtgatacartccttatgtatagtaagaatttag

SEQ ID NO: 100027 - DNA, 50 bp, homo sapien
aacttccagtaagtagagcctagcayagaagttacagattagagctgcat

SEQ ID NO: 100028 - DNA, 50 bp, homo sapien
attaactaccctacctttcaagaaamtgcacagggtcacgacttttctat

SEQ ID NO: 100029 - DNA, 50 bp, homo sapien
aacgttttccttaacgctgaactatwaaataaatatatcaaaaggcattg

SEQ ID NO: 100030 - DNA, 50 bp, homo sapien
tgatataatattcatttcagtaagaytagtaataatttgtatcattctat

SEQ ID NO: 100031 - DNA, 50 bp, homo sapien
tattataggcccttaatggaaaatayactgaaggagaatactctgaaagc

SEQ ID NO: 100032 - DNA, 50 bp, homo sapien
aatcctttaaatgaaagttgccctamgggaagaaattcaaacagtataat

SEQ ID NO: 100033 - DNA, 50 bp, homo sapien
ctgattttagaatttggagcctttgwaatagaagtattgtccctagattt

SEQ ID NO: 100034 - DNA, 50 bp, homo sapien
tcactctgttgtggtctggctccatkaacattgctacagtatattaaaga

SEQ ID NO: 100035 - DNA, 50 bp, homo sapien
ttaaaagggaaattttaaaagaggcycatgatatattagtcacatgaatg

SEQ ID NO: 100036 - DNA, 50 bp, homo sapien
ctgtgcaactagtctgcaaagaggarcattgccaaattctagatctgtga

SEQ ID NO: 100037 - DNA, 50 bp, homo sapien
tttgaaaatatcctttggagacttaraacttctaaattattcacttattt

SEQ ID NO: 100038 - DNA, 50 bp, homo sapien
gtgccttgtggaaaaaatgtaagtgmtagataagcttaattcaggcatga

SEQ ID NO: 100039 - DNA, 50 bp, homo sapien
cactggtcccatgttaaagcttcaartaattggaggcagagagtagaaag

SEQ ID NO: 100040 - DNA, 50 bp, homo sapien
aaaaattgagctgttttcttattgasgctcaaaaattctttatgtattct

SEQ ID NO: 100041 - DNA, 50 bp, homo sapien
aggctttgatgactgtttgaaacaayggactatggtggaaatgtcctctg

SEQ ID NO: 100042 - DNA, 50 bp, homo sapien
catcacattattatcacttacaattwttactaggtgcttcttctggtatg

SEQ ID NO: 100043 - DNA, 50 bp, homo sapien
aacaaattctggacttaaaattgacscttgagcgattagacctaacagat

SEQ ID NO: 100044 - DNA, 50 bp, homo sapien
ttttatgagaagtctctcatttcacrcactgtacctgcttctttcaagtt

SEQ ID NO: 100045 - DNA, 50 bp, homo sapien
tcaggagtaaaagagaacaaatgcaygtgagtatgaaatattattttgcc

SEQ ID NO: 100046 - DNA, 50 bp, homo sapien
ataaaatggtgttaaacaggaaccastaacataagcgcagccagttactt

SEQ ID NO: 100047 - DNA, 50 bp, homo sapien
tacggtgagcttccaagcaaatggcratgaacggctgtctttgcttttat

SEQ ID NO: 100048 - DNA, 50 bp, homo sapien
cggctgtctttgcttttattgaacaygaacagcttatcagaactaacagg

SEQ ID NO: 100049 - DNA, 50 bp, homo sapien
caaagcatgtacttctccttgtctcrctgatcttagataagccacgttaa

SEQ ID NO: 100050 - DNA, 50 bp, homo sapien
tgttagaagaacaagcttagatttcygcttcaggatgaaaatcctaactg

SEQ ID NO: 100051 - DNA, 50 bp, homo sapien
cccttgagagtaacaactaggagtcrcttttattcagctttgatttcttc

SEQ ID NO: 100052 - DNA, 50 bp, homo sapien
gtaccagaactccactcataaacaarggaagctaggatgtttggttcttc

SEQ ID NO: 100053 - DNA, 50 bp, homo sapien
aatcatttaaacttctaaatttcaarcaacttcattttagtgtatttatt

SEQ ID NO: 100054 - DNA, 50 bp, homo sapien
tcacaactgctatgagtatgggtaaytgagttttggtatcctcatttttt

SEQ ID NO: 100055 - DNA, 50 bp, homo sapien
atttaaaacttacaaaatcacaaaastcatattagaaaattcgaaagaaa

SEQ ID NO: 100056 - DNA, 50 bp, homo sapien
ttatctgggagctgatatatgtccayattaaaatgaaatcttcacaattt

SEQ ID NO: 100057 - DNA, 50 bp, homo sapien
ctccatatttcttctcttggaacttkttcttattagactctcagtgtcca

SEQ ID NO: 100058 - DNA, 50 bp, homo sapien
cctccctggatgctgtttatctccaracaaatgggattgatgacattatc

SEQ ID NO: 100059 - DNA, 50 bp, homo sapien
ttaagagctgaggagcctaacagtcrcttatttacgtactgatttaagcc

SEQ ID NO: 100060 - DNA, 50 bp, homo sapien
ttagaaaagattccgaactattggayctttagactcactgagcaatggac

SEQ ID NO: 100061 - DNA, 50 bp, homo sapien
gagaggtaagaaatgggagctctcargaaagataagaacatcagccgtct

SEQ ID NO: 100062 - DNA, 50 bp, homo sapien
atggacaaaaagcaaaaaactccgarctcattgcaaatgttcaataaatg

SEQ ID NO: 100063 - DNA, 50 bp, homo sapien
tctgcaaagttgttgtacctgtagamcttgcatctctgaggctgcagtga

SEQ ID NO: 100064 - DNA, 50 bp, homo sapien
atttttaccattttaagagactttcmcaatttgcatagacagaagttttt

SEQ ID NO: 100065 - DNA, 50 bp, homo sapien
tcaggtgaatggatccaaggtcccaygtattattggagatgaggccataa

SEQ ID NO: 100066 - DNA, 50 bp, homo sapien
gttagatgccatgctttaatgattasactgtactatagccagtgctgaag

SEQ ID NO: 100067 - DNA, 50 bp, homo sapien
gatgcagtatgaagataacacaaaakgtgagaggtaaggccaggcgcggt

SEQ ID NO: 100068 - DNA, 50 bp, homo sapien
ttattggagatgaggccataaatacrgtaacagtttgattactcagtttg

SEQ ID NO: 100069 - DNA, 50 bp, homo sapien
gtaagttacctggtagtgaagtgagrattcaatctcggaacagtctggct

SEQ ID NO: 100070 - DNA, 50 bp, homo sapien
tactgcatacagttattgcaaggagyaaatgaggaatatgtaaaatatct

SEQ ID NO: 100071 - DNA, 50 bp, homo sapien
aatgataagttgtgaatatttattarcttcatttctaacatgatttattt

SEQ ID NO: 100072 - DNA, 50 bp, homo sapien
aacaattgggtctatttaaacctcaygtagcttagctggtgactgtttca

SEQ ID NO: 100073 - DNA, 50 bp, homo sapien
tgtcctgatgcttagtctgcatcatraacccaaattcctccccagatcat

SEQ ID NO: 100074 - DNA, 50 bp, homo sapien
tagagttgctccattcatattggacygatggactgaaaacattgatgtga

SEQ ID NO: 100075 - DNA, 50 bp, homo sapien
aaaagaatgtgttacataggttgcaycacttgcagttaaataaaactcac

SEQ ID NO: 100076 - DNA, 50 bp, homo sapien
taaacccgaggactactttgcacacygaaatttgcaggaaaatgagaccc

SEQ ID NO: 100077 - DNA, 50 bp, homo sapien
acacagaggcttaataccttaccaarggtcacaaaattgtggcaccaaca

SEQ ID NO: 100078 - DNA, 50 bp, homo sapien
gcatatgtagctccatgtgggaggakatagcctggtcacagaaatctagt

SEQ ID NO: 100079 - DNA, 50 bp, homo sapien
agaaagaatatgtccttattttagaygaaccaattcttactcttagaaca

SEQ ID NO: 100080 - DNA, 50 bp, homo sapien
tcaaaaaatttgaggaaccccttccraacagtacacagttattaagttca

SEQ ID NO: 100081 - DNA, 50 bp, homo sapien
cctcttatgaaccttggtatcattaktttctgtgatcacaaaagctaaaa

SEQ ID NO: 100082 - DNA, 50 bp, homo sapien
acaatttgtatacgcttttacaataratggtctggattaaggtttctctc

SEQ ID NO: 100083 - DNA, 50 bp, homo sapien
agatttcttgagtaaaacctgaaaakcatatataatcaaagcaaaaatgg

SEQ ID NO: 100084 - DNA, 50 bp, homo sapien
caagatgttaaggagggaggtgatamgatatatttttgaataaatgtaaa

SEQ ID NO: 100085 - DNA, 50 bp, homo sapien
cttggtactagaatactttaaatacwctctaggcaattataatattcagc

SEQ ID NO: 100086 - DNA, 50 bp, homo sapien
ctatgctatttttcaaagattacaaytcctttataagtctttataatgta

SEQ ID NO: 100087 - DNA, 50 bp, homo sapien
gtgaccttactatgttataatggtasagaattagtaaataaacctagaag

SEQ ID NO: 100088 - DNA, 50 bp, homo sapien
atttttcattagtaatgcttagacartcctgcagtgagcccctaagagtt

SEQ ID NO: 100089 - DNA, 50 bp, homo sapien
gagcttcccactgatgctggatctgytttactagcacatttctgtagcta

SEQ ID NO: 100090 - DNA, 50 bp, homo sapien
ctggctaatgtgtattggcagggacsaaaataacatacagtgaatggatt

SEQ ID NO: 100091 - DNA, 50 bp, homo sapien
gaagcagagtgaccacaggtatctcrcagcaggcattgccacaaaagaat

SEQ ID NO: 100092 - DNA, 50 bp, homo sapien
aagtagaatgatttcataagtctcaygaaggcctgctttgtacaaattgg

SEQ ID NO: 100093 - DNA, 50 bp, homo sapien
gtacttttacaggaaaaaagccttcraagactggcgaacaaagatttcag

SEQ ID NO: 100094 - DNA, 50 bp, homo sapien
taatttcttttaattgatataaacaktagttgattattctttttatctat

SEQ ID NO: 100095 - DNA, 50 bp, homo sapien
tacataggttatctcttcaattcaaygccaatataacattatgtatagag

SEQ ID NO: 100096 - DNA, 50 bp, homo sapien
gtgactgattgtggttatttgaaaaygaaatgaaagcatttacttattta

SEQ ID NO: 100097 - DNA, 50 bp, homo sapien
gaaacaatactttaccagccatttasgtatctttcgatccaatcgagttg

SEQ ID NO: 100098 - DNA, 50 bp, homo sapien
agagaaagcaagacatctggcatccygaagggctctggaggaacaacata

SEQ ID NO: 100099 - DNA, 50 bp, homo sapien
ttctcgctgtccttaagaatgttacyagagtcttagcataggcaacaaaa

SEQ ID NO: 100100 - DNA, 50 bp, homo sapien
attttccaaataccatctgcaaaaastggacttgttaaatttccatgaga

SEQ ID NO: 100101 - DNA, 50 bp, homo sapien
gccatagtgtctgcctacattgatcrgataatatggataactcatctcat

SEQ ID NO: 100102 - DNA, 50 bp, homo sapien
taaaacaaactcaacactctttaaayatgatccaaactcttaacaatgaa

SEQ ID NO: 100103 - DNA, 50 bp, homo sapien
aatgggtctactcactttcagtgaaygccatcgtgccattttattcttac

SEQ ID NO: 100104 - DNA, 50 bp, homo sapien
aaagtcttatgcaaggaactttatayatctttgaatggaagcaagagtat

SEQ ID NO: 100105 - DNA, 50 bp, homo sapien
aaaaaagcttggaagaatacgtaacraaaacatagtggaactggggtcag

SEQ ID NO: 100106 - DNA, 50 bp, homo sapien
caacttccctgaagaggtgtactagratgcttaccttaaaaaacaattgt

SEQ ID NO: 100107 - DNA, 50 bp, homo sapien
gcaattctttgtcaggctcctttcaraaccattacctttcccagtggcta

SEQ ID NO: 100108 - DNA, 50 bp, homo sapien
gcagataccaaatggatggtttacaytctcttctcctgattatacatttg

SEQ ID NO: 100109 - DNA, 50 bp, homo sapien
gtaaagtaatactttctcagaaatartgttttccaataattcacagcaga

SEQ ID NO: 100110 - DNA, 50 bp, homo sapien
gtggcctgcaatatcctaaattttgyctacctccagtttaactttcaatt

SEQ ID NO: 100111 - DNA, 50 bp, homo sapien
agcatatatccagaaaattacacaayccatacctgaacatttcaatggat

SEQ ID NO: 100112 - DNA, 50 bp, homo sapien
tttaaataaaggctcccatcacctaycaaaattagagaagcaattcacaa

SEQ ID NO: 100113 - DNA, 50 bp, homo sapien
tttgtatctggcttctctgttcagcrtgaagtttttggaatttatccatg

SEQ ID NO: 100114 - DNA, 50 bp, homo sapien
cttcccaatctaggatttagatttcyataagctgtaaaaattgttcccca

SEQ ID NO: 100115 - DNA, 50 bp, homo sapien
taatatgaagcaattgctatatgtaygatggcatgtagtataaggaggat

SEQ ID NO: 100116 - DNA, 50 bp, homo sapien
gcttagcagaaatcctagtgcctaayagagtacttgtaggcctgccaaaa

SEQ ID NO: 100117 - DNA, 50 bp, homo sapien
gggtgagaatgtactaatacgttaakaatttaaaggcaacagtcagtact

SEQ ID NO: 100118 - DNA, 50 bp, homo sapien
atagagtagaggtataaattatatgmcataggagaattaattagctgatt

SEQ ID NO: 100119 - DNA, 50 bp, homo sapien
aacctaagaataagatcatcttttasaagagggctaagccttttaatgtg

SEQ ID NO: 100120 - DNA, 50 bp, homo sapien
ggtaaaagaagcatgtgaatgagaayttccaaattaaccaaacacattct

SEQ ID NO: 100121 - DNA, 50 bp, homo sapien
ctaggaagtagatacttaggttgaaragaacgattgtaggtcacattctg

SEQ ID NO: 100122 - DNA, 50 bp, homo sapien
gtaaaatacaaagaatatgctataartaagtgcaaaagggccaaataaca

SEQ ID NO: 100123 - DNA, 50 bp, homo sapien
gaaagaaagaaaagaagacagagaasttaagatgttagagaaagaagcag

SEQ ID NO: 100124 - DNA, 50 bp, homo sapien
attttgaagccctgaatgtggtccamgaaaagaaggatgttttaagcaca

SEQ ID NO: 100125 - DNA, 50 bp, homo sapien
caatattgaacagtcagagaaaagamgagtaaccagcaaaggaggtctat

SEQ ID NO: 100126 - DNA, 50 bp, homo sapien
acgtttgagcaatccaaggaggtccracatccaaataaaatagcagttca

SEQ ID NO: 100127 - DNA, 50 bp, homo sapien
gtttaaaaggtaagtttgatatatargtcaagagatcaaaggggagatct

SEQ ID NO: 100128 - DNA, 50 bp, homo sapien
tataactgatgctcaggtttctatcrcaatacacgtatttacaagcactc

SEQ ID NO: 100129 - DNA, 50 bp, homo sapien
acaattaagtgttgttagtgtagcamcttcttttaataaaacactttctt

SEQ ID NO: 100130 - DNA, 50 bp, homo sapien
ttgtttgatgttaaaagtctcttcaratgataaatatgaaagccaatttg

SEQ ID NO: 100131 - DNA, 50 bp, homo sapien
gcctaagaacatcaaatggtaaatcyaagcatattaattacatcattaaa

SEQ ID NO: 100132 - DNA, 50 bp, homo sapien
ttaaaattattgtatcgtatccttakgacagtatatacaaagtcttgaat

SEQ ID NO: 100133 - DNA, 50 bp, homo sapien
agaattggctttatttctgaactcaygtttgctggaatcagagaaaaatg

SEQ ID NO: 100134 - DNA, 50 bp, homo sapien
atatgtttgccaaatgaacgaagaartaaaaaccactagtgacccaattt

SEQ ID NO: 100135 - DNA, 50 bp, homo sapien
tttagaatatgatcaatatccaccayaaatgaagatgagatattaaaaga

SEQ ID NO: 100136 - DNA, 50 bp, homo sapien
gaataattcagaaattgtgattagawggatttattattaatgaagagagt

SEQ ID NO: 100137 - DNA, 50 bp, homo sapien
ggggtattccctatgtatttgggtgyactctctcattttggaaatatcaa

SEQ ID NO: 100138 - DNA, 50 bp, homo sapien
ataaaaggaggttctgtccaggaaartaagtcccaataaactaaggcata

SEQ ID NO: 100139 - DNA, 50 bp, homo sapien
aacataaataactttgctgaatactwaaatggcactttataatgtctata

SEQ ID NO: 100140 - DNA, 50 bp, homo sapien
cttagcagagtagcaaaggtttagartccacatcattttgctttagtgtt

SEQ ID NO: 100141 - DNA, 50 bp, homo sapien
cgtgatattggaatcagtagatgagratttaaaagttaactatggttcat

SEQ ID NO: 100142 - DNA, 50 bp, homo sapien
cctttagggaaagagctacacataarcacatgctcgagcttctataaaca

SEQ ID NO: 100143 - DNA, 50 bp, homo sapien
gaaagttactgaatacttattctgakcttgtacatatcatatgctctagc

SEQ ID NO: 100144 - DNA, 50 bp, homo sapien
ttgttatcagcttaaagtagcctatyacaactatagatgttttatgtaat

SEQ ID NO: 100145 - DNA, 50 bp, homo sapien
tgaccggagagcgtaagtttatttcmcattgaagggcatgaatctattag

SEQ ID NO: 100146 - DNA, 50 bp, homo sapien
acaagttcaatgtccaaaatcatacrgcatattaaggagagctcagacct

SEQ ID NO: 100147 - DNA, 50 bp, homo sapien
ttaaaacgatgagaatgtagccacckattacatttcacactaaagtctaa

SEQ ID NO: 100148 - DNA, 50 bp, homo sapien
cactgcctggctctgtgatcctgagmaaatcatttaattcatgtaagcct

SEQ ID NO: 100149 - DNA, 50 bp, homo sapien
ctactaacttatatttatatcatgckgaccatttacaaagaactttcata

SEQ ID NO: 100150 - DNA, 50 bp, homo sapien
ttttcatctctgactctaagataacmgactaactgtaatgtatccatcta

SEQ ID NO: 100151 - DNA, 50 bp, homo sapien
aatgtatcaaaatgccatttcttagrccttacctctaaatattctatttt

SEQ ID NO: 100152 - DNA, 50 bp, homo sapien
agaatctaattcaatgtggttacagraggctaagcaaatataaggaagga

SEQ ID NO: 100153 - DNA, 50 bp, homo sapien
atgtaaatgcatttgaagctataagrctatgtaaacagaaaattactgtg

SEQ ID NO: 100154 - DNA, 50 bp, homo sapien
tgttcctctagctggaattctctaaytataccacttgaagcatggttggt

SEQ ID NO: 100155 - DNA, 50 bp, homo sapien
gctgaaatagccaccataagcctatsacagaccccggatcctgaagagtg

SEQ ID NO: 100156 - DNA, 50 bp, homo sapien
agtgccacatgtacattaatctaaakggaacattcctcagtgattattta

SEQ ID NO: 100157 - DNA, 50 bp, homo sapien
aaaatagagaaaagtttgtgaagaaygttgtttgtaagaaaaaatagaaa

SEQ ID NO: 100158 - DNA, 50 bp, homo sapien
gaccttctgctgagacaggtaacaawgaaataaaatagagaaaagtttgt

SEQ ID NO: 100159 - DNA, 50 bp, homo sapien
agagtggggtcagttatttgaaagaygtgggtatttacaatgctaaggac

SEQ ID NO: 100160 - DNA, 50 bp, homo sapien
tttgaaaagtatatgataccttttgmaacttggtaatgtactgtggtaca

SEQ ID NO: 100161 - DNA, 50 bp, homo sapien
taacaagaaactgtacgtcaagaccrattcatgtgaggaggtattcactt

SEQ ID NO: 100162 - DNA, 50 bp, homo sapien
aatctgaaggaatgactctgtaagayggttcaagtaaacaaggagtcttg

SEQ ID NO: 100163 - DNA, 50 bp, homo sapien
gggcatgtgggagaaggttgggtacyattatgaggaacatcacagttctg

SEQ ID NO: 100164 - DNA, 50 bp, homo sapien
atccactgacacacctttggcaatartacccagatattctctacaattgc

SEQ ID NO: 100165 - DNA, 50 bp, homo sapien
aagcagggggcagagtgatgcaatcrttgaccttgaaaatagaaggaggc

SEQ ID NO: 100166 - DNA, 50 bp, homo sapien
atcatatacatatattatctattaaytgtgtcttacagagattgtctttc

SEQ ID NO: 100167 - DNA, 50 bp, homo sapien
gtcctacacttttaagcatgctgtaygattcatttgaaggattccttcat

SEQ ID NO: 100168 - DNA, 50 bp, homo sapien
ctattagtaacaggtgatatttgtgmagtagacgatggagaaagacaatc

SEQ ID NO: 100169 - DNA, 50 bp, homo sapien
gtggggttcaaaagaacttgtacatsaagtagatctgagtggagatggcc

SEQ ID NO: 100170 - DNA, 50 bp, homo sapien
agagctatttttttcactgttaaacyataattgaatagtcagtgttgact

SEQ ID NO: 100171 - DNA, 50 bp, homo sapien
ttcccaagaggttttgcaagttggaragagtttataggtctgagaaagaa

SEQ ID NO: 100172 - DNA, 50 bp, homo sapien
cttagtattcttccaagttaatcggyatagatgacccttgacaatttttt

SEQ ID NO: 100173 - DNA, 50 bp, homo sapien
gtgagaaattataattgacttagtayataaaatgtgtgtttatttgttca

SEQ ID NO: 100174 - DNA, 50 bp, homo sapien
tgtccaggaagatggtaacctcacastactcgaccaatgaggaactgagg

SEQ ID NO: 100175 - DNA, 50 bp, homo sapien
ggaaaccttctggtacacaaagaagscatatggaatagaaataccagaag

SEQ ID NO: 100176 - DNA, 50 bp, homo sapien
tggttggggttgctgaagggagttgrcaaagtacataagaaaaatgggag

SEQ ID NO: 100177 - DNA, 50 bp, homo sapien
agcctaattttccatgcaaacgacaygaaacagagagtggagcgggaggc

SEQ ID NO: 100178 - DNA, 50 bp, homo sapien
gggttcaacccaaatccatcaatgcmatgtctccaaagctgcaatcatcc

SEQ ID NO: 100179 - DNA, 50 bp, homo sapien
cctcaactttgattctagtgaaacaygacattgcaaaaataatgtatttc

SEQ ID NO: 100180 - DNA, 50 bp, homo sapien
tgggtcttcttgttgctctattctargatattgcattgggaatcagtgct

SEQ ID NO: 100181 - DNA, 50 bp, homo sapien
ccattcatgaaagctgattactacawcaagttatacaaaacttacttggt

SEQ ID NO: 100182 - DNA, 50 bp, homo sapien
ccttaaaaaccattcagtttattccrcccatatataatgaacaccattat

SEQ ID NO: 100183 - DNA, 50 bp, homo sapien
ccctaataaatatcatgtggaacagkgaaagatattttcaaatatttggg

SEQ ID NO: 100184 - DNA, 50 bp, homo sapien
aaaaacacctgacctgctcagttcayctagggtttgtttacacctagtac

SEQ ID NO: 100185 - DNA, 50 bp, homo sapien
ttgctctgtcacagtttgtattaaarcttgcctaatgtctagaaatgaat

SEQ ID NO: 100186 - DNA, 50 bp, homo sapien
tctaagcacatgtgagccatcttttygcccctgctaatggagacccaggt

SEQ ID NO: 100187 - DNA, 50 bp, homo sapien
ttattgattagtctatttctccttgyaggtgtgtaattctagactaatta

SEQ ID NO: 100188 - DNA, 50 bp, homo sapien
taatcaaggaggcatggttacaggaraatcacagagatgtcagtagtaag

SEQ ID NO: 100189 - DNA, 50 bp, homo sapien
aaaatgtactatattcagtggacatwagaagtatacaaaaagaaaaatta

SEQ ID NO: 100190 - DNA, 50 bp, homo sapien
gcagtttttctgattttgtatctacyggcaaaatatatcttaagccattt

SEQ ID NO: 100191 - DNA, 50 bp, homo sapien
gtgccagagaatgtgatgtggcagcraagtacatggaaaggtggggcggg

SEQ ID NO: 100192 - DNA, 50 bp, homo sapien
ggccccgggaggcccagtgatggaaygttaaaaccatgaacgggcttttc

SEQ ID NO: 100193 - DNA, 50 bp, homo sapien
attgcagtcttaatgctatgcaacayaagaaaaaggaccaaggggatttt

SEQ ID NO: 100194 - DNA, 50 bp, homo sapien
ctccataagaaaacatcattcaaaargatttactttgggctccagtgaat

SEQ ID NO: 100195 - DNA, 50 bp, homo sapien
cctcaacttgttgctgcaccagaccratctgtttcttcttcttcttcttc

SEQ ID NO: 100196 - DNA, 50 bp, homo sapien
gcaaaaattctcaacaaaatgctacraaacttaatccaacaacacaacaa

SEQ ID NO: 100197 - DNA, 50 bp, homo sapien
tcatcatctctttttaagatacccartcaacttttgccttcactcttccc

SEQ ID NO: 100198 - DNA, 50 bp, homo sapien
tttttaaaaattaaggtgctaagtamaatgtatgcccacattttcatttc

SEQ ID NO: 100199 - DNA, 50 bp, homo sapien
tctcagtacagaggagggctaaaagmaaatgactcatgagcatgatccac

SEQ ID NO: 100200 - DNA, 50 bp, homo sapien
atgaaagatcatcagcttgtaacaaygtctgaaaatcatttttatttaag

SEQ ID NO: 100201 - DNA, 50 bp, homo sapien
tgcttaatttgaagaaaaagtagaamattgtaggaagaaatcctcctgag

SEQ ID NO: 100202 - DNA, 50 bp, homo sapien
tgtggagggaaaaaaaggcaaatcartgattccagtgtgaatgtgtttct

SEQ ID NO: 100203 - DNA, 50 bp, homo sapien
tttaaaatatatgattattgaactgyagtatatatgtctattccttactt

SEQ ID NO: 100204 - DNA, 50 bp, homo sapien
ctcataaactaaaattgattatacaytgacagttaatcggtgtaccattg

SEQ ID NO: 100205 - DNA, 50 bp, homo sapien
ttttctcctattatttttatgtcacrgaagccaatttctattttatctta

SEQ ID NO: 100206 - DNA, 50 bp, homo sapien
gctatctcactggtggctacatccaraattggaatacaatatgagagaac

SEQ ID NO: 100207 - DNA, 50 bp, homo sapien
gagtatagtgtcactagatgcaaaaygataagatataaatgacttggaac

SEQ ID NO: 100208 - DNA, 50 bp, homo sapien
ccaagtttccttcagtgaaaatgcaygtattttgtaatcatggagaaaaa

SEQ ID NO: 100209 - DNA, 50 bp, homo sapien
ctgatctttttctctctgaattgctsacaatagaacaaaagacataaaga

SEQ ID NO: 100210 - DNA, 50 bp, homo sapien
aaagatcaaagctctgaaatttctgraactatatgaagacatttaaattt

SEQ ID NO: 100211 - DNA, 50 bp, homo sapien
taagtaatcaagccaagtataaaaastccagtatttagatgagccatcta

SEQ ID NO: 100212 - DNA, 50 bp, homo sapien
gccaaatgtgtgggtggttgtagaaytgctgaaacaagtggtagtcaaag

SEQ ID NO: 100213 - DNA, 50 bp, homo sapien
gttacagaaaaattccagtaatctarcatataagtaccttcatagtctag

SEQ ID NO: 100214 - DNA, 50 bp, homo sapien
tgcatgcatgaactaatctgtaaaayaaagttggtagaccattggtcatt

SEQ ID NO: 100215 - DNA, 50 bp, homo sapien
ttatgtcacaattcagtttgcaaaascttcaatcatctaactgtctcatg

SEQ ID NO: 100216 - DNA, 50 bp, homo sapien
taaagatgagaactctttactggaayaaattagcacataaactagaagat

SEQ ID NO: 100217 - DNA, 50 bp, homo sapien
tgggtgcctgattgaagaacaaagarcttgatattccccgcagttagggt

SEQ ID NO: 100218 - DNA, 50 bp, homo sapien
ccatgctgtgtttcataaatggaaaygtcacatccaagaaagtgagacca

SEQ ID NO: 100219 - DNA, 50 bp, homo sapien
acgcacttgctcagtaagaactttgyaacattattggcagtaaaattctg

SEQ ID NO: 100220 - DNA, 50 bp, homo sapien
gactcaaatgccattgaaacgtgaaycgatagataaattatggtgtatcc

SEQ ID NO: 100221 - DNA, 50 bp, homo sapien
aaatctggggtggcacaaagcaattyaaaacgagcagaaaataatgtgag

SEQ ID NO: 100222 - DNA, 50 bp, homo sapien
caaaatcagagaggttgtcacgttayagttgtatgcttgcataactgaat

SEQ ID NO: 100223 - DNA, 50 bp, homo sapien
tggagattcagagttgaggtagagaytagagagaacagggatgcaataaa

SEQ ID NO: 100224 - DNA, 50 bp, homo sapien
ttgcccagtctttatttcacctttaycatttgaacttttgtatttggaga

SEQ ID NO: 100225 - DNA, 50 bp, homo sapien
ggggtatacattcactccagataaasctattgataataattaggccaaga

SEQ ID NO: 100226 - DNA, 50 bp, homo sapien
gtttaagggttgtgtacatatgtcamtatttatcaaattgtaccttttaa

SEQ ID NO: 100227 - DNA, 50 bp, homo sapien
gaatccaaatcttcaagtttagtgcraggccctggctagttgaagggttc

SEQ ID NO: 100228 - DNA, 50 bp, homo sapien
attaggaatatcccagtccctacaaygctgatggcttcaacttaccaccc

SEQ ID NO: 100229 - DNA, 50 bp, homo sapien
aggttagcctttctactgacataggsatatatattagccaggtcaagctg

SEQ ID NO: 100230 - DNA, 50 bp, homo sapien
tgttccatcattagcaatcagtacarctctaaaaaggaatggtatatcaa

SEQ ID NO: 100231 - DNA, 50 bp, homo sapien
gaaaagagtaacagtaaaaatcatayagcaattgaaataacaaagaaact

SEQ ID NO: 100232 - DNA, 50 bp, homo sapien
actgtacactcaagttcattgctcaygctcaagttcattggaaggatgga

SEQ ID NO: 100233 - DNA, 50 bp, homo sapien
gattctgctgtgaaccatgaggaacsgaattgcaggtggatctcagttgc

SEQ ID NO: 100234 - DNA, 50 bp, homo sapien
atgctccgtgtgtgtgtagacagaaraaaagaggcactacatagagtggt

SEQ ID NO: 100235 - DNA, 50 bp, homo sapien
agacaatatgtcaaatggcatccagyagtcgcaatctcgtcactaagtca

SEQ ID NO: 100236 - DNA, 50 bp, homo sapien
ccattatgctgtagctccatttgagyagggaccttgtctgttcactactg

SEQ ID NO: 100237 - DNA, 50 bp, homo sapien
tcttgttttagaaggctcttgggtamaataaactctgaattttggtcttt

SEQ ID NO: 100238 - DNA, 50 bp, homo sapien
aagagaaatgaagaaatggagatgasataactaactgcaaacattcctaa

SEQ ID NO: 100239 - DNA, 50 bp, homo sapien
aaagaaggccctcaaaagcaggaaaktctattagctaaatgatgatgggc

SEQ ID NO: 100240 - DNA, 50 bp, homo sapien
acaactgaacctacaacaggtctgawgatacaactgcaaattgattcaat

SEQ ID NO: 100241 - DNA, 50 bp, homo sapien
aaaaggaattcaattaaataggaacratgattgatttctgcaagctcctt

SEQ ID NO: 100242 - DNA, 50 bp, homo sapien
ataattttttttcaaaacagctacakgtattttctttatatctttgatag

SEQ ID NO: 100243 - DNA, 50 bp, homo sapien
tgaaagttgactgagttctgagagaygaaatgactttaagttgctgattt

SEQ ID NO: 100244 - DNA, 50 bp, homo sapien
cttcccccagagtctggtacaaaackggatcccatagtgtccacatagca

SEQ ID NO: 100245 - DNA, 50 bp, homo sapien
taagtttatctcctaatccgtaaaaygaagatgatatataatgcacagga

SEQ ID NO: 100246 - DNA, 50 bp, homo sapien
gcacaggatttgtaaaagactgaaaygaaacaacatacatgattgcattg

SEQ ID NO: 100247 - DNA, 50 bp, homo sapien
cacatttctgcttaactttctgcagyagagacaagagatttgatgtctgg

SEQ ID NO: 100248 - DNA, 50 bp, homo sapien
gcagaaccttatcttttaaagctackactttgttcttcttgctctgtctg

SEQ ID NO: 100249 - DNA, 50 bp, homo sapien
gcgcttgttcatttgtgtatcatttwaaaatatttgattagtctttcata

SEQ ID NO: 100250 - DNA, 50 bp, homo sapien
ttatacttcttcatcctcctttgacsttctatttgggccgattcctttcg

SEQ ID NO: 100251 - DNA, 50 bp, homo sapien
atcctggacaaaccaactctgcaaaygcaaaaggaaactggttttttcac

SEQ ID NO: 100252 - DNA, 50 bp, homo sapien
tattttaggaagtttctttgtcacaygaagagagctgtgaagaccaagag

SEQ ID NO: 100253 - DNA, 50 bp, homo sapien
agcccaacagccagaagaatctggaygaagaaaagagcatcagagaagca

SEQ ID NO: 100254 - DNA, 50 bp, homo sapien
tccctcccctcttttttcctgaacaytagagcagttcattcttaaatgac

SEQ ID NO: 100255 - DNA, 50 bp, homo sapien
agtttgtcagtataaaaacaactgaragtctaagattgggttataacatt

SEQ ID NO: 100256 - DNA, 50 bp, homo sapien
ggaagcatgtatgttgataaaatagraactcatgtcccttgaaaactgat

SEQ ID NO: 100257 - DNA, 50 bp, homo sapien
caagaaactttctataaaacaggacwattaaaaatcaatttctacttaga

SEQ ID NO: 100258 - DNA, 50 bp, homo sapien
acaaacagaagcttatgtttagagakattgatgacttaacagtacaattg

SEQ ID NO: 100259 - DNA, 50 bp, homo sapien
atgacttgctgagaccaggactagasgcggaagatcaagcttacagcata

SEQ ID NO: 100260 - DNA, 50 bp, homo sapien
cttttaggtaactctcccaactcaaratcgatagttctctgaagaattga

SEQ ID NO: 100261 - DNA, 50 bp, homo sapien
ggaagagcctaaaggtaacatgtggycaggaagctcctaccagaactcta

SEQ ID NO: 100262 - DNA, 50 bp, homo sapien
tcctggggagagggtggaagaatgaragaacgactgcaactgccctgggc

SEQ ID NO: 100263 - DNA, 50 bp, homo sapien
ctttctcattctgctttccctgattmtttacaagtttctcctgggaaaac

SEQ ID NO: 100264 - DNA, 50 bp, homo sapien
caaaacatcacatcacacaccttaawtctatgcaattttaataaaacata

SEQ ID NO: 100265 - DNA, 50 bp, homo sapien
aaaatgaaatggatattttgtcttaytaaactatgcttttgtggttagtt

SEQ ID NO: 100266 - DNA, 50 bp, homo sapien
gtaatgtcagtgtctcctttgctaastacctcactgcgtagtaggctttt

SEQ ID NO: 100267 - DNA, 50 bp, homo sapien
aaacaaatgtgacaccaataataaasaacacgtgagattatggaagaaaa

SEQ ID NO: 100268 - DNA, 50 bp, homo sapien
cagagggtagttagatatttgttacrgccaaatttttgttgaaaagacat

SEQ ID NO: 100269 - DNA, 50 bp, homo sapien
tcacagcagttaccatactctattayactctctttactttcttatgtcct

SEQ ID NO: 100270 - DNA, 50 bp, homo sapien
agaataaaagccagagtctttaaaayggccttatgaagctcggcctaaac

SEQ ID NO: 100271 - DNA, 50 bp, homo sapien
agcagagaaaaggggtaaagaaacaytgggcacgatttagggtgggcact

SEQ ID NO: 100272 - DNA, 50 bp, homo sapien
atataaaacaaattggaccttataastaatcatttcttctcatttcaata

SEQ ID NO: 100273 - DNA, 50 bp, homo sapien
atgagcctttgtctgttctagttaartcaattagtgctgagctaatgaaa

SEQ ID NO: 100274 - DNA, 50 bp, homo sapien
atcaagtccagcaaagctgctagacrctttctggaaggaaatatggccag

SEQ ID NO: 100275 - DNA, 50 bp, homo sapien
taaataggacaagaaacataattagsagagtttgagacaagaatgagtta

SEQ ID NO: 100276 - DNA, 50 bp, homo sapien
ctatgacatcatcaacaatgtataayagcttaacataaaatgatctctag

SEQ ID NO: 100277 - DNA, 50 bp, homo sapien
tgctattaagttttattatttttaarcatctgtgatcaatcaaataggta

SEQ ID NO: 100278 - DNA, 50 bp, homo sapien
tgtatgattcaatgcactcgcaaagraaaattttattttaggggaaactt

SEQ ID NO: 100279 - DNA, 50 bp, homo sapien
aggggacgatggcatgactggaataygctgaattcattccctccctcctt

SEQ ID NO: 100280 - DNA, 50 bp, homo sapien
ctagtaagcctcatcatattgtctaygctacccaaatgcagccgcatcct

SEQ ID NO: 100281 - DNA, 50 bp, homo sapien
aaaacacaacttgaaaatcataaacmagaaagcaaaaaagagatgatttg

SEQ ID NO: 100282 - DNA, 50 bp, homo sapien
aaaagatttcattgttcctaacatcraaaagctaaagttagtagaaattc

SEQ ID NO: 100283 - DNA, 50 bp, homo sapien
ccagccaaaaacctgacatttctaayaaaggcttcttaaaaactagaatc

SEQ ID NO: 100284 - DNA, 50 bp, homo sapien
gtggcctctgaaatcatgtagaagcyaatacaaaagggtgtggacacaga

SEQ ID NO: 100285 - DNA, 50 bp, homo sapien
gggtttacagaaagaggccaaacaaygcactgtgagcatgccagctgcgt

SEQ ID NO: 100286 - DNA, 50 bp, homo sapien
ggggtaagggttttggtgagagctcyatggacctatgacacaaattgctc

SEQ ID NO: 100287 - DNA, 50 bp, homo sapien
cctactgataacagtcattagttaaytgaagtaattgtttagtgtaatat

SEQ ID NO: 100288 - DNA, 50 bp, homo sapien
cgaagggattgaagtaattaccaaamtctagggttcataagaattgcctg

SEQ ID NO: 100289 - DNA, 50 bp, homo sapien
actttttaggccctcaactaataaaractaagctgcagaaatgacaactg

SEQ ID NO: 100290 - DNA, 50 bp, homo sapien
gggcatttcatatgtaatgtaaatgycaattctttttgagacggagtttc

SEQ ID NO: 100291 - DNA, 50 bp, homo sapien
cctctagctgatggccttgagacaaycttataattcaaaggccacagctg

SEQ ID NO: 100292 - DNA, 50 bp, homo sapien
agtaacatctaataatattacgaacrccttctaactgttcttcctgtcct

SEQ ID NO: 100293 - DNA, 50 bp, homo sapien
ttagtctggagcttcaacttacatcraattgccaagtgacagagggcaca

SEQ ID NO: 100294 - DNA, 50 bp, homo sapien
gtatggaaattagctctgattaatcwcataactcttcagaatactttcat

SEQ ID NO: 100295 - DNA, 50 bp, homo sapien
tggcatcgctgggtcacagaatgacwccgtgcttaactttttgaggaatt

SEQ ID NO: 100296 - DNA, 50 bp, homo sapien
gaaaggataggactatgaatagtagratactttccacccaaattaacagt

SEQ ID NO: 100297 - DNA, 50 bp, homo sapien
agaccatgttcacaagcctactcttraaacatcctagttcagaatcaatg

SEQ ID NO: 100298 - DNA, 50 bp, homo sapien
tccaatccctagtctctgacctcacmatctggaacctgagccaaaatagc

SEQ ID NO: 100299 - DNA, 50 bp, homo sapien
tcaaagctctgcttcatgctcttcayaaaatttaggcactaatccatcct

SEQ ID NO: 100300 - DNA, 50 bp, homo sapien
ctagagatggactccatcagttccaraaaggttcccacagaagcctccca

SEQ ID NO: 100301 - DNA, 50 bp, homo sapien
acaagcagtagataaaaatcacacamgtataactggaaaatgtagttaga

SEQ ID NO: 100302 - DNA, 50 bp, homo sapien
acatctatgccccttgcaagaaagarcgcttccagaaagaaaagcttcca

SEQ ID NO: 100303 - DNA, 50 bp, homo sapien
gcactgtaaaaggctcaattactaaraaattaagtgacactttagtttca

SEQ ID NO: 100304 - DNA, 50 bp, homo sapien
cttatcagctctgacatactcccgaytcatttatttttcttattcgccac

SEQ ID NO: 100305 - DNA, 50 bp, homo sapien
ttcagattgctctttgctttgtttaygagttcagttcaacccccttattc

SEQ ID NO: 100306 - DNA, 50 bp, homo sapien
ctcttgatggtcactgctatatggayggagattttctctttggaccattt

SEQ ID NO: 100307 - DNA, 50 bp, homo sapien
attcttcttggttagggaatagtcaycagtaaaatggaaatgttctttgg

SEQ ID NO: 100308 - DNA, 50 bp, homo sapien
ctgtttccagtcaccattattaaaawctctcttggctaggcatagtggct

SEQ ID NO: 100309 - DNA, 50 bp, homo sapien
ggattaccattaacttgactattaawtatgcatgaggtagggaaccagtc

SEQ ID NO: 100310 - DNA, 50 bp, homo sapien
gctgcagcgtgtgctgatggctgtcsaagtggttacggggtcaagcatga

SEQ ID NO: 100311 - DNA, 50 bp, homo sapien
gtaccctgcactttaggaacttagastctagttagggaatatgggaacac

SEQ ID NO: 100312 - DNA, 50 bp, homo sapien
catgtaggggctgctttccctgcacratccaggtccttggttgggcttac

SEQ ID NO: 100313 - DNA, 50 bp, homo sapien
catccaaatgctgacatggcaaggayatcttggtcatcaagtctaacccc

SEQ ID NO: 100314 - DNA, 50 bp, homo sapien
tgtacatatccatactttcgtatcartatcttcaatggttatcatgtacc

SEQ ID NO: 100315 - DNA, 50 bp, homo sapien
ccagatttgtcctaagtctctccctrtgtgtcagcctccatgctgcagga

SEQ ID NO: 100316 - DNA, 50 bp, homo sapien
ttgttttatgccaagcactttgttaygtgttgaggataagccgcttggtt

SEQ ID NO: 100317 - DNA, 50 bp, homo sapien
gcaagcctttcatgtttggtcaaccsaggactaggaccagctactaagtc

SEQ ID NO: 100318 - DNA, 50 bp, homo sapien
ggactttatcccaggtgtagcaccaytgagaggttttcaacagggaaatg

SEQ ID NO: 100319 - DNA, 50 bp, homo sapien
atgacatgctttctagtaactctctraagtctctggagaaccaaacatcc

SEQ ID NO: 100320 - DNA, 50 bp, homo sapien
ctgtcgggaagaagttttctttctaygtaacatcgcctaaatgtaaaaaa

SEQ ID NO: 100321 - DNA, 50 bp, homo sapien
tactgcagagaggaccgaagtggaaygcttgtagaggactagtttatcga

SEQ ID NO: 100322 - DNA, 50 bp, homo sapien
attgctcccaactgataccaacaccyaatattatatctttttttttctaa

SEQ ID NO: 100323 - DNA, 50 bp, homo sapien
tggtcattagtgttaggaattgtacycagaagtgtatacaagaataagtt

SEQ ID NO: 100324 - DNA, 50 bp, homo sapien
aaatattttattcgattcttaaagasagatttgaatttctctcactatat

SEQ ID NO: 100325 - DNA, 50 bp, homo sapien
agtcatatcttataaacagaatccargactccttccaagtgaaatgactg

SEQ ID NO: 100326 - DNA, 50 bp, homo sapien
gaaaagtgagtcagtaaagatgttaygattttgtgaaagatatcagttca

SEQ ID NO: 100327 - DNA, 50 bp, homo sapien
tgatgacctaaaacataatactatarataaggcaattgtgtactgtgaat

SEQ ID NO: 100328 - DNA, 50 bp, homo sapien
aggcagatttcagccgaacataaatractgacaggagctcttcatggtcc

SEQ ID NO: 100329 - DNA, 50 bp, homo sapien
aagactgagggtgcaaaacaaatgcrgagccgagcagacatttctcagcc

SEQ ID NO: 100330 - DNA, 50 bp, homo sapien
tgggccgaaatctgcctcaaagacartaattaacatcatcaatgatgttc

SEQ ID NO: 100331 - DNA, 50 bp, homo sapien
atagcaccatggttcaaaaaagctamcttgatcagtaagtggtagaggcc

SEQ ID NO: 100332 - DNA, 50 bp, homo sapien
ctaacatagcttgaaaactctcctakgctctcttctgcaagattttggtc

SEQ ID NO: 100333 - DNA, 50 bp, homo sapien
tttaaatgaaataatgcattgcaaaygtgcatccagttacttgaaacaaa

SEQ ID NO: 100334 - DNA, 50 bp, homo sapien
tctagaactcagctgtcgtgagagasaagtgtaagcctgtgggtaggagc

SEQ ID NO: 100335 - DNA, 50 bp, homo sapien
cacatgcattaggtatttgtgctaaygatctctgtctccttgtccccacc

SEQ ID NO: 100336 - DNA, 50 bp, homo sapien
tccctagtaccttagcacagttgtaygcacaattagattttaaatggatt

SEQ ID NO: 100337 - DNA, 50 bp, homo sapien
cactctccctttgccactgcactagyaaacgtttgtgaaaagaatctgca

SEQ ID NO: 100338 - DNA, 50 bp, homo sapien
ggtgctgccagcagttctctctgggwaggattgtggtataattctttcca

SEQ ID NO: 100339 - DNA, 50 bp, homo sapien
ttcggtcccatttctttcctatcaawttgtgttacaacatttctaagact

SEQ ID NO: 100340 - DNA, 50 bp, homo sapien
gggactataggcacctgctactgtayctggctaaaatgttttttaagctg

SEQ ID NO: 100341 - DNA, 50 bp, homo sapien
tcagtgatggaatctctgaatttaaygaacagtccccttctctttgtttt

SEQ ID NO: 100342 - DNA, 50 bp, homo sapien
atttgcaaagttgcactacataccayggacccgttactagcaataagact

SEQ ID NO: 100343 - DNA, 50 bp, homo sapien
accatggcactaatttaaagaatacraaaagccacaatacaaaaacacaa

SEQ ID NO: 100344 - DNA, 50 bp, homo sapien
tctagagagatcagagagcgtagagrattatagactttgaaaacagggat

SEQ ID NO: 100345 - DNA, 50 bp, homo sapien
ttctgctagttccatcatttcttgaragcttaatatgcctctatcttttt

SEQ ID NO: 100346 - DNA, 50 bp, homo sapien
ttaaacaaaagaaagcattatactgragcagatcactcacctgcttctca

SEQ ID NO: 100347 - DNA, 50 bp, homo sapien
cacattatcccaggttggcgtctcastcatttctaagtattggcactgtc

SEQ ID NO: 100348 - DNA, 50 bp, homo sapien
cataatcttacaaaacagaaggaccytttagactcttggaactgtacact

SEQ ID NO: 100349 - DNA, 50 bp, homo sapien
ctccccatgtaatctgtgaatgaaartgtaccagtgttctcctcccactc

SEQ ID NO: 100350 - DNA, 50 bp, homo sapien
ctctatgaacaatagaacttgaaaaygggccttgtgtccacccacagggt

SEQ ID NO: 100351 - DNA, 50 bp, homo sapien
atatttgttctgcatatctgtttaakctattccactatattacataatat

SEQ ID NO: 100352 - DNA, 50 bp, homo sapien
atatgtgcagttgctgacacttactscatatggttgaatatatcagatat

SEQ ID NO: 100353 - DNA, 50 bp, homo sapien
aattttcttgttgttggtttgagttmaaatgacctgtcacacacttgtcc

SEQ ID NO: 100354 - DNA, 50 bp, homo sapien
accaataggctctctggttaaaatgkgtagactcttcattcagctcattc

SEQ ID NO: 100355 - DNA, 50 bp, homo sapien
cttcacacgtcagtggccgtgagtakcccatcatcatgggaaactcctgc

SEQ ID NO: 100356 - DNA, 50 bp, homo sapien
attagaaggcttagttgtataatacyaaaaattgtacaaattgtgcaagt

SEQ ID NO: 100357 - DNA, 50 bp, homo sapien
ataagaaactagtgacatctgtctcmcaaaaacgatgtgtgcctggctct

SEQ ID NO: 100358 - DNA, 50 bp, homo sapien
ccgagctcacttctgtcagaggaatyaggtttcacaagcccttttttatg

SEQ ID NO: 100359 - DNA, 50 bp, homo sapien
gaacgttgtttctttcttagttttcwaccggctcatcttttgtttttgtt

SEQ ID NO: 100360 - DNA, 50 bp, homo sapien
agaacagagaggatggcaaaaaggasccatgtattcaggcggaaaggcct

SEQ ID NO: 100361 - DNA, 50 bp, homo sapien
gccgggtcctgggaagaaggcatgargtttctaacaaatatgaaggcatc

SEQ ID NO: 100362 - DNA, 50 bp, homo sapien
gtcatgtacctagtctcttcaaagakccttctgtatgattgactacctga

SEQ ID NO: 100363 - DNA, 50 bp, homo sapien
aaaagtaagatattgtctagcaatgracacctgggttggttcccagctct

SEQ ID NO: 100364 - DNA, 50 bp, homo sapien
actcttcattcagctcattctttgawtcattttattttgattggttcgat

SEQ ID NO: 100365 - DNA, 50 bp, homo sapien
ccatccagacagttttcaagtgtacrgaatttgaggaacaatgtatgctt

SEQ ID NO: 100366 - DNA, 50 bp, homo sapien
atgatatgttaagatcttcaatacaytataggcccttcatgttctaacag

SEQ ID NO: 100367 - DNA, 50 bp, homo sapien
ataaaaagatccacactaagactcaytattaaaacatttcaaatactgat

SEQ ID NO: 100368 - DNA, 50 bp, homo sapien
aaatgacagaaacaagtttctcaacraccaccacttctacagagtaactc

SEQ ID NO: 100369 - DNA, 50 bp, homo sapien
tctttctcctcccggcttaactaatyataaccaaatctggggaaggcagg

SEQ ID NO: 100370 - DNA, 50 bp, homo sapien
gcctaggaatattgtattctgctcaractcatcctgcatggatagacttt

SEQ ID NO: 100371 - DNA, 50 bp, homo sapien
tcagtaatcttctgaaactactgtcsttgttgttcaaaaagcaatgaagc

SEQ ID NO: 100372 - DNA, 50 bp, homo sapien
tagttagagaattagaagttataaarggcacatttcttctcagtttgcca

SEQ ID NO: 100373 - DNA, 50 bp, homo sapien
cagacaaaacagacaagacaaaaagygttactagaaatcaagaagatttt

SEQ ID NO: 100374 - DNA, 50 bp, homo sapien
aggtggtgcggctaatcactattggmaagggcctccgaacagaaggagct

SEQ ID NO: 100375 - DNA, 50 bp, homo sapien
atatggcattttgttataatatcctkaacagactaagacagatatcgttt

SEQ ID NO: 100376 - DNA, 50 bp, homo sapien
atcgtgggggtaacagactgaaacaygccttatctccaaatactgtactt

SEQ ID NO: 100377 - DNA, 50 bp, homo sapien
aaaccctgtcctccacagactgtgaygttctgagcaagacttagtttccc

SEQ ID NO: 100378 - DNA, 50 bp, homo sapien
atcatcagaagttacttttgtgcatwaagggctatagtacagcaagggag

SEQ ID NO: 100379 - DNA, 50 bp, homo sapien
cctaagcctcccatgattgacatggmacatatactagtgaattaaaggaa

SEQ ID NO: 100380 - DNA, 50 bp, homo sapien
ggcactcatctgtcattactttgaayaagccatttgacctttatattata

SEQ ID NO: 100381 - DNA, 50 bp, homo sapien
tcagacacaggccagtataggtacaratgtgtagaggaaatgtagccaaa

SEQ ID NO: 100382 - DNA, 50 bp, homo sapien
ttgcagagtcagaattcttcagtgaygtacaggacaatttttttcttggc

SEQ ID NO: 100383 - DNA, 50 bp, homo sapien
cactgatattactcaaagcagcttaycaactgagaggcatcatgacaata

SEQ ID NO: 100384 - DNA, 50 bp, homo sapien
ccaattgtagctttgcaaagtgtacygatgatgatctgaacatgaagcaa

SEQ ID NO: 100385 - DNA, 50 bp, homo sapien
gttctatacaatacaaatcgctaggyatgtgaagaaacaggagtgtctag

SEQ ID NO: 100386 - DNA, 50 bp, homo sapien
gattatatagtagtagaacaatgtcrgaatccaaatattctcactcccag

SEQ ID NO: 100387 - DNA, 50 bp, homo sapien
gaaagtaattactctgcaatatacgyggaatgtcttaaatgcttaaagca

SEQ ID NO: 100388 - DNA, 50 bp, homo sapien
ttacagctttctttctgattctatcmtgagttactctactccaagctgag

SEQ ID NO: 100389 - DNA, 50 bp, homo sapien
taatcttgttgcatttggttaaaagwctgctttggcatttttggtcacct

SEQ ID NO: 100390 - DNA, 50 bp, homo sapien
ggatgtttccattactcacaaaaaawtttctcatgccccaagcaataatt

SEQ ID NO: 100391 - DNA, 50 bp, homo sapien
caagtatatagagtgatgaataataygatgactactagaacaacttgatg

SEQ ID NO: 100392 - DNA, 50 bp, homo sapien
ccttgggagtttttcctggtctttcraagccatctctgaatgagattgat

SEQ ID NO: 100393 - DNA, 50 bp, homo sapien
tgcatcgagtgctttccaactgatayacagggccaggacacgttagtttc

SEQ ID NO: 100394 - DNA, 50 bp, homo sapien
atgtctttcaccacgttggctataamggtaccgacctccatttcctctgc

SEQ ID NO: 100395 - DNA, 50 bp, homo sapien
tcattaaaaattattctacctaatcraatttgacatcataaattgtttga

SEQ ID NO: 100396 - DNA, 50 bp, homo sapien
actaaactataggcccatttctaagracacatttatggttggaagcaaag

SEQ ID NO: 100397 - DNA, 50 bp, homo sapien
ggtcaggtatatccaaacatatcagraagtaggttacatggtgtggtgaa

SEQ ID NO: 100398 - DNA, 50 bp, homo sapien
tagctgactagtacatcatttcctgraagagcccacattagctgagaaac

SEQ ID NO: 100399 - DNA, 50 bp, homo sapien
actgctcctcctcagagctgcactgraactggttgtagggtaaagggatg

SEQ ID NO: 100400 - DNA, 50 bp, homo sapien
aagacacaaaaccacactgtaaaacmataacagaaatgttgctttaatca

SEQ ID NO: 100401 - DNA, 50 bp, homo sapien
ttttatttaaaaacctgttaaatcasgccaaaagcaattatcaactttca

SEQ ID NO: 100402 - DNA, 50 bp, homo sapien
agttcttgagtaaaaatatttcaacragataaatgaggccatatctatct

SEQ ID NO: 100403 - DNA, 50 bp, homo sapien
gccgagcaggagctgttgggtttccrgagaagtctaggaagggaaatgtg

SEQ ID NO: 100404 - DNA, 50 bp, homo sapien
gggacagtgccaaatggtttcggatraagaacaatggtaatgagaataaa

SEQ ID NO: 100405 - DNA, 50 bp, homo sapien
aaaagccacacttagtaggaagtaarctcctgaaactctctacctgggga

SEQ ID NO: 100406 - DNA, 50 bp, homo sapien
attaccctgttcaatttgttaccacyatgacaatggtaagtaaacacaaa

SEQ ID NO: 100407 - DNA, 50 bp, homo sapien
agaaagaaggagaaaaataggtcacrctaagtccaggccctttatttcat

SEQ ID NO: 100408 - DNA, 50 bp, homo sapien
gcaagagataatttcgggtgatccaraaatgcatgtcaggttgtgtgtca

SEQ ID NO: 100409 - DNA, 50 bp, homo sapien
tagtaaatagaacaaatgttacaggkatatgatcaaaactgaaagcgggg

SEQ ID NO: 100410 - DNA, 50 bp, homo sapien
ccttttcttttcagacttctgctgaygatgctggtcatgtggaagggact

SEQ ID NO: 100411 - DNA, 50 bp, homo sapien
tttcctcatgagcaaacggtgaaacsagagtgcttcataatcatcgcagc

SEQ ID NO: 100412 - DNA, 50 bp, homo sapien
aaaaatatacactctcatctttgctytaggcactgttcagtgtttacccc

SEQ ID NO: 100413 - DNA, 50 bp, homo sapien
ttttactttagctctgtgtttgggamagatacgcttacagatgttagaat

SEQ ID NO: 100414 - DNA, 50 bp, homo sapien
aagacaaacatcacaagagtcagctwaaagaatcattacaatgaaaccaa

SEQ ID NO: 100415 - DNA, 50 bp, homo sapien
agcagaggccatgaggtaaagaaaakcttcatgtgagtgtggaagagaac

SEQ ID NO: 100416 - DNA, 50 bp, homo sapien
ttaatgtctgcctgcatctacaagakaagcctcaaataggcagcagatta

SEQ ID NO: 100417 - DNA, 50 bp, homo sapien
ctgagggtcatcagctaatgcatctraatggcgaagtcatgatttcaagg

SEQ ID NO: 100418 - DNA, 50 bp, homo sapien
gtgatagacatccaggctgcctctcrcttgttgttaccacaaaggaggct

SEQ ID NO: 100419 - DNA, 32 bp, homo sapien
ttttaatttgtgtttcyctaattgctagtgag

SEQ ID NO: 100420 - DNA, 50 bp, homo sapien
attcttctacggtttgatagcaggarctgtgtctcattcatatctgtact

SEQ ID NO: 100421 - DNA, 50 bp, homo sapien
aaggtaggcagacgcctgatcatacraggccgcatgaaccatggtaaggt

SEQ ID NO: 100422 - DNA, 50 bp, homo sapien
ccagaaatctcaaaatgacttggagratgtgcctctttattgctcaacag

SEQ ID NO: 100423 - DNA, 50 bp, homo sapien
gggtgctcaaaggacataaggatagytgtcagtggtcctgaaccaacacc

SEQ ID NO: 100424 - DNA, 50 bp, homo sapien
ttttgctatcaacatgatttctttcmattgtattcctttcctttccttag

SEQ ID NO: 100425 - DNA, 50 bp, homo sapien
ctctgtttagcccagtgagagaagaygcacctcagggaacagtaattctt

SEQ ID NO: 100426 - DNA, 50 bp, homo sapien
attttatggacttcatggcagcgatragtaatctgtgatgatactaaata

SEQ ID NO: 100427 - DNA, 50 bp, homo sapien
acagcttctgatcattcttcaactayatcatccaggtcctggtgtcatat

SEQ ID NO: 100428 - DNA, 50 bp, homo sapien
gggtcccttcatccatctatgttccrgaagactgttctatgtgggcatga

SEQ ID NO: 100429 - DNA, 50 bp, homo sapien
atgtggccagtttatgtgcagaataygaagggttaggtaatatttatttt

SEQ ID NO: 100430 - DNA, 50 bp, homo sapien
agaaacatagggcactgtgtcgttaygggtgaatcctagtcgtcctgcag

SEQ ID NO: 100431 - DNA, 50 bp, homo sapien
tcaaatgtaaacctacagtttgatamgctttaaaatacctagttaagagg

SEQ ID NO: 100432 - DNA, 50 bp, homo sapien
tcacccctttgagcctcacatataakaatagggccaacttcactaggacg

SEQ ID NO: 100433 - DNA, 50 bp, homo sapien
atatgttagttcaaggtatatttgcrcaagatttctttgtgatcccaccc

SEQ ID NO: 100434 - DNA, 50 bp, homo sapien
aaatcccaggacttgaaccaaatgtraaaacagtagaattcaattcaggt

SEQ ID NO: 100435 - DNA, 50 bp, homo sapien
aactcagcagaaacctccagataaaygctttagttgtccaggtaggaaac

SEQ ID NO: 100436 - DNA, 50 bp, homo sapien
ttctgtagagtgaggaactaggccawccctaaagtgtttttggaggtcta

SEQ ID NO: 100437 - DNA, 50 bp, homo sapien
agatggaccagaaacttgatctggartatgtggaaaaggggcctcccagt

SEQ ID NO: 100438 - DNA, 50 bp, homo sapien
tgggtagtacaagacatgtagaaacygtgggtagtaaaaccatgtgatca

SEQ ID NO: 100439 - DNA, 50 bp, homo sapien
ttcagctagtcgctgtgctctcaggratgagtaagagtaagtccagaacc

SEQ ID NO: 100440 - DNA, 50 bp, homo sapien
ccacctagttccctgcacacgaatcyaatttccctggtgactggcagaca

SEQ ID NO: 100441 - DNA, 50 bp, homo sapien
cagtgccttgtgtggtacccaataarctagtgagcattccggaaatactt

SEQ ID NO: 100442 - DNA, 50 bp, homo sapien
aacgctcaactttactagaagcaaarctaacactacagatacttctctag

SEQ ID NO: 100443 - DNA, 50 bp, homo sapien
taacatctggtggttctaaagaatarcaaagctacaactaagaaggctct

SEQ ID NO: 100444 - DNA, 50 bp, homo sapien
acactgagtccacctccctagccacrgataaaatagagttgttcattatt

SEQ ID NO: 100445 - DNA, 50 bp, homo sapien
tagaggttgacttgagccattaacarccaagcttgaaaaacaaaaatgaa

SEQ ID NO: 100446 - DNA, 50 bp, homo sapien
ttcagcagcagctaaaaacatggackgtactccaagggacaggggctgtg

SEQ ID NO: 100447 - DNA, 50 bp, homo sapien
cctgtgggtacagtcagctttccacrcagaggtactgtttcccgggaagg

SEQ ID NO: 100448 - DNA, 50 bp, homo sapien
tctgtacctgaatagttgcagaaacmacaacatgagtgaacgtggaagga

SEQ ID NO: 100449 - DNA, 50 bp, homo sapien
cttctcaggactattcctaagcttaytaaatcagcatgagtcactccctt

SEQ ID NO: 100450 - DNA, 50 bp, homo sapien
gagacttctgaaaagttaatatttaygatatactagattttcttgttccc

SEQ ID NO: 100451 - DNA, 50 bp, homo sapien
agttatctttcttgggaatccatgcrctaaccttaatgccaccaatattg

SEQ ID NO: 100452 - DNA, 50 bp, homo sapien
taaaatgtccaggacttgtatatgakagaattaaaatataggtgactttc

SEQ ID NO: 100453 - DNA, 50 bp, homo sapien
actcttggaaagccaggcttaaaaayaaattacacgcctctgtgggagaa

SEQ ID NO: 100454 - DNA, 50 bp, homo sapien
tgacaaagccaggcagttttagttamagttcttatccactatccccatca

SEQ ID NO: 100455 - DNA, 50 bp, homo sapien
tgaccaaatgtgtcgccaaaaactaygtactcttggtggaaaataaaaag

SEQ ID NO: 100456 - DNA, 50 bp, homo sapien
gttcaggattgagagacaatatatcmgagatttgatttactcataaaagg

SEQ ID NO: 100457 - DNA, 50 bp, homo sapien
tctacctgagggtagtgactttactyggatagagtgttgagaactccatg

SEQ ID NO: 100458 - DNA, 50 bp, homo sapien
gaaggccaagtactttatggaaaccrtgacatacactaaagaaagagttc

SEQ ID NO: 100459 - DNA, 50 bp, homo sapien
gctttcctatctgctaaatgtgaccmagtttgtattctctagattaaaag

SEQ ID NO: 100460 - DNA, 50 bp, homo sapien
gccttaccacagccttgtcccagatracagacatccgctcctccacacca

SEQ ID NO: 100461 - DNA, 50 bp, homo sapien
atttaaacttttatatacttagcgayattttatcccctttgacaagcgaa

SEQ ID NO: 100462 - DNA, 50 bp, homo sapien
gagtcagcttgaacctggtttaaaawtatggctgtgccacttagtagcta

SEQ ID NO: 100463 - DNA, 50 bp, homo sapien
ttgtcaacatgctgggtgtaggaagmattgttccaagcgttgccactcaa

SEQ ID NO: 100464 - DNA, 50 bp, homo sapien
aaatctgttttattgcattacatctyaaacttcaggacataacataatca

SEQ ID NO: 100465 - DNA, 50 bp, homo sapien
aagcactgtggacataaaaatatcartaagacagctttccctgtattctt

SEQ ID NO: 100466 - DNA, 50 bp, homo sapien
ggccaggttctctgtcacaaacatasccagcttcactacaacacacattg

SEQ ID NO: 100467 - DNA, 50 bp, homo sapien
aattgcaattaaaatgtcacaagccyatttatatctgtcccatccaagtc

SEQ ID NO: 100468 - DNA, 50 bp, homo sapien
accatccttatttaaaccattatcawctcttgcttcactgcttgaaaatc

SEQ ID NO: 100469 - DNA, 50 bp, homo sapien
aaattctactcctaaaaagattcagratacactagggtctaagtgaaaat

SEQ ID NO: 100470 - DNA, 50 bp, homo sapien
gataactcagatttaggaaatctacyggtataatttatcaaatatgtgat

SEQ ID NO: 100471 - DNA, 50 bp, homo sapien
tgatcttttgaaatgggattatagcrcatccctccttaaaatgcttcagt

SEQ ID NO: 100472 - DNA, 50 bp, homo sapien
aaatgctttggtttcttcttcacttrcccgcaagcaccctattttgtttt

SEQ ID NO: 100473 - DNA, 50 bp, homo sapien
atggtcatattactcagatgatgccrgatgtctgatcctaaagacatttg

SEQ ID NO: 100474 - DNA, 50 bp, homo sapien
ttattgttaattattattatcattayagtgagatctatgggtctagaatt

SEQ ID NO: 100475 - DNA, 50 bp, homo sapien
caaatgagggaactaaactcacacarggtaagtaaactatgtaatcttgt

SEQ ID NO: 100476 - DNA, 50 bp, homo sapien
ttatgttcttaattggtttgaccgtsaagtagtgcaacggcatatctaat

SEQ ID NO: 100477 - DNA, 50 bp, homo sapien
aatcaggctttaaaaaaataactgcmatttttgagcacctaccttaaatc

SEQ ID NO: 100478 - DNA, 50 bp, homo sapien
attaagacaaggctgcttgccaaaastccacacaggcagcggtcgagctg

SEQ ID NO: 100479 - DNA, 50 bp, homo sapien
aatagtgtatgtaatgtacctcctayggatttaagataggtgctcaaaaa

SEQ ID NO: 100480 - DNA, 50 bp, homo sapien
acaattctgatagatcatttatttcrctctttggaaagtcttcctatacc

SEQ ID NO: 100481 - DNA, 50 bp, homo sapien
agaaaatggatgcttgttaccccggratatgctgtgttattttctaagaa

SEQ ID NO: 100482 - DNA, 50 bp, homo sapien
gtgtccaagcccaggtatggcagaaytaaagtctgagctcttaatctctg

SEQ ID NO: 100483 - DNA, 50 bp, homo sapien
ttgccatatgctattccttactgcamacataggagatgagtgtgcagtga

SEQ ID NO: 100484 - DNA, 50 bp, homo sapien
agacagttttatgctagtagttaaayctgaaagacactagaaatgaagtg

SEQ ID NO: 100485 - DNA, 50 bp, homo sapien
caggtctgtttcaaggaatgctgagsaaacattgttagaaagtatcttct

SEQ ID NO: 100486 - DNA, 50 bp, homo sapien
gaatccccattagactatcagtgaayaccttagcagaaaccttgaaagtc

SEQ ID NO: 100487 - DNA, 50 bp, homo sapien
tataagcagcgagcagccagactttktgctggttacagttcattgttgtc

SEQ ID NO: 100488 - DNA, 50 bp, homo sapien
agatttcacgtgcatgtagtttgaaytgtacacacatattacatatatat

SEQ ID NO: 100489 - DNA, 50 bp, homo sapien
cagcttatctggctgtatctaccacraaataagacagtaatgacaacacc

SEQ ID NO: 100490 - DNA, 50 bp, homo sapien
aagccaaagaggttgagtcaaaaaayagcaattaagaatagtctttgtgt

SEQ ID NO: 100491 - DNA, 50 bp, homo sapien
atctggccaaagtttcagttatagaratgaagctgtgattattaaatttc

SEQ ID NO: 100492 - DNA, 50 bp, homo sapien
tctgagcattatcctctgaagtactraataccactgtcaattcagagact

SEQ ID NO: 100493 - DNA, 50 bp, homo sapien
tgatctcctttgacaaagacttactsagtaacaagaattcacaccaatga

SEQ ID NO: 100494 - DNA, 50 bp, homo sapien
aagaggcagtgctgtaaaatgacggyaaggcctgagatggtagcaaccct

SEQ ID NO: 100495 - DNA, 50 bp, homo sapien
taatttgtcttaagcaaataataaayctgcaactggtaagacctatagtt

SEQ ID NO: 100496 - DNA, 50 bp, homo sapien
atcctaaatactttaagcatgaaaaytgacgatgtttttgatttcttacc

SEQ ID NO: 100497 - DNA, 50 bp, homo sapien
gatcaccaggtagagttgttttgctyagattgcttaaattacccaatctt

SEQ ID NO: 100498 - DNA, 50 bp, homo sapien
agaagaaggatcaatagaccaagtasaagggcaaagaaaacttgtgaggt

SEQ ID NO: 100499 - DNA, 50 bp, homo sapien
aaggaatgtctatatgagatgcaaakaatgtatactgcctgaattcttct

SEQ ID NO: 100500 - DNA, 50 bp, homo sapien
agtaagtactattaattccgggctcrattgtatgcgtcacatgccaaact

SEQ ID NO: 100501 - DNA, 50 bp, homo sapien
acctcatcctttttcctctgaaggcycttagctgattagataaggccctt

SEQ ID NO: 100502 - DNA, 50 bp, homo sapien
caaaaaagtaagtgtctcactggacyctgttcaggagctatgcagactta

SEQ ID NO: 100503 - DNA, 50 bp, homo sapien
ttcaaacaattacatccatccttccrcaattgtacctgcctctctagagg

SEQ ID NO: 100504 - DNA, 50 bp, homo sapien
ctaggacagggaccacaaccatgtcrccttactttgccccatccttccca

SEQ ID NO: 100505 - DNA, 50 bp, homo sapien
agacctgctggtgatggcattaagawctgaatggtagggagtctctctga

SEQ ID NO: 100506 - DNA, 50 bp, homo sapien
actttttatgatgtctgaaaaataayaggatcctaagaaatttttgtgga

SEQ ID NO: 100507 - DNA, 50 bp, homo sapien
gcatagagttccaggatgtagaaacrgatttggttggaggagggaaataa

SEQ ID NO: 100508 - DNA, 50 bp, homo sapien
ttagatagtcccagtttctgatcccratgctgcccacctctatgccatga

SEQ ID NO: 100509 - DNA, 50 bp, homo sapien
agcccctccccaagccaaaaatagawgtactaacatttaccaagcactta

SEQ ID NO: 100510 - DNA, 50 bp, homo sapien
tacagcaacataatgttgttaccacrctggacctaaaaagatgagggaag

SEQ ID NO: 100511 - DNA, 50 bp, homo sapien
taggagtacaccctcagtgctcagaragagaggaactttaaagattctct

SEQ ID NO: 100512 - DNA, 50 bp, homo sapien
gagatgctctctgagtaacgggaaastcttgtattcttccataaagctga

SEQ ID NO: 100513 - DNA, 50 bp, homo sapien
gggtggggatagagccaaaccatatyaaggaggaaagtgaagttgagtac

SEQ ID NO: 100514 - DNA, 50 bp, homo sapien
ccctcactatcacaagaacagcatargggaaaccacttccaggatcgcat

SEQ ID NO: 100515 - DNA, 50 bp, homo sapien
cttaagtctgcccccttgaggccacygaaaacaagtctcttctctgtcct

SEQ ID NO: 100516 - DNA, 50 bp, homo sapien
ctgtggtatacccatacaccagaatrttatttagcaataagaggaaatga

SEQ ID NO: 100517 - DNA, 50 bp, homo sapien
gtacagaaaaatattacagatcatcragactgaaatggagcatatgaaat

SEQ ID NO: 100518 - DNA, 50 bp, homo sapien
gattgagtacagaagactttttcagmcagagaaactattctgtatagtcc

SEQ ID NO: 100519 - DNA, 50 bp, homo sapien
atttttaaaaaattctatttcccacygtattttgttttaagaaaatgtca

SEQ ID NO: 100520 - DNA, 50 bp, homo sapien
atcaaaacattcaacacaagtatatragactagaagtttctagagaagaa

SEQ ID NO: 100521 - DNA, 50 bp, homo sapien
atcagaggaggcatgtcatggatgcktgtacagggttggctgaccaactg

SEQ ID NO: 100522 - DNA, 50 bp, homo sapien
ataaactataaagctgtaggcattawgtagatatatatcactattatttc

SEQ ID NO: 100523 - DNA, 50 bp, homo sapien
actgcctctactcagggatataccasgtttgtaagcagagcgacacaaag

SEQ ID NO: 100524 - DNA, 50 bp, homo sapien
tgtttcctgcctactgtggacattaygattttggaagtggcccctggata

SEQ ID NO: 100525 - DNA, 50 bp, homo sapien
cccagtttctttatctgcaagttgakactaaaaagagtggctccatatac

SEQ ID NO: 100526 - DNA, 50 bp, homo sapien
atttagatatgctctgaaaattaaarttctgtctctttgtggaggcattt

SEQ ID NO: 100527 - DNA, 50 bp, homo sapien
acttctggcatgcctgtgattttccracagtggatttttttcttggaggt

SEQ ID NO: 100528 - DNA, 50 bp, homo sapien
tgaagaattggtaaactggaagatgrcactatagggaatttcctaattct

SEQ ID NO: 100529 - DNA, 50 bp, homo sapien
ggacagtttgggtttgggacttaccrgggtgatgttagatctggaacccc

SEQ ID NO: 100530 - DNA, 50 bp, homo sapien
aacatatctagacaattaaccagaayaatgaaggtttagaattattccct

SEQ ID NO: 100531 - DNA, 50 bp, homo sapien
tgccattcaaagacttaaaatcaacrgatagaaattgtcctgaggaagct

SEQ ID NO: 100532 - DNA, 50 bp, homo sapien
tgttaaattattttttctcatatgcrctcaagaacaaagctgaacaccct

SEQ ID NO: 100533 - DNA, 50 bp, homo sapien
tgtttttaatttttagatttttggaygtatgaatattagcacaagcatca

SEQ ID NO: 100534 - DNA, 50 bp, homo sapien
taaatacctcatagaagtagcttcayacactttgtctttttgtgactgac

SEQ ID NO: 100535 - DNA, 50 bp, homo sapien
gttaggagaactttattttccatatwacaatttcatagaggaatctgttc

SEQ ID NO: 100536 - DNA, 50 bp, homo sapien
ttaattacctttgggtaagtgctgayagaagaatggctagatcacctggc

SEQ ID NO: 100537 - DNA, 50 bp, homo sapien
aatggaatttaaaaggctgcctctamgctttcgtgggagttataagtagt

SEQ ID NO: 100538 - DNA, 50 bp, homo sapien
acaggtgtggagtgtgctataaccartcagagagataagactgactgctg

SEQ ID NO: 100539 - DNA, 50 bp, homo sapien
catttcttatgtttatttccctctgyatgcataaaatactgcaagggctt

SEQ ID NO: 100540 - DNA, 50 bp, homo sapien
taaagcttctcatttaattctgatgyaatccaaataagggaaacttttct

SEQ ID NO: 100541 - DNA, 50 bp, homo sapien
actataaatgcccatgaattaggacratggtttggagatcttattgctag

SEQ ID NO: 100542 - DNA, 50 bp, homo sapien
ctacaaagactgtgctgacaactaartggtgtgacctaaaagcaaaacat

SEQ ID NO: 100543 - DNA, 50 bp, homo sapien
acaagcttggaaaaaacaatgtgtaraatcccttccagggcccaccagca

SEQ ID NO: 100544 - DNA, 50 bp, homo sapien
agaagcattcttctcaatagccaaaygttacaagtaatccaactgtatat

SEQ ID NO: 100545 - DNA, 50 bp, homo sapien
aataagtttcatgatgactaagtggraatgcaagtgaatggctcagcata

SEQ ID NO: 100546 - DNA, 50 bp, homo sapien
caacttcctatctcggccaatagccrtgatgactactggaggaattctca

SEQ ID NO: 100547 - DNA, 50 bp, homo sapien
taaagcaattggattatttgtaaaasttgctttaatatctatatttgttg

SEQ ID NO: 100548 - DNA, 50 bp, homo sapien
ctcattcttctttcttaaggcttttwgtatccatgaaggtcccaacttcc

SEQ ID NO: 100549 - DNA, 50 bp, homo sapien
caagacttcagcagagctggattcamgagaggaataaggatgtaacctca

SEQ ID NO: 100550 - DNA, 50 bp, homo sapien
gttagtgacctagagggaatgaaatyagaagagaagcagatcaggtggaa

SEQ ID NO: 100551 - DNA, 50 bp, homo sapien
aagtattttggtcatttctaagaaargacacactattaaactattccagt

SEQ ID NO: 100552 - DNA, 50 bp, homo sapien
tctgctctgcagtctctgatattctsacacctggttctaatgctgatttg

SEQ ID NO: 100553 - DNA, 50 bp, homo sapien
aactaaaacacctagtggttatttargtcacccgtgaaattctgaataat

SEQ ID NO: 100554 - DNA, 50 bp, homo sapien
agacagtgggcttatagactaatgarcacatatgattaatcaattaacct

SEQ ID NO: 100555 - DNA, 50 bp, homo sapien
gaattatcgttaaactaattgggccrcatggaggcaggatgatgctgaaa

SEQ ID NO: 100556 - DNA, 50 bp, homo sapien
actcaaaaggctaacaaacttatgayccttcaactacaatagttacaggg

SEQ ID NO: 100557 - DNA, 50 bp, homo sapien
accaagtgtctgttttttgtatcatwacacaggtatacaccacttgcctc

SEQ ID NO: 100558 - DNA, 50 bp, homo sapien
tttatagagggaatactgtttcaacsagaacctgggagggtttccactgg

SEQ ID NO: 100559 - DNA, 50 bp, homo sapien
agtttctcaaaattaggcatgtatcmgactaacttggagggataattaaa

SEQ ID NO: 100560 - DNA, 50 bp, homo sapien
cacacagcaaggagcaaagcgataaygagaacccaagctccccagcgtcc

SEQ ID NO: 100561 - DNA, 50 bp, homo sapien
agaggtgaaaactcagtgtgtcatgyagcactgtccaagacagaggtcct

SEQ ID NO: 100562 - DNA, 50 bp, homo sapien
acctcaaatctaatatgttccatacwactattttgatctttcaccacaat

SEQ ID NO: 100563 - DNA, 50 bp, homo sapien
tggattctttcactacattttaaagscatgttgacaaaaactattttaat

SEQ ID NO: 100564 - DNA, 50 bp, homo sapien
tctctggagagtcatgatttagaatyacatgttttgtttgtgtgattatt

SEQ ID NO: 100565 - DNA, 50 bp, homo sapien
taagggcatcccttgtaaggttctargtcagtggtcctcaaagtatggtc

SEQ ID NO: 100566 - DNA, 50 bp, homo sapien
ttcaaatttggataagttagtcaaaytgatgtgaaaggaccacccttgta

SEQ ID NO: 100567 - DNA, 50 bp, homo sapien
cagatgctgccagtttgaatttatgragaaaggctgtcagacttcttgga

SEQ ID NO: 100568 - DNA, 50 bp, homo sapien
gcattcaacataagtgaactacaacmagagtagtgttgaactggatgatc

SEQ ID NO: 100569 - DNA, 50 bp, homo sapien
agaagctagtacactgtttcaactcyagttagctttcttaagcctttttg

SEQ ID NO: 100570 - DNA, 50 bp, homo sapien
aacctgacagtaggtgattaatgtaycatccctggttaagaaaagcatag

SEQ ID NO: 100571 - DNA, 50 bp, homo sapien
aagaaacacccaacaataatgaaaayggtaggataagggcactccaaatg

SEQ ID NO: 100572 - DNA, 50 bp, homo sapien
aatagcacatggtggccacaaagacmcttaataaatgctgcttgtttgct

SEQ ID NO: 100573 - DNA, 50 bp, homo sapien
gtgggaggcctttacgggacattatraggagagctaacgtaactcaatgg

SEQ ID NO: 100574 - DNA, 50 bp, homo sapien
ttgtgacactggcccaaatgtctaaygtgatcccatgatctgcattcaat

SEQ ID NO: 100575 - DNA, 50 bp, homo sapien
gcctatacacattctgcatggtacastcatatttcaatttggaagtgtgg

SEQ ID NO: 100576 - DNA, 50 bp, homo sapien
ttagatctaagaaccatctaagaccrggaaagatttgggatagaaaagac

SEQ ID NO: 100577 - DNA, 50 bp, homo sapien
gagagaggttgaagaatatcctcaaytgatcccaagcaccttctctgagg

SEQ ID NO: 100578 - DNA, 50 bp, homo sapien
atatttgccatctctggtcacaattraagagaaacagtaacttcatatta

SEQ ID NO: 100579 - DNA, 50 bp, homo sapien
cacttgtaaaacaataggattaagayagagtgagatttttaaaacacttt

SEQ ID NO: 100580 - DNA, 50 bp, homo sapien
agaaggtaactctttgagaaaatgayccatggcttcttcatacattgcac

SEQ ID NO: 100581 - DNA, 50 bp, homo sapien
aaactaaccactagaactattttccygacagaatctttgccttgcatgtt

SEQ ID NO: 100582 - DNA, 50 bp, homo sapien
acctctttttttgactctaagaataygacagaagttgctgacctcagaaa

SEQ ID NO: 100583 - DNA, 50 bp, homo sapien
aatgtgtatcctgcagctcttagatraaatgttccgtaaatacctactag

SEQ ID NO: 100584 - DNA, 50 bp, homo sapien
atagcatctagatatgtaaaggaaayattatcgagctaaagagagagata

SEQ ID NO: 100585 - DNA, 50 bp, homo sapien
aactgacgtgatgctaagcagaaccrgaaagtaaaacagaaaggatatgg

SEQ ID NO: 100586 - DNA, 50 bp, homo sapien
tgaggtagattctactattattcgtwaccaagaattaagaagctaaacaa

SEQ ID NO: 100587 - DNA, 50 bp, homo sapien
actaaactccttggcagatgtaaatractttctactttgcatgtaatttt

SEQ ID NO: 100588 - DNA, 50 bp, homo sapien
tgtttcttggataacagaataaatakgtcaagctaagccccaagattaaa

SEQ ID NO: 100589 - DNA, 50 bp, homo sapien
tgactagcaagtgccaaatacttcamgtaaaagcaagaacttaaggaaat

SEQ ID NO: 100590 - DNA, 50 bp, homo sapien
tttttcatgagccagcccagggatayaaaactagaattaccaaggtgaat

SEQ ID NO: 100591 - DNA, 50 bp, homo sapien
ccaggtgaaacagctcccatcaaggkaccataagaactggcgtgctccta

SEQ ID NO: 100592 - DNA, 50 bp, homo sapien
ccacaaagcttaagggtaagtacaartgacggaagcaattcaaagaagga

SEQ ID NO: 100593 - DNA, 50 bp, homo sapien
aatggaattatagtctgatacggtgraataaatgtacacatagggtataa

SEQ ID NO: 100594 - DNA, 50 bp, homo sapien
tggccatttagtcttgcttcctacarggtctggtgacttaattaaaggac

SEQ ID NO: 100595 - DNA, 50 bp, homo sapien
ggcagaatcaagtccagcaccattayctcattgattccatctggaacttg

SEQ ID NO: 100596 - DNA, 50 bp, homo sapien
ataaaacacatgtttctgttactaawccatgcacttaccattattgtctg

SEQ ID NO: 100597 - DNA, 50 bp, homo sapien
atttcctatatttatttaccactggmaggtcttagattaatatttccttt

SEQ ID NO: 100598 - DNA, 50 bp, homo sapien
ttggtattatctccattttgtaaaaktatgtcgatgttctagagcaggga

SEQ ID NO: 100599 - DNA, 50 bp, homo sapien
tggtggtgggaggtaacccggcatcmtggagaaaaatactcagcttgaaa

SEQ ID NO: 100600 - DNA, 50 bp, homo sapien
agtatctcctctgaggattcaaaacyaaaatgctattcctaacagaggct

SEQ ID NO: 100601 - DNA, 50 bp, homo sapien
catagatagaatacactctgaaactkaatacaaacctgttatatttattt

SEQ ID NO: 100602 - DNA, 50 bp, homo sapien
atgtcctcctggtgccagacccaacrctaggtaaagctactgtggtaaaa

SEQ ID NO: 100603 - DNA, 50 bp, homo sapien
agtctatttctctctatcattcatcsaaagtaatatcatttcttgaagaa

SEQ ID NO: 100604 - DNA, 50 bp, homo sapien
aagcatgtgtatgtcttttctttacrcatgtaaccagatagtatctgagt

SEQ ID NO: 100605 - DNA, 50 bp, homo sapien
atacccaatgaaaatatgctttaaamattaagatgatattaagacgtttt

SEQ ID NO: 100606 - DNA, 50 bp, homo sapien
tttaaacattaagatgatattaagamgttttcaggcaaacaaaaacgaag

SEQ ID NO: 100607 - DNA, 50 bp, homo sapien
gaaaaagggaaagagaacttcatgamaattccaagacttgatttgaacaa

SEQ ID NO: 100608 - DNA, 50 bp, homo sapien
atattattgttattttaatagtcaaygttctcttacactatccacatatt

SEQ ID NO: 100609 - DNA, 50 bp, homo sapien
tttatgatctggtagtagggcaggcmatttcattcccactttacggagga

SEQ ID NO: 100610 - DNA, 50 bp, homo sapien
cagttggcttttgatgaactattacyatataaaaattgcactgcaaataa

SEQ ID NO: 100611 - DNA, 50 bp, homo sapien
gggttactcaatctgtacttttcacygaattatagaactggctaatgtta

SEQ ID NO: 100612 - DNA, 50 bp, homo sapien
cataatgattgcatggaaaaggtgaygctgaaggttgatagtaaccaaaa

SEQ ID NO: 100613 - DNA, 50 bp, homo sapien
tgctgaaggttgatagtaaccaaaaygcttttcagagaactaggtcacac

SEQ ID NO: 100614 - DNA, 50 bp, homo sapien
gttagaggcttttagagacttcaacycaggattttcacagcagaatatca

SEQ ID NO: 100615 - DNA, 50 bp, homo sapien
caggaggagaaaatgttactgattaygggcaaaaatccaaggtggaactt

SEQ ID NO: 100616 - DNA, 50 bp, homo sapien
agagaaaacacaaatgtacaaataamcgaggtcatttcagacatgataaa

SEQ ID NO: 100617 - DNA, 50 bp, homo sapien
ctttgaattaagacctgttatcagamggatccaaagagaaagccaacatc

SEQ ID NO: 100618 - DNA, 50 bp, homo sapien
tataaatagccaaatatctatacaayctactcaaaactcctaaagttacc

SEQ ID NO: 100619 - DNA, 50 bp, homo sapien
atgcctattctctatgttcatggagyccacaatcttccaatggggcatcc

SEQ ID NO: 100620 - DNA, 50 bp, homo sapien
tagcagcctacagaaggcacacctaygtttttatttccatggcttcctta

SEQ ID NO: 100621 - DNA, 50 bp, homo sapien
tcagtcccaaccttcagttttggaarggtcaaagaagatacaattgggcc

SEQ ID NO: 100622 - DNA, 50 bp, homo sapien
aaactgaaggttgggactgactccayggtgctggcctgtctatggcccac

SEQ ID NO: 100623 - DNA, 50 bp, homo sapien
taagttttcacgcatagtggacagargacttagaccgaatgaggtgaggc

SEQ ID NO: 100624 - DNA, 50 bp, homo sapien
aaagctgggatcttattcactgcacygagtcatatcttccacatagtttc

SEQ ID NO: 100625 - DNA, 50 bp, homo sapien
gattttttgcatgtagatattgttcragttgatgtttctgtaggaggcaa

SEQ ID NO: 100626 - DNA, 50 bp, homo sapien
tactgccggcagtctctgttccagaygcaatatatgcaaggtctaatgta

SEQ ID NO: 100627 - DNA, 50 bp, homo sapien
tgtgaacccctgtggcagaaatgaargtattgttcgtataccaccttagc

SEQ ID NO: 100628 - DNA, 50 bp, homo sapien
gaaaataattcatgtttagaagctayatttagaagactatgtaacctata

SEQ ID NO: 100629 - DNA, 50 bp, homo sapien
ataaaacagggaaatatgatattgayggaaaaatcatgatggagaatgat

SEQ ID NO: 100630 - DNA, 50 bp, homo sapien
ggtcctagacttttgtggatcagaaytgtccaaggtgtgctagcattgat

SEQ ID NO: 100631 - DNA, 50 bp, homo sapien
gtagtgtgcattaattgtctaactcyatctgtccatctatatttattagt

SEQ ID NO: 100632 - DNA, 50 bp, homo sapien
gtagaagcgtttgtagtagagagcaytgactccagatctcattttcttct

SEQ ID NO: 100633 - DNA, 50 bp, homo sapien
atagaaaactaatacaccctccaaaygtaaccctctatctaccctgctgc

SEQ ID NO: 100634 - DNA, 50 bp, homo sapien
tgtgagacttctgacctccataatcrtaagataatatttacgaaatttgt

SEQ ID NO: 100635 - DNA, 50 bp, homo sapien
ttacagtctagcaaggaaacactcayaatctgtgatatgtgctcagaagg

SEQ ID NO: 100636 - DNA, 50 bp, homo sapien
cattcctttgttctttaagctacaartacgtattgagcatgcagaaatac

SEQ ID NO: 100637 - DNA, 50 bp, homo sapien
actcttctttcatgatagggattaakgcaaaaatgaaatataaggcaaca

SEQ ID NO: 100638 - DNA, 50 bp, homo sapien
tttactattccaagtagctcctttcrattattgattcattctgcctttaa

SEQ ID NO: 100639 - DNA, 50 bp, homo sapien
tctgtgaaacaagtccattgtaaaaygtagtggaaaatgatacatatgtg

SEQ ID NO: 100640 - DNA, 50 bp, homo sapien
atactgacgttttgcagaggtgataygggatgttccaatacagacgtggt

SEQ ID NO: 100641 - DNA, 50 bp, homo sapien
gaggtctataaaatattattttgtayagcaaagttggaatagtttctatt

SEQ ID NO: 100642 - DNA, 50 bp, homo sapien
ttcaaacattattgaaattggactcycttggaaaatctgtgatactatat

SEQ ID NO: 100643 - DNA, 50 bp, homo sapien
tgcttctgctgctgtccgaatatcarccacttatttttctattcttaata

SEQ ID NO: 100644 - DNA, 50 bp, homo sapien
aatagagatgataaattcaggagacratgttcaggaataattcaaatgaa

SEQ ID NO: 100645 - DNA, 50 bp, homo sapien
attactgctctgttaccatcagatcrtcttaatcctattgactgaaatgc

SEQ ID NO: 100646 - DNA, 50 bp, homo sapien
ggtaagctatcagataagagatcacmatgtaactggtatagaaaacactt

SEQ ID NO: 100647 - DNA, 50 bp, homo sapien
cttcaagactagtcttggcaatacaytgaaaccgtgtctctataaaaaac

SEQ ID NO: 100648 - DNA, 50 bp, homo sapien
aagtcacatcagagtgaacagactawgaatggttgggcagaaaaagcctt

SEQ ID NO: 100649 - DNA, 50 bp, homo sapien
gttatgaacactttacattatgaacmactcattctgtgaagtggcttttc

SEQ ID NO: 100650 - DNA, 50 bp, homo sapien
atcagtagattataatccaaaataaratttctgaacaccctgtcatttac

SEQ ID NO: 100651 - DNA, 50 bp, homo sapien
ttaaaacaccatgaaatactccacaraaaagttatagtaacacacatgaa

SEQ ID NO: 100652 - DNA, 50 bp, homo sapien
actgtgaccacaccagtgtaagaaargtatcagtaggtcagacaacaatg

SEQ ID NO: 100653 - DNA, 50 bp, homo sapien
gcttcctacatgatactgaggagaakaattatggcctttaaagctcaatg

SEQ ID NO: 100654 - DNA, 50 bp, homo sapien
gatcaggtgttctgacctgagaaaasttctatactcattgatcttcagta

SEQ ID NO: 100655 - DNA, 50 bp, homo sapien
tgagtggaaacctaactttacaagaragcttactccacttacagacacct

SEQ ID NO: 100656 - DNA, 50 bp, homo sapien
atgcattttttgggacaacaataccragtggatgataaaaataggatatt

SEQ ID NO: 100657 - DNA, 50 bp, homo sapien
aaaactagagagcagagaatggagasaatgacttgaagtgtggccactca

SEQ ID NO: 100658 - DNA, 50 bp, homo sapien
cttgggcacacagttaagtgttcaayggagaactgtcaatggagaatgtt

SEQ ID NO: 100659 - DNA, 50 bp, homo sapien
actcagttctcacctgactgctcacytttaccctacctgcctacaccttg

SEQ ID NO: 100660 - DNA, 50 bp, homo sapien
aaatgtaatatctcagccttagagaytaaaatgggttgccagttattctc

SEQ ID NO: 100661 - DNA, 50 bp, homo sapien
aaaagtctcttgtcttctgtggaackcatacattaactttaacgagctta

SEQ ID NO: 100662 - DNA, 50 bp, homo sapien
ttatagatgttcattactcctgttaygaatatgtgaaccagtttgccatg

SEQ ID NO: 100663 - DNA, 50 bp, homo sapien
taaaaatatgttccttggtcgaacamtatggtagtaatataaggaaacat

SEQ ID NO: 100664 - DNA, 50 bp, homo sapien
aatctatgacatttgatatataaacmcattattcaacaatagagatgaac

SEQ ID NO: 100665 - DNA, 50 bp, homo sapien
gttcttggtggttgtgcttggatgaygatataaggttgtgggaaggtgaa

SEQ ID NO: 100666 - DNA, 50 bp, homo sapien
gcatctggtgactcatcaaagaagayacgatctgttccaatactagagga

SEQ ID NO: 100667 - DNA, 50 bp, homo sapien
ggtgtgatctttggtagaaataagamgagagggatccacagaccctggga

SEQ ID NO: 100668 - DNA, 50 bp, homo sapien
ttcacagaccagaaatcaagcctgasgtgtagcttctgtttgtgacccag

SEQ ID NO: 100669 - DNA, 50 bp, homo sapien
agtaagtcagtagctcaatggggcarcataattagttcaaatatgtgggc

SEQ ID NO: 100670 - DNA, 50 bp, homo sapien
tcagttctgctctgttctgctcttawtttttacatattagaaaaagtgag

SEQ ID NO: 100671 - DNA, 50 bp, homo sapien
acttttcaggggtacagctgtatgcrccatgaatgatgtttttatattca

SEQ ID NO: 100672 - DNA, 50 bp, homo sapien
tgggttttcaaagaccaggtgtatayaagaattacctgagagtagttgaa

SEQ ID NO: 100673 - DNA, 50 bp, homo sapien
ttacttcaccttatcaaaatgaaagwctattaagcatgccctgccctacc

SEQ ID NO: 100674 - DNA, 50 bp, homo sapien
ttttacataaagctggcttcacagayagtatctcatttgcttctcagaac

SEQ ID NO: 100675 - DNA, 50 bp, homo sapien
cgattgccctctggtaagaattgtamgctcaattggattttgaaggtcat

SEQ ID NO: 100676 - DNA, 50 bp, homo sapien
gaagcataaaaattgagatgtggaamggggtgacaagaaagtatttatga

SEQ ID NO: 100677 - DNA, 50 bp, homo sapien
ctctcatttatctgatgcatacagarcctcttcagtatctctgatttcag

SEQ ID NO: 100678 - DNA, 50 bp, homo sapien
gttggttttggcttttggttgttacrattcttacatatgttataagcccc

SEQ ID NO: 100679 - DNA, 50 bp, homo sapien
aaaacaaaagactgaggagatgtcayaggttgaaggaaactaaagagatc

SEQ ID NO: 100680 - DNA, 50 bp, homo sapien
agtaggagacatatttgtattggcawtattccattttgtttgtccccaca

SEQ ID NO: 100681 - DNA, 50 bp, homo sapien
gctaattctctctcttcaagaattaragtaaacttgactggttgttcttt

SEQ ID NO: 100682 - DNA, 50 bp, homo sapien
agaacacaggaacaaaagaatcgaaygcaatgaaatattatcctcaatgt

SEQ ID NO: 100683 - DNA, 50 bp, homo sapien
gtaaatctagaagtgtatttgggtayacagtgaatgatttttcaactttt

SEQ ID NO: 100684 - DNA, 50 bp, homo sapien
agacaagtatactgcgattcagaaakattaaatggcttatccaagaatta

SEQ ID NO: 100685 - DNA, 50 bp, homo sapien
ctgatcactccaaatatcccatgaayaaccctaatccatttgatgagttt

SEQ ID NO: 100686 - DNA, 50 bp, homo sapien
aaatggcacattaattcacaaaggcrcatagaaaatagtgtacaagcaat

SEQ ID NO: 100687 - DNA, 50 bp, homo sapien
tgaatgcaggaaacacccttacttayggcacagaattaaatgaagagagc

SEQ ID NO: 100688 - DNA, 50 bp, homo sapien
aaattgggatgagtttaccaatcaaygtgtacacttaatgcagttaattt

SEQ ID NO: 100689 - DNA, 50 bp, homo sapien
aaacctacctgtagagatattctaamacagactgaatgattgctcacaag

SEQ ID NO: 100690 - DNA, 50 bp, homo sapien
tctgtacagaatttggcaatggttayccaaaactgagtggtagcttccct

SEQ ID NO: 100691 - DNA, 50 bp, homo sapien
atatgtttgtaattcctattcccacrcatcaatcttggaatgtgatagta

SEQ ID NO: 100692 - DNA, 50 bp, homo sapien
caattcaacctagagcttaaaaaagsccttcatcagagaacatgtcacaa

SEQ ID NO: 100693 - DNA, 50 bp, homo sapien
gtttcaaatagtcatgaatagccagrccataataccctgcacctgcctgg

SEQ ID NO: 100694 - DNA, 50 bp, homo sapien
ttcagtttaatttctttcatgtaaayaggtatgatcaccaatttgagaga

SEQ ID NO: 100695 - DNA, 50 bp, homo sapien
aagaatttcaagatagtgaagcagartggtaaaccagctgcaaagccctt

SEQ ID NO: 100696 - DNA, 50 bp, homo sapien
agcccttctgggccttatactactgyacacctgtgaagccaaccctcttg

SEQ ID NO: 100697 - DNA, 50 bp, homo sapien
ttcatcacaagccctctctcttttayagaattgcctactcctaatattga

SEQ ID NO: 100698 - DNA, 50 bp, homo sapien
acatggcaccaatgatagataatctsaagaaacagacttctgcatagcat

SEQ ID NO: 100699 - DNA, 50 bp, homo sapien
aaatgggactagctggagaggaatgyatggactagaacatatattctgct

SEQ ID NO: 100700 - DNA, 50 bp, homo sapien
taatattgtcaaccataatttttagrcactcctatatattcaatattgta

SEQ ID NO: 100701 - DNA, 50 bp, homo sapien
taaacaccaggccagatgatctctaygtttccttctatcattatttttct

SEQ ID NO: 100702 - DNA, 50 bp, homo sapien
tcttaggtcacacattcctaattctyactatgattcctcatttgatgttg

SEQ ID NO: 100703 - DNA, 50 bp, homo sapien
cagtcccagctgttgagataccccargcctttgagtctcccagctaaggt

SEQ ID NO: 100704 - DNA, 50 bp, homo sapien
cctttgaggacttgagaggccgtcaygagaagagtgcttctcggctccta

SEQ ID NO: 100705 - DNA, 50 bp, homo sapien
caattgatctatattgcacagtcatmaaatcaaattcagaaattggtatc

SEQ ID NO: 100706 - DNA, 50 bp, homo sapien
gttacaaaacaacattatataggcayaccactcatccactctggcaaata

SEQ ID NO: 100707 - DNA, 50 bp, homo sapien
ctctacctcctaaatgttctaaaacrccaactctttaaaagcaaggacca

SEQ ID NO: 100708 - DNA, 50 bp, homo sapien
catgacccctaccttctattctttcmcttaagagatctgagacattaaga

SEQ ID NO: 100709 - DNA, 50 bp, homo sapien
agcccactctagagatgcatagcctraagaacatggagcagagtatttgc

SEQ ID NO: 100710 - DNA, 50 bp, homo sapien
aaaagacctcttccatcacagacacraaggttcactgcactctcaggcaa

SEQ ID NO: 100711 - DNA, 50 bp, homo sapien
cagaaactattaatagtcacccaacyggaaatgttttgaaaaacagcaac

SEQ ID NO: 100712 - DNA, 50 bp, homo sapien
gtggaactatagtaatttgcacacartccatgtcaagaaaataatcatca

SEQ ID NO: 100713 - DNA, 50 bp, homo sapien
aatgtggaggagagaataaagtatargagtgtgaattctgacattttaat

SEQ ID NO: 100714 - DNA, 50 bp, homo sapien
ctttgtttaaatataacaataatccyattaccacacacacaatccagaag

SEQ ID NO: 100715 - DNA, 50 bp, homo sapien
ctgattccccatccagatattacackcactccacaacattatagcatttt

SEQ ID NO: 100716 - DNA, 50 bp, homo sapien
ttggcaacaccctcagagatacaccyaggaacaacactttgcatccttca

SEQ ID NO: 100717 - DNA, 50 bp, homo sapien
tgggttttgacaatctgaccttctayacattgagactggaggaatacgaa

SEQ ID NO: 100718 - DNA, 50 bp, homo sapien
cttgtttagccacacacacagataaytgagtattacaattttttcctaaa

SEQ ID NO: 100719 - DNA, 50 bp, homo sapien
tcttggtaatacatgccagatgatcyataattaatatgattgcctagaaa

SEQ ID NO: 100720 - DNA, 50 bp, homo sapien
ttctgtgctacaagtaagggtgctaycaagccatgaaaagatagagaggc

SEQ ID NO: 100721 - DNA, 50 bp, homo sapien
gttcttctaaagggaatagcctttcrccagctatgttaactcttttctgt

SEQ ID NO: 100722 - DNA, 50 bp, homo sapien
attttgccccaaggtttaaacccaaygatgatttttagttcatattcatt

SEQ ID NO: 100723 - DNA, 50 bp, homo sapien
accctcaaaacattaatgtaacaccrattcattcaaaccgatttcatcat

SEQ ID NO: 100724 - DNA, 50 bp, homo sapien
actgaaagagaatagtgtctcctctsaaacttgttttcttctcttttatt

SEQ ID NO: 100725 - DNA, 50 bp, homo sapien
taatttcatcacctgggtgataagcrcagtaaccattagctatttttaaa

SEQ ID NO: 100726 - DNA, 50 bp, homo sapien
gcaaattaaaaggaaggatagtgttsaacaaacaaatgatgcatattgag

SEQ ID NO: 100727 - DNA, 50 bp, homo sapien
gttttgtgtttttgtcttagttactyaacaaagttgggcaatcttacagg

SEQ ID NO: 100728 - DNA, 50 bp, homo sapien
cttctatgtctcgctaaagagtctgsacttcgtattgtgggcagtaggga

SEQ ID NO: 100729 - DNA, 50 bp, homo sapien
cccggtcaagtcagtgcaatagtaaygaaaacaaacaaacaaacaatgat

SEQ ID NO: 100730 - DNA, 50 bp, homo sapien
catttagcaattgctaggaccaaacygagcagcagctcatattctttaca

SEQ ID NO: 100731 - DNA, 50 bp, homo sapien
cagaacgtgactcagtaaagacagcwcctcgctagtggtattatttaaaa

SEQ ID NO: 100732 - DNA, 50 bp, homo sapien
agatgttcatttatatagtttgtggracttagtttcagaataccagatta

SEQ ID NO: 100733 - DNA, 50 bp, homo sapien
aaaattgtcctgacagctaaagagcratctgacctttgtgatcaggagga

SEQ ID NO: 100734 - DNA, 50 bp, homo sapien
tctgctcttagggtttaaagatcaasaaagcatggcactcaagttgctta

SEQ ID NO: 100735 - DNA, 50 bp, homo sapien
ttcctctagttagctagttaggtcaytataaactaaggaagctgcaaaat

SEQ ID NO: 100736 - DNA, 50 bp, homo sapien
aaaaacacattcaaggttagagcaawgtatcaaacttcaaactttactaa

SEQ ID NO: 100737 - DNA, 50 bp, homo sapien
atagcagattagaaataaaaaatcaraaggagtagaggagctattacagg

SEQ ID NO: 100738 - DNA, 50 bp, homo sapien
gcacatcttttacatctacaaagtasagatgatcatggtaatgccaacct

SEQ ID NO: 100739 - DNA, 50 bp, homo sapien
ccaaatgagaattctgtgtacctgaraaagcacttgattaagggtttaaa

SEQ ID NO: 100740 - DNA, 50 bp, homo sapien
gtgtttttattgttaaaagagtctcragtaagacaaacattttgcctaag

SEQ ID NO: 100741 - DNA, 50 bp, homo sapien
agcttcccagagccaaaagctgttayaggcttcctcagtgaaagcgcagc

SEQ ID NO: 100742 - DNA, 50 bp, homo sapien
actggattcatgcctattctattcartaaagttatctctttagactgaca

SEQ ID NO: 100743 - DNA, 50 bp, homo sapien
tatagaaggtgcttaaaagaactacygagggcttgaatttccagttttct

SEQ ID NO: 100744 - DNA, 50 bp, homo sapien
ccactagagaccttcctagcttggaygttttaaattacctattggccatc

SEQ ID NO: 100745 - DNA, 50 bp, homo sapien
cactttgtattctcttagcttttaaytctcagggacaaggactgacctgg

SEQ ID NO: 100746 - DNA, 50 bp, homo sapien
ctgaaaaggatccgatatcagtcacrtgcaactaagtatgctgtttagtt

SEQ ID NO: 100747 - DNA, 50 bp, homo sapien
ccagtacaagctgagtccagcacacygtcggcaagcctaagtacaaatga

SEQ ID NO: 100748 - DNA, 50 bp, homo sapien
tgtcctgtgtattaatgtgtgtaaaygtagcttagaactactatgggtaa

SEQ ID NO: 100749 - DNA, 50 bp, homo sapien
atgggattttggaagtttgtgttgckaatacaattgtggagaatcttagg

SEQ ID NO: 100750 - DNA, 50 bp, homo sapien
taaattcttaccaaactatgcccaayatgttttcatttcattaagcagtt

SEQ ID NO: 100751 - DNA, 50 bp, homo sapien
gtcagatcgctctttagctgtcaggrcaattttagcttctttcccgttgg

SEQ ID NO: 100752 - DNA, 50 bp, homo sapien
tgtcaggacaattttagcttctttcycgttggatcaaatgattcgacttt

SEQ ID NO: 100753 - DNA, 50 bp, homo sapien
atgcccagaaatggaagtttctgtarcattcaatctaatacaatataaca

SEQ ID NO: 100754 - DNA, 50 bp, homo sapien
ttctaaggatgggataacacaggtcrttaaaggtctgcagggaatttcac

SEQ ID NO: 100755 - DNA, 50 bp, homo sapien
ttcttgacatccatcaccacttgaarctctaatggacgtctttaatttaa

SEQ ID NO: 100756 - DNA, 50 bp, homo sapien
tctcaagggattccgatacacatagwcctttgataatatacttaaaaaac

SEQ ID NO: 100757 - DNA, 50 bp, homo sapien
gtttttaaagtctgtaagtttgcacratactgtatagtaactaaatgcat

SEQ ID NO: 100758 - DNA, 50 bp, homo sapien
caaattttatagttcagacctatgaragagatagctaagttttggaaact

SEQ ID NO: 100759 - DNA, 50 bp, homo sapien
agtgctttctaaatggcaaatactgygtttcatcccagcaacatgatgga

SEQ ID NO: 100760 - DNA, 50 bp, homo sapien
gctgaaaaccctgctagttctaaaaytttaagtgcttactcaacctattt

SEQ ID NO: 100761 - DNA, 50 bp, homo sapien
attgcctaacatagtgtcttcacaartgccagatactgggtgtcgaatgg

SEQ ID NO: 100762 - DNA, 50 bp, homo sapien
agcaaatgaatcttttatggctgtaygctgaaatgatctagcatggtgat

SEQ ID NO: 100763 - DNA, 50 bp, homo sapien
tcagggaggttcaactgccttgcttkaaaagaatccaggaaactggccta

SEQ ID NO: 100764 - DNA, 50 bp, homo sapien
gggagagagatgacatgtgaataaamaaggccattttggatgctgcgaat

SEQ ID NO: 100765 - DNA, 50 bp, homo sapien
atagatgtgattatgtgagtaaggaragtgcactaataagtactcatcat

SEQ ID NO: 100766 - DNA, 50 bp, homo sapien
aagaggagtaataagagaattttctygggtgatagaaatgttccctctcc

SEQ ID NO: 100767 - DNA, 50 bp, homo sapien
aaaacattaaatgtgatagatatcasaatactcacaatctctggggaagg

SEQ ID NO: 100768 - DNA, 50 bp, homo sapien
gccctcactcagatgtctgagaactycagaagagcctatcatcacctgag

SEQ ID NO: 100769 - DNA, 50 bp, homo sapien
cctgtgcttgcaacgcttacgtgttsatcccagtgtccttttccaaatga

SEQ ID NO: 100770 - DNA, 50 bp, homo sapien
acagtagctgcccttgaggatagtarcaagctcagctgtaggttctagca

SEQ ID NO: 100771 - DNA, 50 bp, homo sapien
atttgcagtggagaaaagaacccgaygtcccacagccagatatacaccca

SEQ ID NO: 100772 - DNA, 50 bp, homo sapien
aaacccagtggtgactgttaacctcrgaagaccctgcttctgctcttgga

SEQ ID NO: 100773 - DNA, 50 bp, homo sapien
tgaggcaagacaataaagtgtgtaaragctcaggttcaagcaccaaagag

SEQ ID NO: 100774 - DNA, 50 bp, homo sapien
tcatcatcttgtgatctgtttaaaarcctaaaactatttgcttttgaatc

SEQ ID NO: 100775 - DNA, 50 bp, homo sapien
actgcaaatgagactacagttgtgaygatggtgggaggttccaggggtgc

SEQ ID NO: 100776 - DNA, 50 bp, homo sapien
tgaagacttgattctgatgatagaargccatcacaggcttgtgaacaggg

SEQ ID NO: 100777 - DNA, 50 bp, homo sapien
ttttttatcctgcaaaaaatataaartgcaggaaattattttttgccccc

SEQ ID NO: 100778 - DNA, 50 bp, homo sapien
agggaagttacaggttgatccccctyaagaacaaagattatttattccat

SEQ ID NO: 100779 - DNA, 50 bp, homo sapien
tccattgtgctgtttgtgaaaagaamtaatcctctttgcttcccctcaca

SEQ ID NO: 100780 - DNA, 50 bp, homo sapien
ctgctgagtaagtcttgatccttaastctctttcactaagaaagtgttca

SEQ ID NO: 100781 - DNA, 50 bp, homo sapien
aacagcaagaatgggccatatgtgayaaaattaagagacaacaaagttct

SEQ ID NO: 100782 - DNA, 50 bp, homo sapien
ataaatgggaaatgatcaacaggctraataagttccttttgaatgtgaaa

SEQ ID NO: 100783 - DNA, 50 bp, homo sapien
tgtattttaaaaacaacaaacttgartaaatactatacaacttctaaagc

SEQ ID NO: 100784 - DNA, 50 bp, homo sapien
gctgtgtgccaacacagtcctagagrgaagaaagacacattcctgatgac

SEQ ID NO: 100785 - DNA, 50 bp, homo sapien
ctaatacaaaggagactggaagtacsataaaaataaatagataaataaat

SEQ ID NO: 100786 - DNA, 50 bp, homo sapien
tttctctagatacagaaatatttcartcaggccaatttttatacaaaact

SEQ ID NO: 100787 - DNA, 50 bp, homo sapien
atgaaaagagagccaaacaagacagsatggcctaaaaatgacatgccctg

SEQ ID NO: 100788 - DNA, 50 bp, homo sapien
gctatctctggctgagagaaccacaracttcaagatgtatgagggctacc

SEQ ID NO: 100789 - DNA, 50 bp, homo sapien
ctaatttcatatagtatagatggaartatggtctactatcttggaataaa

SEQ ID NO: 100790 - DNA, 50 bp, homo sapien
accatatctggcccactttcttaaayctactaagactgcgtaaacctgct

SEQ ID NO: 100791 - DNA, 50 bp, homo sapien
tcgtattcaattcctgaatctccaayatttaaaacaatgcctagcaagct

SEQ ID NO: 100792 - DNA, 50 bp, homo sapien
ctagtaacaaatttaaactatgtgcyatatgtggtagaaaaacccctgga

SEQ ID NO: 100793 - DNA, 50 bp, homo sapien
gagacaaaatgctactgcatctaagmacaggaaaggtttgtggattgtgc

SEQ ID NO: 100794 - DNA, 50 bp, homo sapien
tctgtgttttatgtatactacctcaytcagactttgcaataatcctgtga

SEQ ID NO: 100795 - DNA, 50 bp, homo sapien
aatttacatttgatagttacatcatyataaaacactcagaataccatgca

SEQ ID NO: 100796 - DNA, 50 bp, homo sapien
ggcaatgaacattactgagcactaaygaatgagctatttgctttctgtca

SEQ ID NO: 100797 - DNA, 50 bp, homo sapien
tctgtacaaagaaataggaaattacygatacctttattcccaacttccag

SEQ ID NO: 100798 - DNA, 50 bp, homo sapien
atttgattcgttcctttaaagctcaygtctgtagaagcgcatgattcttt

SEQ ID NO: 100799 - DNA, 50 bp, homo sapien
atctttgaagaaagaggtcaaaccarataagtattcattggattggttga

SEQ ID NO: 100800 - DNA, 50 bp, homo sapien
gagagtcaacaggtcagagagcatamccatttgaaatgttcatgcatatt

SEQ ID NO: 100801 - DNA, 50 bp, homo sapien
gggtcattttctaaacagcaaaatamatagatgtcatcacaatgttttat

SEQ ID NO: 100802 - DNA, 50 bp, homo sapien
tcaatggcaaagactgtgttgtgcaytagatagatatgctgagaaatgag

SEQ ID NO: 100803 - DNA, 50 bp, homo sapien
ttactcttttacttgacattgattgwacctctcaatggcaaagactgtgt

SEQ ID NO: 100804 - DNA, 50 bp, homo sapien
tcacctcggtaaaggattcatcatcrttaggtgtcacccgggtcacagca

SEQ ID NO: 100805 - DNA, 50 bp, homo sapien
tttgtttctgtgaatttctaccctcmagagtaacccaactgagcaagaaa

SEQ ID NO: 100806 - DNA, 50 bp, homo sapien
attttgtgaattgaattaggttgaaytggagcatgtcagaagtaggaggg

SEQ ID NO: 100807 - DNA, 50 bp, homo sapien
gatattcttgaatgataatctattarcccttaaacatcaaattaacatca

SEQ ID NO: 100808 - DNA, 50 bp, homo sapien
catgaaagtatcagggcttggtaaaygagagtgctttctgtttaattact

SEQ ID NO: 100809 - DNA, 50 bp, homo sapien
caaaatataaatacaagtactttggsaccatatgaaaaagggatttgacc

SEQ ID NO: 100810 - DNA, 50 bp, homo sapien
ttgtgatctctgagttttagaataaygatagaagagtccacacagtaaac

SEQ ID NO: 100811 - DNA, 50 bp, homo sapien
gatttcaattccattcttagctctgmacttttttcacataggtgaccatg

SEQ ID NO: 100812 - DNA, 50 bp, homo sapien
tattagtctgtggtctactaatgackgaaacattgttatgcagcacatga

SEQ ID NO: 100813 - DNA, 50 bp, homo sapien
attagacttcagaggactattgtgarcattaaatgagattatgcatggga

SEQ ID NO: 100814 - DNA, 50 bp, homo sapien
tgacgtttcttttgtgcaactcagtrctttaacaagactgaattgaaatg

SEQ ID NO: 100815 - DNA, 50 bp, homo sapien
tcagctcagacaacattctgtgaaayctttcaaagaggaatgttgaatat

SEQ ID NO: 100816 - DNA, 50 bp, homo sapien
cgatggcagttgtggacactcattgragatgacagccgacttcaacatgg

SEQ ID NO: 100817 - DNA, 50 bp, homo sapien
tatttaggatatatgattaggttagraaatgctatttacacttgatttgc

SEQ ID NO: 100818 - DNA, 50 bp, homo sapien
gaaatattttaatcatgaagttcaakaattcatttgctgatataactaca

SEQ ID NO: 100819 - DNA, 50 bp, homo sapien
attatcattttcatgtacgattttaygaattttcgacatgttcaagtctc

SEQ ID NO: 100820 - DNA, 50 bp, homo sapien
caatggaaaggcactagattagaaascttcccagggattttgtatccacc

SEQ ID NO: 100821 - DNA, 50 bp, homo sapien
cgattgggtacacaaaggtacacaarttatgttgacataggacttctcag

SEQ ID NO: 100822 - DNA, 50 bp, homo sapien
gatcccaggtgctgtctagcagtagyctaaccaagcttcaaggatagttt

SEQ ID NO: 100823 - DNA, 50 bp, homo sapien
taccaacccaccaggctctctctaartaaagtcttctttcccgttctctt

SEQ ID NO: 100824 - DNA, 50 bp, homo sapien
ctgctaaataagtgtatttaccatcragttataaagcttttccatagtct

SEQ ID NO: 100825 - DNA, 50 bp, homo sapien
gcatttttactacagcctgtttgtcrgaacccatttagtcacccaccaat

SEQ ID NO: 100826 - DNA, 50 bp, homo sapien
tcattgcaaaagagttaagttaccartacagtcatgtgtcacttagtgat

SEQ ID NO: 100827 - DNA, 50 bp, homo sapien
ctgtattggtaacttaactcttttgyaatgagatagtgactttttagcac

SEQ ID NO: 100828 - DNA, 50 bp, homo sapien
gaaggatctggattagagtattttaygtctgcagcactagagaaccaaca

SEQ ID NO: 100829 - DNA, 50 bp, homo sapien
tcacaaacccctagaaatactcaccrcattatattccagattatctccac

SEQ ID NO: 100830 - DNA, 50 bp, homo sapien
tccttccctccagtgactgattacckactctgaaccaagagctctgacag

SEQ ID NO: 100831 - DNA, 50 bp, homo sapien
actatagccaagtgcagatacaacarctcattactgcattagttttctgt

SEQ ID NO: 100832 - DNA, 50 bp, homo sapien
gggatatttaaaaacagatgtatacraaagataagtagatctgttgctat

SEQ ID NO: 100833 - DNA, 50 bp, homo sapien
ctattttctggtcccaggccctctcratttctggttataattctagcctt

SEQ ID NO: 100834 - DNA, 50 bp, homo sapien
ggctgcaaaggactatggatgtgaaytggaggcactgttcttagtgatgc

SEQ ID NO: 100835 - DNA, 50 bp, homo sapien
ctacaactagccctaggctaatctawgtcagccatctgagcttcagtgtc

SEQ ID NO: 100836 - DNA, 50 bp, homo sapien
tactgatgaattttcaaatctcaaarcaaattaagatagcactctttcag

SEQ ID NO: 100837 - DNA, 50 bp, homo sapien
agcaaaattgactcctcctactgacyacttactgagtccttactatgggc

SEQ ID NO: 100838 - DNA, 50 bp, homo sapien
cttcttaaaaaccaatctgtcactaytggccagaacaagcaacattactt

SEQ ID NO: 100839 - DNA, 50 bp, homo sapien
gagtactgcctccaggacttagcacragaggatgaaatctgcggttgttt

SEQ ID NO: 100840 - DNA, 50 bp, homo sapien
tcagagaacttgtgacttcctaacamtaaaccacattctagtgaggaact

SEQ ID NO: 100841 - DNA, 50 bp, homo sapien
acccacctagaatattcttagagtayagggaaacaattggtttctctgcc

SEQ ID NO: 100842 - DNA, 50 bp, homo sapien
taaagaattaactgaacgaacaagasaggaattcatggaaacctgtacac

SEQ ID NO: 100843 - DNA, 50 bp, homo sapien
tttttcttttttaacagaacctaggmacattcaaatgtggacatgaatgg

SEQ ID NO: 100844 - DNA, 50 bp, homo sapien
gtgtcagaggtttccaaagatgatargtagcatgatttaactcaagcgta

SEQ ID NO: 100845 - DNA, 50 bp, homo sapien
aaaactgggaaataccagaaagtgcraaggaaaaagtaagaaatctcttg

SEQ ID NO: 100846 - DNA, 50 bp, homo sapien
gggcttccgtgtcagacatagcaacrcagactttatcctgaaagcatggg

SEQ ID NO: 100847 - DNA, 50 bp, homo sapien
acctctcacttgaccttaaagcatargttgagactggatggtctctcaaa

SEQ ID NO: 100848 - DNA, 50 bp, homo sapien
atatcatccctgaaaaatactggagkctcagttaaatgttattttgtact

SEQ ID NO: 100849 - DNA, 50 bp, homo sapien
gaatggttataaaacaaatctgtgakaacaaagacataagaaactcatga

SEQ ID NO: 100850 - DNA, 50 bp, homo sapien
aagggttcttgtaaaatggaggcacratggtgagaaagaggttataagaa

SEQ ID NO: 100851 - DNA, 50 bp, homo sapien
gcatttctctgatgtgtatggcctcyagtttaaagagtgaagcccagaga

SEQ ID NO: 100852 - DNA, 50 bp, homo sapien
ttgccagacagcaaagtgaaaggcaygttttgattactaccgacattcac

SEQ ID NO: 100853 - DNA, 50 bp, homo sapien
atgtggctggtacacctgaatgtctraattctcatataatatgtcttagt

SEQ ID NO: 100854 - DNA, 50 bp, homo sapien
cttggcaggtggctctcacggataaygtccagggtatctctcagacctcc

SEQ ID NO: 100855 - DNA, 50 bp, homo sapien
gcatggagtcatgataaaggcattarccatcatcaagttgactccttcaa

SEQ ID NO: 100856 - DNA, 50 bp, homo sapien
caggtgatatgcacaaatgtgcaatraagtgtcaactgttacaccaacat

SEQ ID NO: 100857 - DNA, 50 bp, homo sapien
gagcttgatcagtatcatcacatcaraattttatcttggagatatgtcag

SEQ ID NO: 100858 - DNA, 50 bp, homo sapien
attatggatcctgttgacatttaaayacacaatggactgatgtggaagac

SEQ ID NO: 100859 - DNA, 50 bp, homo sapien
ggtcacaaccgtaacacattccttcrcgttactctcctccttcaccaccg

SEQ ID NO: 100860 - DNA, 50 bp, homo sapien
gaaaattactgaagagaatgtggtcrcaatcaataggaaacaccaggaga

SEQ ID NO: 100861 - DNA, 50 bp, homo sapien
acattgctgcaactattatgtggagragcaactgcttattgaaatggaat

SEQ ID NO: 100862 - DNA, 50 bp, homo sapien
caggggagatggtcatgccttaaccrtgggtaacagtcatggagatgatg

SEQ ID NO: 100863 - DNA, 50 bp, homo sapien
gagacctttcagaagtgctaacagakcctcagacctgacctgaccatcca

SEQ ID NO: 100864 - DNA, 50 bp, homo sapien
tggataataaaattgtaatggatgcraagaagtgattactaggaaagcca

SEQ ID NO: 100865 - DNA, 50 bp, homo sapien
atattctaaaataaaaacaggtttayaaatcagcacgtgtagagtgattt

SEQ ID NO: 100866 - DNA, 50 bp, homo sapien
acagtggaaagacttactttggtgarcaaactgataacccaataccctct

SEQ ID NO: 100867 - DNA, 50 bp, homo sapien
tcctctaatatgggtatattcataaygcctgatagttcactttattctga

SEQ ID NO: 100868 - DNA, 50 bp, homo sapien
actttctgaagttacctcatttctcrcttcacttgtatttccatgacctt

SEQ ID NO: 100869 - DNA, 50 bp, homo sapien
caaagtgtgatgtcacctatttatawccctccaagggcttcccaagacct

SEQ ID NO: 100870 - DNA, 50 bp, homo sapien
tcctcttttatctaccacatgaaaakactatctgattataatttgatgcc

SEQ ID NO: 100871 - DNA, 50 bp, homo sapien
attcttgtctttggcaaatattgaaraactggaggtgattgagacacaaa

SEQ ID NO: 100872 - DNA, 50 bp, homo sapien
actgtcattggccatttatcagtccrtgagtaatactgctttttataaac

SEQ ID NO: 100873 - DNA, 50 bp, homo sapien
acagctttgtcagaactgctactaastctaggcggaccttgctatgtact

SEQ ID NO: 100874 - DNA, 50 bp, homo sapien
ctgtcaacaaggcttctgctgtttgyaaaaagacatttcctcacagtata

SEQ ID NO: 100875 - DNA, 50 bp, homo sapien
ctcaggctggggttggcattgaaaargttaagcttgagatgattggaaat

SEQ ID NO: 100876 - DNA, 50 bp, homo sapien
cctgttaaaatctgatttctatacartatttgatgttaatatctggctca

SEQ ID NO: 100877 - DNA, 50 bp, homo sapien
tatttagtgcttactacataaagagmactgggctagaagcagttgagaga

SEQ ID NO: 100878 - DNA, 50 bp, homo sapien
cctgttaaataaattcttcatctccratattctgtgtatttgtcttttac

SEQ ID NO: 100879 - DNA, 50 bp, homo sapien
gtaaaagcctcattttagcttttaaycaattctacctctaaaaactggac

SEQ ID NO: 100880 - DNA, 50 bp, homo sapien
atgaaagatggaaggaatcaccaaaraatgaagaatacaagaataaaatc

SEQ ID NO: 100881 - DNA, 50 bp, homo sapien
gtaggtttctctgtcctgataaagayaggtaattactaggatcacactgt

SEQ ID NO: 100882 - DNA, 50 bp, homo sapien
tccaggagtcttatcaatgctgtcayacaggaccaggaacagttttgagt

SEQ ID NO: 100883 - DNA, 50 bp, homo sapien
acatctaactatcaagactaactccyaaaatagctttcaataaactgcaa

SEQ ID NO: 100884 - DNA, 50 bp, homo sapien
ttacaaatgaagaaactgagtcaaasaggtgttcagcattgctgaaggtt

SEQ ID NO: 100885 - DNA, 50 bp, homo sapien
cctgttagcggagtccctttaaggargttagaccagtgacctttgctgtg

SEQ ID NO: 100886 - DNA, 50 bp, homo sapien
agctctcatgtatctcatttcaagartctcattttgagtatactatatgc

SEQ ID NO: 100887 - DNA, 50 bp, homo sapien
gaaaagaagaaatgatttttactgcsccagacttaatagactgttaccat

SEQ ID NO: 100888 - DNA, 50 bp, homo sapien
tctagatttcgaattgagttctttascttcacatattatgcaagttattg

SEQ ID NO: 100889 - DNA, 50 bp, homo sapien
tttattcatttatgtaatcattccasaaaattacatcaaggacaaactgc

SEQ ID NO: 100890 - DNA, 50 bp, homo sapien
ccatctttccaagttgtttttttcakctatggcccctcagactggttacc

SEQ ID NO: 100891 - DNA, 50 bp, homo sapien
gctcaaattttagtaggctgtaaacrcaaatccacatgtgtggtgtttta

SEQ ID NO: 100892 - DNA, 50 bp, homo sapien
gttttgtctgagttactttttcatasgtgctttgggctggacattctcac

SEQ ID NO: 100893 - DNA, 50 bp, homo sapien
ttcagttctattattggcagccatakaatccaatttgaattcaagaagcc

SEQ ID NO: 100894 - DNA, 50 bp, homo sapien
ggttatttccacgaagaaaggtgtayacttgaaatgagactgtttctaga

SEQ ID NO: 100895 - DNA, 50 bp, homo sapien
atttattagttatatacgtaacaaartatgttcaagatctgtaggaggaa

SEQ ID NO: 100896 - DNA, 50 bp, homo sapien
gaagcttatagtctaaactgaggatyattcacctgaagagattcctatgg

SEQ ID NO: 100897 - DNA, 50 bp, homo sapien
atacaaagacaaagaacatctggaarggaacacactacagataaaatcct

SEQ ID NO: 100898 - DNA, 50 bp, homo sapien
gtagctagaatcaatattgtcaaaasggccatactaccaagagtgatcca

SEQ ID NO: 100899 - DNA, 50 bp, homo sapien
agggacagtgcctggcatattgtaasagcttagcacatacccattgtatt

SEQ ID NO: 100900 - DNA, 50 bp, homo sapien
tgatttttattatgtaaggctcaccrtgtcaactaacacaaaccttttgg

SEQ ID NO: 100901 - DNA, 50 bp, homo sapien
gtaatttttaacatttacgtcaaggrcatattgtaggaaccaaggagata

SEQ ID NO: 100902 - DNA, 50 bp, homo sapien
ggcaaagcaatccttatgaaactaamaaaccaatctaaaacagtaagaaa

SEQ ID NO: 100903 - DNA, 50 bp, homo sapien
caagcatgacaaaatgttctatactyacacaaatttattctaaaaataac

SEQ ID NO: 100904 - DNA, 50 bp, homo sapien
ggctctcactaaggtgattttctaamcatgaatatttacaaagacgaaaa

SEQ ID NO: 100905 - DNA, 50 bp, homo sapien
gtatcttactgaactaagtcatggaygtgaaaaattaaattactaaaagt

SEQ ID NO: 100906 - DNA, 50 bp, homo sapien
tataccctacacaataatctgtcaamaaaatatactttttgcagagactt

SEQ ID NO: 100907 - DNA, 50 bp, homo sapien
ttggttcacatccagagcaatagtcratgcatagcatactatatgaaaat

SEQ ID NO: 100908 - DNA, 50 bp, homo sapien
gacatgaagagatactttcttactcycttgacggtggctgtgtgatctgc

SEQ ID NO: 100909 - DNA, 50 bp, homo sapien
aaaacaccctttggccttagcgacgsactatttctaaacctggaatcatt

SEQ ID NO: 100910 - DNA, 50 bp, homo sapien
ctgccctcctgttgagtaaggattgyatctaccggatgtcccttgccagt

SEQ ID NO: 100911 - DNA, 50 bp, homo sapien
gacatggactgtgtgcaaattactayagttccacttttacaacacaattc

SEQ ID NO: 100912 - DNA, 50 bp, homo sapien
ccttactgcaccaactcatttaagartctgcatttcagagtgtttatatt

SEQ ID NO: 100913 - DNA, 50 bp, homo sapien
acggggaaaattcttcctgcctaacrcgaaagttgtaaagataaaatgaa

SEQ ID NO: 100914 - DNA, 50 bp, homo sapien
tatttatttattgctggatacccacyaacaatagccacagacaattactt

SEQ ID NO: 100915 - DNA, 50 bp, homo sapien
tataaaatgtgaacctataaaactcytagatcataacatagaataaaatc

SEQ ID NO: 100916 - DNA, 50 bp, homo sapien
gctaagtgctataagtgttttatatyaccgacggtcacaagactagaagg

SEQ ID NO: 100917 - DNA, 50 bp, homo sapien
gaagtgtactatttctgcatttaaayttctatatgttacacttaagcctt

SEQ ID NO: 100918 - DNA, 50 bp, homo sapien
tgagcctttaccctgagactgttaastacaaaatctttgacaaaaattct

SEQ ID NO: 100919 - DNA, 50 bp, homo sapien
ggaaggaaggaaagaaatagacacayagattcttataaaaccagacaaaa

SEQ ID NO: 100920 - DNA, 50 bp, homo sapien
agaattgattatattaaagctgtatmaatcttgaattcccttcccccact

SEQ ID NO: 100921 - DNA, 50 bp, homo sapien
tataataaaaaataaaaattaccacyaataacacttgcacagcttgtaga

SEQ ID NO: 100922 - DNA, 50 bp, homo sapien
aagcctttcatgctctgctaatgtgrcatttgtttggtaatatgtgggag

SEQ ID NO: 100923 - DNA, 50 bp, homo sapien
gagatgttctataagcagttgaaaaygtaaatctaggccaggtgcagtgg

SEQ ID NO: 100924 - DNA, 50 bp, homo sapien
cataatattgatgtactacagtgacyattaaagcatttaccttttctgga

SEQ ID NO: 100925 - DNA, 50 bp, homo sapien
tggcaaactttaactttatcatcgcyaattaaagtgtctcttcctcctga

SEQ ID NO: 100926 - DNA, 50 bp, homo sapien
acaaaaattatttatgtttgttaaartattctgaagtttaacccatcatt

SEQ ID NO: 100927 - DNA, 50 bp, homo sapien
ctattttcagtcctgggttctataasataccactataatatcctaatgga

SEQ ID NO: 100928 - DNA, 50 bp, homo sapien
gaataccaaagcttctctatcctcaygatgacaaattttgagttatgaca

SEQ ID NO: 100929 - DNA, 50 bp, homo sapien
gtagcttctggtatttttattaccartcggagtaggcttgtcaccatcag

SEQ ID NO: 100930 - DNA, 50 bp, homo sapien
tggtagctgggagagaggtaacacaycaatagacaggtttccttggattc

SEQ ID NO: 100931 - DNA, 50 bp, homo sapien
cattttgatcatgataacctggacaycgattggtttttctgaagcaactt

SEQ ID NO: 100932 - DNA, 50 bp, homo sapien
aatgtctgtacaaagacttgcccacmaatagtcacagcaactttctttgg

SEQ ID NO: 100933 - DNA, 50 bp, homo sapien
ccaatgtggctggagaggaatgaacmagagtttaagagatggggggaggg

SEQ ID NO: 100934 - DNA, 50 bp, homo sapien
aaggtaaagctagagatcggactcaytcctacaaccttgaaagacatttt

SEQ ID NO: 100935 - DNA, 50 bp, homo sapien
aaagaaactaactaaaggcaatgtayactatataaggcaaaaatgtgatc

SEQ ID NO: 100936 - DNA, 50 bp, homo sapien
aagaaatgaagcaagaaaagtgcacmgacgtatccaatgtaaattatcgt

SEQ ID NO: 100937 - DNA, 50 bp, homo sapien
tttccttttccagtatttaatctgasacatttgatcttcattattaagtg

SEQ ID NO: 100938 - DNA, 50 bp, homo sapien
gtctgctgttaaatactctggctgtractcactgaaactaacaggcacag

SEQ ID NO: 100939 - DNA, 50 bp, homo sapien
catgtcagatctgtttaagaagttcyatggttcaagaatgaagaaaatgt

SEQ ID NO: 100940 - DNA, 50 bp, homo sapien
attaccaacctaacaataaagaagcyaagcctagaacagtggttatgttg

SEQ ID NO: 100941 - DNA, 50 bp, homo sapien
ctgtatcagtgtgcctatctaagtgmaaactcagggagggcaggatggaa

SEQ ID NO: 100942 - DNA, 50 bp, homo sapien
tttttatagtacactcatcttagaargtattattcaataaatgaagaaaa

SEQ ID NO: 100943 - DNA, 50 bp, homo sapien
tttagagggactgagaagtgcaaggrtcaaaggctcacattgagcaggat

SEQ ID NO: 100944 - DNA, 50 bp, homo sapien
gaggcatgtgactttgggtgagtgaycctctttgtacttcaattcctcat

SEQ ID NO: 100945 - DNA, 50 bp, homo sapien
aatacaggagggttctaagatgaagscttattgtctaggtcacacaattg

SEQ ID NO: 100946 - DNA, 50 bp, homo sapien
ctactgtaatttaaactatcttgcaytgagtaagagaattgacctacagc

SEQ ID NO: 100947 - DNA, 50 bp, homo sapien
atgctgactcttcctcaaataagacrgaactcctcgtgctggactgcctt

SEQ ID NO: 100948 - DNA, 50 bp, homo sapien
ggaagcaccatctccttgttggaggycatctggagaagtaagcaacaaaa

SEQ ID NO: 100949 - DNA, 50 bp, homo sapien
gtagctctaaaacttgagtgtacackaaaatcacctagaggacgtgtcac

SEQ ID NO: 100950 - DNA, 50 bp, homo sapien
ggtacaaatatttctatactcaagaratgtacagaatccaaattacagta

SEQ ID NO: 100951 - DNA, 50 bp, homo sapien
tctaactggagaagaagaagactaayagatgtaataacagtctccattta

SEQ ID NO: 100952 - DNA, 50 bp, homo sapien
gaaaaggaacatgaaatgggatcaastaagttatattgaatacatataca

SEQ ID NO: 100953 - DNA, 50 bp, homo sapien
cacttgtctttcagagagtctcttgyaggtatgaagaataaaaaatttat

SEQ ID NO: 100954 - DNA, 50 bp, homo sapien
ttcaattaaatgtgtgttgtaataaygctttcttctaaagtgtttggaca

SEQ ID NO: 100955 - DNA, 50 bp, homo sapien
cctaactagctatgagaagaaggcartatgctaggctagaactgatgaat

SEQ ID NO: 100956 - DNA, 50 bp, homo sapien
actttgcttctcccaagccaaatccractgaataatatttattaagaaat

SEQ ID NO: 100957 - DNA, 50 bp, homo sapien
tatttagttgggaccaatatagtcayagggctcttaaatggggaagatgg

SEQ ID NO: 100958 - DNA, 50 bp, homo sapien
cccagagaaacagatgatgagaataygaaggaaaagatatgtttagaatt

SEQ ID NO: 100959 - DNA, 32 bp, homo sapien
gtggcgttaagtcctastaaacttaaggtaaa

SEQ ID NO: 100960 - DNA, 50 bp, homo sapien
caaattctttcatggtgagagatagyactgctaattattagaacaaatct

SEQ ID NO: 100961 - DNA, 50 bp, homo sapien
gttctggccacacttacattactccrgcagtctcaatcggctacctcctt

SEQ ID NO: 100962 - DNA, 50 bp, homo sapien
caacccttccatttactaactgtacrccatgcagattacttaatctccta

SEQ ID NO: 100963 - DNA, 50 bp, homo sapien
aatctagagaaaacttccacatacartctgttccagctgcttgggggcac

SEQ ID NO: 100964 - DNA, 50 bp, homo sapien
tggcagtcccaaaggcaagttctgaytaagttcattcaggagcagtaagg

SEQ ID NO: 100965 - DNA, 50 bp, homo sapien
aagaactatttattatggctttaaarttatttatgtgtttactttagata

SEQ ID NO: 100966 - DNA, 50 bp, homo sapien
ccagtgagagtctatatccatacaarttcacatgtggatgccccttattt

SEQ ID NO: 100967 - DNA, 50 bp, homo sapien
agtaccagacacagttatgcctgtcrttgaaccaggagtcaaggtgagtc

SEQ ID NO: 100968 - DNA, 50 bp, homo sapien
tctgtagcttcctgttgcacctaaawtaatctaagaaggctgtgtcctta

SEQ ID NO: 100969 - DNA, 50 bp, homo sapien
gtgtgttgttcccaaagatgtcatcyaccatatgtgtttaggcaatcata

SEQ ID NO: 100970 - DNA, 50 bp, homo sapien
ggactgtttactggagagtaaaatgsaggttcaggcagataaagagaagg

SEQ ID NO: 100971 - DNA, 50 bp, homo sapien
aaaagtaacacttgtatatgatgtaygataaaagcacaaaagagctgtca

SEQ ID NO: 100972 - DNA, 50 bp, homo sapien
gaagtcaaaggtgaaacataaccacyagcttggcctgaatttgatagggg

SEQ ID NO: 100973 - DNA, 50 bp, homo sapien
attataaaagtatttcatcattaaaygcacttgggaaatgctgaaattca

SEQ ID NO: 100974 - DNA, 50 bp, homo sapien
aatacttagtttgcatgcttattttstaacgtcataatcagagatttgtt

SEQ ID NO: 100975 - DNA, 50 bp, homo sapien
tctatgcatctatatgcaagcaataygatatgacaggaacaagtttctat

SEQ ID NO: 100976 - DNA, 50 bp, homo sapien
tgttttatgtcgaattatgccactcyataaatttgttctttcccactcca

SEQ ID NO: 100977 - DNA, 50 bp, homo sapien
gttttatttacaaaatgtattacaawgtggttctttcagagttttgtgat

SEQ ID NO: 100978 - DNA, 50 bp, homo sapien
gaaggctccgactatagaaggaagartatcatgtcaagcattctaaggat

SEQ ID NO: 100979 - DNA, 50 bp, homo sapien
gcttgagacaagaattgatggataamtttttctcagaagatgttgtgatt

SEQ ID NO: 100980 - DNA, 50 bp, homo sapien
tgtgtatggattcaagtgcaataagwaagctggtgttgtcaggttcagat

SEQ ID NO: 100981 - DNA, 50 bp, homo sapien
ttgcataattaaaaatgattttaacrgagaatttaatgataaagaaaaat

SEQ ID NO: 100982 - DNA, 50 bp, homo sapien
agatactttgtggatgcttattataygcgcgcttagtgggcaaggcgagg

SEQ ID NO: 100983 - DNA, 50 bp, homo sapien
cacttttccttattttatagcttcartaaagaattctgctgttttgtaaa

SEQ ID NO: 100984 - DNA, 50 bp, homo sapien
tattaagttcgtgaagaacaaaatarcaattgagggaaatataattttaa

SEQ ID NO: 100985 - DNA, 50 bp, homo sapien
aataaagccatctcagctaagagackaagaccatccctcctcagcagcct

SEQ ID NO: 100986 - DNA, 50 bp, homo sapien
gaagcaagatgcaagatgaaagatcrctgagatagaaccttaccatttca

SEQ ID NO: 100987 - DNA, 50 bp, homo sapien
taagggtgaaaatctatgcacctaaytgacttcacttgctccagtataac

SEQ ID NO: 100988 - DNA, 50 bp, homo sapien
acctacaaccatctgctcttcaacamagtccacaagaatgaccaatgggg

SEQ ID NO: 100989 - DNA, 50 bp, homo sapien
tgagttagtttcttcactgccgacakccttcttataagagtccctgtcac

SEQ ID NO: 100990 - DNA, 50 bp, homo sapien
aaacataatgttggcttcagcatccracaggtataaattctatgctcata

SEQ ID NO: 100991 - DNA, 50 bp, homo sapien
tagctagctagctagagctcactcartaaatagctattattactatagtg

SEQ ID NO: 100992 - DNA, 50 bp, homo sapien
tcccatagggaggtggtcaccaggartaagttgtgtaaggcagatatcta

SEQ ID NO: 100993 - DNA, 50 bp, homo sapien
tagcccctatagtccgctgggagcaytgaactcctgacctcaggtgatcc

SEQ ID NO: 100994 - DNA, 50 bp, homo sapien
aacaagtagtgagaccaagcactgasaaatacattggaattttgcagtaa

SEQ ID NO: 100995 - DNA, 50 bp, homo sapien
ccattttacagatttagaaatatggyagatgcaataaggtttaacttgcc

SEQ ID NO: 100996 - DNA, 50 bp, homo sapien
atattgaagtccttttttatgatgcrctgtgttagataccgaggactaaa

SEQ ID NO: 100997 - DNA, 50 bp, homo sapien
tcttgattatgataagaaatattaaygctgtagtagacaaaattaatgtt

SEQ ID NO: 100998 - DNA, 50 bp, homo sapien
ctgcgatatcaggactaagtaccggsaaccaggatgctagacaaagtggt

SEQ ID NO: 100999 - DNA, 50 bp, homo sapien
atgggacagtcatcaaaggacaggarcgggctgttgcctgctctaagtat

SEQ ID NO: 101000 - DNA, 50 bp, homo sapien
tccaaaacacactgagcaaaattacraaaatgtagcttcaaacatacctt

SEQ ID NO: 101001 - DNA, 50 bp, homo sapien
attggtagcattttaggagccataastgacaaggaacaggatttttagtg

SEQ ID NO: 101002 - DNA, 50 bp, homo sapien
gaaaagagacataataaccgcataaygatcaaaagaaatttgaaacgaat

SEQ ID NO: 101003 - DNA, 50 bp, homo sapien
gaataatgggtatctattgttaaaartaatagtgatcatggtgaagttaa

SEQ ID NO: 101004 - DNA, 50 bp, homo sapien
tcttaaggttatcatgacctaggaarttaggaacagggaatgaacaatgt

SEQ ID NO: 101005 - DNA, 50 bp, homo sapien
gaagtacctgctcagcctctcttggwatatgggaccaccacaaagtctct

SEQ ID NO: 101006 - DNA, 50 bp, homo sapien
aaataagaagtcaatgacaaaatctraaaatttattgggcttatattttg

SEQ ID NO: 101007 - DNA, 50 bp, homo sapien
aaattatggataatttcatacatacycattagtagagagaatagtagcat

SEQ ID NO: 101008 - DNA, 50 bp, homo sapien
gaagaagcctttgagacttaggtaayataacgactgatagttattgccct

SEQ ID NO: 101009 - DNA, 50 bp, homo sapien
cgtcccattctgcagacttgcctcaratgaactctattgtcagctaagaa

SEQ ID NO: 101010 - DNA, 50 bp, homo sapien
aaatgattatagaatttacttccacygagtatattaaaagaatagataat

SEQ ID NO: 101011 - DNA, 50 bp, homo sapien
gcacttactggaatgccttataagayaggattttggttactaggcaagcc

SEQ ID NO: 101012 - DNA, 50 bp, homo sapien
ctgtagtttggcattcataataaaaragaagcagtaaaagaaaacaaaaa

SEQ ID NO: 101013 - DNA, 50 bp, homo sapien
acatctcagaaaacttctaccaaaaygacagaaaagataaataatatgca

SEQ ID NO: 101014 - DNA, 50 bp, homo sapien
ccaaatgtaaaccttaagactttcargagaaaatatgaaaattattattt

SEQ ID NO: 101015 - DNA, 50 bp, homo sapien
gataacagtatagatcctcattagarcgacacaaagaaaataccatgaac

SEQ ID NO: 101016 - DNA, 50 bp, homo sapien
cttaatgttttcttaattttagtgargtaatacatccatgtaactttaaa

SEQ ID NO: 101017 - DNA, 50 bp, homo sapien
aactattagataattaatattctcartacaaccattctatctttaattag

SEQ ID NO: 101018 - DNA, 50 bp, homo sapien
aaaatggtacatacagctcctgtatwaaaaaaacaggtcagagtggagcc

SEQ ID NO: 101019 - DNA, 50 bp, homo sapien
aaccctcacaggctaatttttaaacyacatctcttaagaaaatatggaga

SEQ ID NO: 101020 - DNA, 50 bp, homo sapien
aattattttaaaaattacaccagtcrttcaaaaatacatgacaatatatg

SEQ ID NO: 101021 - DNA, 50 bp, homo sapien
gttttaatggtggttagttgcttagrttgggtcgtgttttccaatgcaca

SEQ ID NO: 101022 - DNA, 50 bp, homo sapien
tcagtacaaatcttacttgttcaaawacatgttccttaactttgtacaac

SEQ ID NO: 101023 - DNA, 50 bp, homo sapien
aatcaatgcagagccttttagaaaayggaaagaagattatactttattct

SEQ ID NO: 101024 - DNA, 50 bp, homo sapien
ggatttctggtgtgcccaattcacakcatttccaaacctggcaaagacag

SEQ ID NO: 101025 - DNA, 50 bp, homo sapien
aaaaaagagaggactatcctgaaaaygataaattatgctgtgaatagaga

SEQ ID NO: 101026 - DNA, 50 bp, homo sapien
tctgtgatgtggaataggatgtaacragattaactcacaataggtgggac

SEQ ID NO: 101027 - DNA, 50 bp, homo sapien
attcctttcttgctgattgctgatcrctaggttggctccctgataccctg

SEQ ID NO: 101028 - DNA, 50 bp, homo sapien
cattatttgcaagtaacctgctaggraccataaattgaaaggagaatagc

SEQ ID NO: 101029 - DNA, 50 bp, homo sapien
tctataaattggataaatttttccarggtgttgtcttgtctttcttgtta

SEQ ID NO: 101030 - DNA, 50 bp, homo sapien
acattagcataaaactccatttgaaraaaacaatcattctccaagcttat

SEQ ID NO: 101031 - DNA, 50 bp, homo sapien
ataggtacaagagctcatttttggaygtagggtagcattaatatttggcc

SEQ ID NO: 101032 - DNA, 50 bp, homo sapien
catggccaggtaggtgagtcatgtayagtataaaggattatactattgtt

SEQ ID NO: 101033 - DNA, 50 bp, homo sapien
tctaatcgaacattctaaatgagcamaaaacatagtaaaaaataaaaaat

SEQ ID NO: 101034 - DNA, 50 bp, homo sapien
atagctagagtctggaataaaaatawgttatctaacggtgaagtttggtg

SEQ ID NO: 101035 - DNA, 50 bp, homo sapien
gatctcaggcttttttcctctattaygctcatgatattcacactaataac

SEQ ID NO: 101036 - DNA, 50 bp, homo sapien
tctaaagttaatatgttattaacacmcagtcttaaaataagtgagtagct

SEQ ID NO: 101037 - DNA, 50 bp, homo sapien
atttgagcccagggctggctgatctsaaagcccaagttgatgattgtaat

SEQ ID NO: 101038 - DNA, 50 bp, homo sapien
agcataaaggtctaaattagactaamcatttttccttcaattacactcct

SEQ ID NO: 101039 - DNA, 50 bp, homo sapien
tatcattacttctgggaaacttcacygctttccaatagctaaaaccagga

SEQ ID NO: 101040 - DNA, 50 bp, homo sapien
aatatctaaactgaatctactgtaastctaaaaattgttaagggtgatat

SEQ ID NO: 101041 - DNA, 50 bp, homo sapien
aaatattactgtatttgcagataggrcctataaagaggaaattaaattaa

SEQ ID NO: 101042 - DNA, 50 bp, homo sapien
gggtaactgcctcagccaagtttgakaaaagaagcagattttgccctttg

SEQ ID NO: 101043 - DNA, 50 bp, homo sapien
aggacatatactcctgttcatctgargttaagttttgatttgatctgacc

SEQ ID NO: 101044 - DNA, 50 bp, homo sapien
gaagttaggaaagctgactttcttaygtgacagaaaacctttgcagcttt

SEQ ID NO: 101045 - DNA, 50 bp, homo sapien
attaggctaaacttctcagttgtaawcttcattcatctcaggatatagtc

SEQ ID NO: 101046 - DNA, 50 bp, homo sapien
ttttctgagacctttctatcaatcargctacagatccagataggacacat

SEQ ID NO: 101047 - DNA, 50 bp, homo sapien
tcatcctcactgtccttcattaaaayttgttaagaatatcagccattgca

SEQ ID NO: 101048 - DNA, 50 bp, homo sapien
cccaccatcaactctatttgacagasagaggaaattaaagctcagacaga

SEQ ID NO: 101049 - DNA, 50 bp, homo sapien
ttcctgaggaaggattgagactagartcaagagacgtttaatggccactc

SEQ ID NO: 101050 - DNA, 50 bp, homo sapien
gagagaaaacacaatcgaaacctctsaaacacaagcgaaaaccataggaa

SEQ ID NO: 101051 - DNA, 50 bp, homo sapien
tccttctgatgtttggatgtgttccragtttcttccttctggtgggttgg

SEQ ID NO: 101052 - DNA, 50 bp, homo sapien
ctaactggcctacaacacttatagckcactctcaggtagcctagcaacaa

SEQ ID NO: 101053 - DNA, 50 bp, homo sapien
tggtaagtatcaggaagaaaataaayggggtgatgaatcagggaatactg

SEQ ID NO: 101054 - DNA, 50 bp, homo sapien
gtaagaataaatgagataatgcccargaaatggtaagcaccccatggaga

SEQ ID NO: 101055 - DNA, 50 bp, homo sapien
ttgtctaagatggtaacatttaagaraaaatagtaggatctagccatgtg

SEQ ID NO: 101056 - DNA, 50 bp, homo sapien
gcagatatgtaaatccctgctcttgmatcgatccgacattaaaggcgatg

SEQ ID NO: 101057 - DNA, 50 bp, homo sapien
cacgtgcattgacctgacattaaaaraacgaggtggctgtgagctgtact

SEQ ID NO: 101058 - DNA, 50 bp, homo sapien
gattctggtttaagcatgagatctgyagcaatgacattttctaaaatagc

SEQ ID NO: 101059 - DNA, 50 bp, homo sapien
atttccattttttggctttggaggayggccatgttactcttctagaggcc

SEQ ID NO: 101060 - DNA, 50 bp, homo sapien
atttttttttaaatcctttttatccrgttgttctcaagggattccacccc

SEQ ID NO: 101061 - DNA, 50 bp, homo sapien
ggaatcatgacccccagctcttaagraactcataatctagtagaggggac

SEQ ID NO: 101062 - DNA, 50 bp, homo sapien
gtaagaaatagaaaggcttgttagcrtaagccactgagttttgtagttgt

SEQ ID NO: 101063 - DNA, 50 bp, homo sapien
atggttcaggcaaccaacgaaaaaawttcctgatgccaaaagagcaaata

SEQ ID NO: 101064 - DNA, 50 bp, homo sapien
tgctgagaactttcttcttcttaccrtcctatgtacagcttccagaataa

SEQ ID NO: 101065 - DNA, 50 bp, homo sapien
gctaacgatgtcctgctaatgtaaaygtaaatgagcctgaagtagtggct

SEQ ID NO: 101066 - DNA, 50 bp, homo sapien
aggaattgtgctaaaatggattgccsaaatggcacttaagcctctccact

SEQ ID NO: 101067 - DNA, 50 bp, homo sapien
tgttcctctatgggcataatgtaacrggtctaaacataagcaatggcctt

SEQ ID NO: 101068 - DNA, 50 bp, homo sapien
tgttctatttgcccatattcctatcrcatgttggtctttactgtcaagac

SEQ ID NO: 101069 - DNA, 50 bp, homo sapien
ttgagagaagacctttgtaataatayatttgagaaaggagttcattctag

SEQ ID NO: 101070 - DNA, 50 bp, homo sapien
acatattgttgtgccagccaggcackgaattaagcaacatatcatctcac

SEQ ID NO: 101071 - DNA, 50 bp, homo sapien
tttaccgtaaaggctttcttacaagyatgctatctgtaaacctttttaaa

SEQ ID NO: 101072 - DNA, 50 bp, homo sapien
agatgataatgtactggaattcacaygcttactgaacttcaacctatgtc

SEQ ID NO: 101073 - DNA, 50 bp, homo sapien
atctgaactaatcaacgaagcagccrcatcataatggagtgctatagcta

SEQ ID NO: 101074 - DNA, 50 bp, homo sapien
gcaacaggctctgtggctggataacyctggaagcagaaattccaaacaga

SEQ ID NO: 101075 - DNA, 50 bp, homo sapien
caaaccgtagtcataggtgtgccaarttattgatatttgttgaatccagg

SEQ ID NO: 101076 - DNA, 50 bp, homo sapien
cacactagtgcaggtagagtgattamcacagtccctggtatactgtaaat

SEQ ID NO: 101077 - DNA, 50 bp, homo sapien
tgcttatgtttgagggaacagtaacyctttggccagtgaaccaggctgac

SEQ ID NO: 101078 - DNA, 50 bp, homo sapien
gatggcttttcgagtattattctcargcacttggactgattctccatgat

SEQ ID NO: 101079 - DNA, 50 bp, homo sapien
gtatacgaatctgcatataattaacratatgaaaaaacacaggttacact

SEQ ID NO: 101080 - DNA, 50 bp, homo sapien
acttgttaggtggctaccattcctcrctgtgaaatgtaaggaaaaactta

SEQ ID NO: 101081 - DNA, 50 bp, homo sapien
ttcctttttgctcatttcagtatcargtatagagaaaagaaatacgatac

SEQ ID NO: 101082 - DNA, 50 bp, homo sapien
cttactcaggagaagccacatcttcrcttcctttcagaatatcctcttga

SEQ ID NO: 101083 - DNA, 50 bp, homo sapien
ttggcagacatcactggaattataayagacatgtgctcagaaaaggaaaa

SEQ ID NO: 101084 - DNA, 50 bp, homo sapien
tggtcagagatcttgctctcaccagmacattttatacaggtcgtttgtcc

SEQ ID NO: 101085 - DNA, 50 bp, homo sapien
acaatgaatagtgtctgattcaaaartaaaaggtgttagcatgcagacag

SEQ ID NO: 101086 - DNA, 50 bp, homo sapien
agcctcataccaaagacaatgattakaaagagccaaatgaactgtgctga

SEQ ID NO: 101087 - DNA, 50 bp, homo sapien
aacacatttaaaatttgttgtcataraatgtaattgtgaaaaagtcctaa

SEQ ID NO: 101088 - DNA, 50 bp, homo sapien
tttaacataactaaaagaatataacygcattgactgtaacacaaaggatg

SEQ ID NO: 101089 - DNA, 50 bp, homo sapien
tgagctaaaaaaatagcagtaaaaayttatcactgataagctattaaact

SEQ ID NO: 101090 - DNA, 50 bp, homo sapien
actgtaagtaaagtgataaaacccarcaaatcatcgattaggagttcacc

SEQ ID NO: 101091 - DNA, 50 bp, homo sapien
tcaaaacatacaagcaacagcaaaarccctaacttcttatacgtctagcc

SEQ ID NO: 101092 - DNA, 50 bp, homo sapien
ttgggctgtaatattaagagtattgwctccttcatgcactacttctaatt

SEQ ID NO: 101093 - DNA, 50 bp, homo sapien
aattgcagggatgtgctgaacagccrcagaaataactaaagtaaaagtgg

SEQ ID NO: 101094 - DNA, 50 bp, homo sapien
agatagatctagtcccaggctcagtwaaattcggggacatggactttatc

SEQ ID NO: 101095 - DNA, 50 bp, homo sapien
ggttatatcttaattttgtgggagakataataatgtacattgttatttgg

SEQ ID NO: 101096 - DNA, 50 bp, homo sapien
actccaaagtcaagtgagtaaaacckcaggcaagataccctgaaaactct

SEQ ID NO: 101097 - DNA, 50 bp, homo sapien
tcagaaaagattaaagccttgggaawtgacttgcatgtggacataaaagg

SEQ ID NO: 101098 - DNA, 50 bp, homo sapien
atctagagaatgggatccagctctcrcctcaaatgaaacacaggtgctga

SEQ ID NO: 101099 - DNA, 50 bp, homo sapien
aaggcctacaggcaggtgtctgtcastatccaaacaatgcaaacaagaaa

SEQ ID NO: 101100 - DNA, 50 bp, homo sapien
ccagcagctgcccaaccttagtcaastaactgaccctctctaggactggg

SEQ ID NO: 101101 - DNA, 50 bp, homo sapien
gcagaaatcaagtgttacgatgctayactactgggaaaagtaaattccat

SEQ ID NO: 101102 - DNA, 50 bp, homo sapien
cccaggatgcttggaatgattgttcygagggttttgtaaaatgccagggg

SEQ ID NO: 101103 - DNA, 50 bp, homo sapien
tagaactatatagaagctccctagawcctgtttataattcacctcccctc

SEQ ID NO: 101104 - DNA, 50 bp, homo sapien
ccctgacaaggctgttctgcataccmaagatttcttctgagagcggtaat

SEQ ID NO: 101105 - DNA, 50 bp, homo sapien
actaatgaaattgtgaaagtatagtygtcctttaaatgtttgtgcctgaa

SEQ ID NO: 101106 - DNA, 50 bp, homo sapien
tctaaggtggattgcagtgtttaaawttatgattattcactgtccaaaat

SEQ ID NO: 101107 - DNA, 50 bp, homo sapien
cactgttaacaagaatgaaaagtcargtgctgaatgggagaaaacatttg

SEQ ID NO: 101108 - DNA, 50 bp, homo sapien
ggggggtgaccagagcctaggatcasaatgataaatagagaccatcttac

SEQ ID NO: 101109 - DNA, 50 bp, homo sapien
cgacttggattctacacttgcacacrgtaaagattccatgtcaaaggact

SEQ ID NO: 101110 - DNA, 50 bp, homo sapien
gttcttcttattcttaccaataacascagctatgtttttttgaacatctg

SEQ ID NO: 101111 - DNA, 50 bp, homo sapien
aatgaatgtgtgaatagaaatagaamatcgaaaagcaattctatatactc

SEQ ID NO: 101112 - DNA, 50 bp, homo sapien
gaaggatttcttctaagaattgaaawgaggaggcacatggttttaccagt

SEQ ID NO: 101113 - DNA, 50 bp, homo sapien
ttcattagtaatgcttgtaggcatayatgtactttaacattaaactttta

SEQ ID NO: 101114 - DNA, 50 bp, homo sapien
aattttttggtgaagtggccattagraatcttcaaagaaagagatgggca

SEQ ID NO: 101115 - DNA, 50 bp, homo sapien
gcttgtgtctgtcagcacatcccaamtgctcaatagatagtagggatgat

SEQ ID NO: 101116 - DNA, 50 bp, homo sapien
tcttaggtctgttgggaaattgtagygccttctaaaaaaacttgatgttg

SEQ ID NO: 101117 - DNA, 50 bp, homo sapien
tctgaactagaaagatggccaggcasaagccaatactgaattaatttccc

SEQ ID NO: 101118 - DNA, 50 bp, homo sapien
aactctcttggattctatattctctyagacattacattttcatgctttga

SEQ ID NO: 101119 - DNA, 50 bp, homo sapien
ttggaactgtggggtgttcaccgaaygtgtaataaatagcaggcttttgt

SEQ ID NO: 101120 - DNA, 50 bp, homo sapien
acgaagaaaagggaagattgatcagyacgtgttagaggttaagaaaattt

SEQ ID NO: 101121 - DNA, 50 bp, homo sapien
taagacacaagtccaatgaatggtaractgtagatgccttctttatttcc

SEQ ID NO: 101122 - DNA, 50 bp, homo sapien
cacttgtttctatttatattatctcyctgcacaaaactctaaaatgcaag

SEQ ID NO: 101123 - DNA, 50 bp, homo sapien
cagagatgtccacatcttcattttcraatctgaatacgttaagttacatg

SEQ ID NO: 101124 - DNA, 50 bp, homo sapien
ctttctaccttttcttaaacaaagawctggcaacacaggacccaaattct

SEQ ID NO: 101125 - DNA, 50 bp, homo sapien
cacatttcattgtataatataaaaamatcacatctattaatatcaccact

SEQ ID NO: 101126 - DNA, 50 bp, homo sapien
tgagggtggcggtttgcacgaacagsatggatttcccctgctcttgtacc

SEQ ID NO: 101127 - DNA, 50 bp, homo sapien
tagattggctaatggcactggggcartaagtttgatttaaaaaatttttt

SEQ ID NO: 101128 - DNA, 50 bp, homo sapien
gagccgggattacccactgacattawagctggcagccgtgggctgttggc

SEQ ID NO: 101129 - DNA, 50 bp, homo sapien
acaccacactccccagctttatcaaygggtccaaagttcctttgagaaga

SEQ ID NO: 101130 - DNA, 50 bp, homo sapien
gataatcctgtatccatgtgctcaaygaaggagagtatggtgcatatgag

SEQ ID NO: 101131 - DNA, 50 bp, homo sapien
acaagattaaatatttagatcattayagcggagtctggtctaaattctac

SEQ ID NO: 101132 - DNA, 50 bp, homo sapien
cagcatccccactttccaggtagcamgataaaggtcacccaaggtggcat

SEQ ID NO: 101133 - DNA, 50 bp, homo sapien
cataatggaaacaaatgttacatctsaaagctaaatgaaaaaaatgtata

SEQ ID NO: 101134 - DNA, 50 bp, homo sapien
agagatgttgagccagagaatcctgytaagcaatacccagattcttgacc

SEQ ID NO: 101135 - DNA, 50 bp, homo sapien
caatgagggatgcgtatctgaatacygagagctttaaaaaaaaaacagat

SEQ ID NO: 101136 - DNA, 50 bp, homo sapien
aaccaccacactcggccagaattccrcatttttattattagattctcttt

SEQ ID NO: 101137 - DNA, 50 bp, homo sapien
tgccttggggacagttagaatttacrccaccccaatcgtgaggtcaggag

SEQ ID NO: 101138 - DNA, 50 bp, homo sapien
tgggcacctttgcacaaaccaaacayagtaaggacgttgcagtgtccaaa

SEQ ID NO: 101139 - DNA, 50 bp, homo sapien
cttcatgcgagaatgatagtgcccaygtttagaagggaccatagggaatg

SEQ ID NO: 101140 - DNA, 50 bp, homo sapien
atatcaccccggactgtaggcattawctttgaattctatgctctaagtaa

SEQ ID NO: 101141 - DNA, 50 bp, homo sapien
gtatgatgcctaggatctagcaggasttcaatgtacattgcatatctctc

SEQ ID NO: 101142 - DNA, 50 bp, homo sapien
tatgtggtggctcataagattcaacwcctcttctactcctgctgccacta

SEQ ID NO: 101143 - DNA, 50 bp, homo sapien
tgaacacattgatgattttaaagcartgagactagatgagagtgtagaca

SEQ ID NO: 101144 - DNA, 50 bp, homo sapien
attttaaccatgaaatcaaagaacartaatatcttagaaaatcaaaaata

SEQ ID NO: 101145 - DNA, 50 bp, homo sapien
gactaagatgtctggactttacacartaagacctaagaagtaataggtct

SEQ ID NO: 101146 - DNA, 50 bp, homo sapien
gacagaggtgtgagatttagttcatyacagccaggggtaggagagagggt

SEQ ID NO: 101147 - DNA, 50 bp, homo sapien
gttatatatagtgaggacactgttasaataaggtgagtgcattgttacag

SEQ ID NO: 101148 - DNA, 50 bp, homo sapien
cggcagtatatgaattctaaccacaygtatggtaaccatggacttcacaa

SEQ ID NO: 101149 - DNA, 50 bp, homo sapien
ttctaccttagcaaaccacctaacckctgggctggaaacaaggggcaagt

SEQ ID NO: 101150 - DNA, 50 bp, homo sapien
aaggctgaaacgtgagaatgtggtarcttaattttctccatcactccaaa

SEQ ID NO: 101151 - DNA, 50 bp, homo sapien
agagatccataactggacaaagggarataaagtaatcatgtaatgcaaga

SEQ ID NO: 101152 - DNA, 50 bp, homo sapien
ttataaaacaagggttgagctaaccrataaactgaatttctggacatgcc

SEQ ID NO: 101153 - DNA, 50 bp, homo sapien
gcctccatggtgctgtgcaactctgracggattacattacctctctgggc

SEQ ID NO: 101154 - DNA, 50 bp, homo sapien
tttaaccatatctttgtgggagaacrgttactatgatgaacatgaaatct

SEQ ID NO: 101155 - DNA, 50 bp, homo sapien
aaccttgagattcatgaaaacatcaracttctgttttaaatacagatgtt

SEQ ID NO: 101156 - DNA, 50 bp, homo sapien
ctgtccaggacatcttaagccaatcyactggcaccttctcacctgacatt

SEQ ID NO: 101157 - DNA, 50 bp, homo sapien
ctcatctcttgcctggattatcaggwttatcacaattgcctcctaactca

SEQ ID NO: 101158 - DNA, 50 bp, homo sapien
ggtggcttttttttcctagttaagtsaatttagctttaaggaaaacccac

SEQ ID NO: 101159 - DNA, 50 bp, homo sapien
aaggtaaattactttaaagctcagascgtcaggtatcccaaggagagacg

SEQ ID NO: 101160 - DNA, 50 bp, homo sapien
attctagagctcttaattgaacaaaytctcttgattagcttaaacaatgc

SEQ ID NO: 101161 - DNA, 50 bp, homo sapien
ctatttattcattgctttagagcccrcacctagcccagtataggggatac

SEQ ID NO: 101162 - DNA, 50 bp, homo sapien
agatgaatattgaaaagagttaatamattgcattcccttttcctagaacc

SEQ ID NO: 101163 - DNA, 50 bp, homo sapien
ttggcagggtgatgagataagtgtasgtgaagcagaacaaggcgttccaa

SEQ ID NO: 101164 - DNA, 50 bp, homo sapien
tctctttgttttaccttctaccttcmaatgataaatagccttagagattt

SEQ ID NO: 101165 - DNA, 50 bp, homo sapien
tatcacaatgtacattattttgaaasacaatactggtgggggtaagggaa

SEQ ID NO: 101166 - DNA, 50 bp, homo sapien
tctagagacgatgtcttcagattaasttgaaaaccactccccttttcact

SEQ ID NO: 101167 - DNA, 50 bp, homo sapien
agcaagagaagtaactgaattcttayatatcaaaatgaataattttaccg

SEQ ID NO: 101168 - DNA, 50 bp, homo sapien
tatgtggcagatagattttgtcccgwccaacattctctcctctccttatc

SEQ ID NO: 101169 - DNA, 50 bp, homo sapien
taacaacgtcacctgggtatctctaygcacagcgaagtttcggaggcact

SEQ ID NO: 101170 - DNA, 50 bp, homo sapien
ttcatatcattaggctcaaattaagwaaataacagaatcctaagctgatg

SEQ ID NO: 101171 - DNA, 50 bp, homo sapien
taaaaacaaatcagtgcagatactgkgttttccgtccaacagtagagcag

SEQ ID NO: 101172 - DNA, 50 bp, homo sapien
ttgttagtagaaagacacaagtaatraaaacctggtctcaaattcaaggg

SEQ ID NO: 101173 - DNA, 50 bp, homo sapien
aaaaaaaagcgtattaatctctcaasactacatgtgaaacacagaatcac

SEQ ID NO: 101174 - DNA, 50 bp, homo sapien
tacacatgctacttaactcctttgarctttaatgtttttcacctatataa

SEQ ID NO: 101175 - DNA, 50 bp, homo sapien
gcatcatgggacattctgtttcatckctttcctatagtccagcaacagcc

SEQ ID NO: 101176 - DNA, 50 bp, homo sapien
attaattaattaggacaaatattggyagccaagcaacttagtatttgctg

SEQ ID NO: 101177 - DNA, 50 bp, homo sapien
cagaaggctactatgaactcagcaayacctttaaatgtattttaattgca

SEQ ID NO: 101178 - DNA, 50 bp, homo sapien
gcagagatggcttccttctttctcartaggggtttggcatttttttgaat

SEQ ID NO: 101179 - DNA, 50 bp, homo sapien
caacctcatcttttatgtcacttaartaattaaaacgcttctcattgaat

SEQ ID NO: 101180 - DNA, 50 bp, homo sapien
tacttgtctttcttagctattaactytcaattactagacatttagggagt

SEQ ID NO: 101181 - DNA, 50 bp, homo sapien
gacaatagcatcagacattcacttasaacactgcattaatttaaatggtt

SEQ ID NO: 101182 - DNA, 50 bp, homo sapien
caccagaagtcccaggcatcacatcsaagtatagcaatgtccagaagagg

SEQ ID NO: 101183 - DNA, 50 bp, homo sapien
caaattatcacacaccagttacacaygggttttcagattttaagaaattg

SEQ ID NO: 101184 - DNA, 50 bp, homo sapien
tttttaaagtggcaaaatgtggctaygaaattatatcaatgtttcattct

SEQ ID NO: 101185 - DNA, 50 bp, homo sapien
ctcaaatgagagaaaaatctgggaaraagttatcctatgtttgaagggag

SEQ ID NO: 101186 - DNA, 50 bp, homo sapien
tcttgagatgaccaaggatagcatgyaacattaactcacgtatttattca

SEQ ID NO: 101187 - DNA, 50 bp, homo sapien
aaagagggagatccccttaaatcgakaagaccattaatgcagtgctattt

SEQ ID NO: 101188 - DNA, 32 bp, homo sapien
tgaggttgggagaggtraagtgatctctcatg

SEQ ID NO: 101189 - DNA, 50 bp, homo sapien
ttaatttacttactgtctctctacaytcaccaaattataagcattataag

SEQ ID NO: 101190 - DNA, 50 bp, homo sapien
agccacaaagttaccaagtcaagaasaagaacacaaagcaatgtctattt

SEQ ID NO: 101191 - DNA, 50 bp, homo sapien
tccaggtaatctcccatcagtggaamtctctcaccttctctttaagcacc

SEQ ID NO: 101192 - DNA, 50 bp, homo sapien
tatgaacatcttccctttctttatarcatctacctcagtttctttattaa

SEQ ID NO: 101193 - DNA, 50 bp, homo sapien
gttgtcagtgaccaatagaatgatcmatgcctttaggtctagggtccagg

SEQ ID NO: 101194 - DNA, 50 bp, homo sapien
taatttttgatcccaaatcagtaacrgaattgtcagaacagttcttgctc

SEQ ID NO: 101195 - DNA, 50 bp, homo sapien
aagtcaatgtagtcattcactgaacragtatttcttgaatgccttatata

SEQ ID NO: 101196 - DNA, 50 bp, homo sapien
atttcccagaggaatagccatattgyttcactctcattttttgataggga

SEQ ID NO: 101197 - DNA, 50 bp, homo sapien
aaattcccgctgttgattaaacaggscagagtagctgtggaccagaattg

SEQ ID NO: 101198 - DNA, 50 bp, homo sapien
gaagaagccatcattccaacacttcratttagacctcggagaaaataaat

SEQ ID NO: 101199 - DNA, 50 bp, homo sapien
cctattgcaatagctgggcctcaccragattgtcccaggtgaagttggtt

SEQ ID NO: 101200 - DNA, 50 bp, homo sapien
gggggcagaaaatgtacatctttagratcatagggagaaagaaggaaact

SEQ ID NO: 101201 - DNA, 50 bp, homo sapien
gaaagcgtatttaggaattgactacrcaggaatacagaaatagcaaataa

SEQ ID NO: 101202 - DNA, 50 bp, homo sapien
aaagatatccaaaatttctaggcaaygagaatcagggatgagggaaatac

SEQ ID NO: 101203 - DNA, 50 bp, homo sapien
atctacccctggttaatatccatgaygtttagacatatatttttggtcta

SEQ ID NO: 101204 - DNA, 50 bp, homo sapien
attctctgcaggtctttctcccttaragctatctccctactcctacctta

SEQ ID NO: 101205 - DNA, 50 bp, homo sapien
tctactatctcttagccaaatttcaytccctgggcttcttcctgccttaa

SEQ ID NO: 101206 - DNA, 50 bp, homo sapien
tgaatggcaatgtgaggtttcgacaygaaaagtatcagctctccaagaaa

SEQ ID NO: 101207 - DNA, 50 bp, homo sapien
attgaggattctggatacacaatcartatatttaaaagctagtagaattc

SEQ ID NO: 101208 - DNA, 50 bp, homo sapien
gggctccacccctcatccacctgcartaaagcagaaaagcctcattgaaa

SEQ ID NO: 101209 - DNA, 50 bp, homo sapien
tttaaagaaacgaagaaattttttamagtcatctctaggtctgtttctat

SEQ ID NO: 101210 - DNA, 50 bp, homo sapien
cagcctctttttcttgtttcatataraacagtgtgctattctttttgctt

SEQ ID NO: 101211 - DNA, 50 bp, homo sapien
gtatatggttttggagaacagaatcraaggtgaaaaaaggacagaagcaa

SEQ ID NO: 101212 - DNA, 50 bp, homo sapien
tcaaaacaattctcaagaagattaarctgatcggccaataaattaggcat

SEQ ID NO: 101213 - DNA, 50 bp, homo sapien
caagagcatggcgatgtgtaccaaaygtaaagcatgtgattgagaactca

SEQ ID NO: 101214 - DNA, 50 bp, homo sapien
ttagggaaaatacagctttgcatacyaggtttacttctctgggttctcat

SEQ ID NO: 101215 - DNA, 50 bp, homo sapien
ttactctcttattagctctttgatayatttaagatgttattttccatata

SEQ ID NO: 101216 - DNA, 50 bp, homo sapien
acttcactctccgctcaaattgcaamatgaacaagagacaggtgttcatg

SEQ ID NO: 101217 - DNA, 50 bp, homo sapien
tggaattctcttgctttctacattgwatccaaacaactcagtggtggtga

SEQ ID NO: 101218 - DNA, 50 bp, homo sapien
atttggatttatcagtgcgtagaaaytcatgatgtttaacttaaaggcaa

SEQ ID NO: 101219 - DNA, 50 bp, homo sapien
ttacccatcagatatttggtgaaggractgatgcatgatgggctctagac

SEQ ID NO: 101220 - DNA, 50 bp, homo sapien
acaggatttccttcaggacaagatcratttatcatgaccacttagatttt

SEQ ID NO: 101221 - DNA, 50 bp, homo sapien
tggcaatgtacactggcttagatgascttttcctcaatatttgtgtattc

SEQ ID NO: 101222 - DNA, 50 bp, homo sapien
caagaagtgcttgttccttggaatascaggataggcagttgttagcacat

SEQ ID NO: 101223 - DNA, 50 bp, homo sapien
tgtgatttgcatacatatatgacagrataaaataattgcaagagaactag

SEQ ID NO: 101224 - DNA, 50 bp, homo sapien
tagagtgctatgccaaactcctttgyagaataagaaaaattataacaagc

SEQ ID NO: 101225 - DNA, 50 bp, homo sapien
tgctcacttactgtgctagcattgaygttgagagttcacagatgtttcag

SEQ ID NO: 101226 - DNA, 50 bp, homo sapien
aaaattgttaataattatcaagtgamctgaaattggcactctgtcaaccg

SEQ ID NO: 101227 - DNA, 50 bp, homo sapien
tccagagttacagccatattaacagrttcacaagctctggccagtagtac

SEQ ID NO: 101228 - DNA, 50 bp, homo sapien
gttaatatggctgtaactctggatgwctgatatgggttattttctcaaag

SEQ ID NO: 101229 - DNA, 50 bp, homo sapien
gtaaatgcagttatacaataatcacrggaatactctaaacactgtcacac

SEQ ID NO: 101230 - DNA, 50 bp, homo sapien
ttaatcaaggtgattatttaagcctyagttcctatgtctacaaatagaga

SEQ ID NO: 101231 - DNA, 50 bp, homo sapien
tgtaccaagtagagacaggaggatcrggtagaataatactcagcatgtga

SEQ ID NO: 101232 - DNA, 50 bp, homo sapien
ggtatatgtgtagtttgctaagttaygaaatctgaagatgactcactgaa

SEQ ID NO: 101233 - DNA, 50 bp, homo sapien
ctgcttaggagggctgggccggcctractgagttcacatccatgctctgc

SEQ ID NO: 101234 - DNA, 50 bp, homo sapien
acagtgttatttttacaaaacttcckcgtgtgattatattgtaaaaccag

SEQ ID NO: 101235 - DNA, 50 bp, homo sapien
gatgctccacgaaaaaacaagtccarggtgaaatagtgttaagaaagtct

SEQ ID NO: 101236 - DNA, 50 bp, homo sapien
gtaaaccaatagtataaaccacacaytaaacaaatttctaggttcatgca

SEQ ID NO: 101237 - DNA, 50 bp, homo sapien
atttttggaatatgatcaaattttgygaagataagaataactctttttta

SEQ ID NO: 101238 - DNA, 50 bp, homo sapien
aggagcagatgtagaaggggtttgakttgagccaggatgggaaagatggt

SEQ ID NO: 101239 - DNA, 50 bp, homo sapien
ggcaactgtgatttgattgctgggaygcatgtttatcttgtccactacat

SEQ ID NO: 101240 - DNA, 50 bp, homo sapien
gagtcaattaaacctcataattaaamcttcgtaaagtaatcagtcgcagg

SEQ ID NO: 101241 - DNA, 50 bp, homo sapien
gccagatcatatctacacgtgaggaraatgggtttcatgtggaaaatttc

SEQ ID NO: 101242 - DNA, 50 bp, homo sapien
tggcatgaattcatatgttatcagcwagtactatagatgaacttcttttg

SEQ ID NO: 101243 - DNA, 50 bp, homo sapien
tgtgacacacagcctgccttatgtcragaactgtcagagaggacaaggag

SEQ ID NO: 101244 - DNA, 50 bp, homo sapien
atattatcatttagccttcgctattktttttaacatgtcctcagaaaaaa

SEQ ID NO: 101245 - DNA, 50 bp, homo sapien
atatctccaaccattagacatttccractgaataccataaaagcatttca

SEQ ID NO: 101246 - DNA, 50 bp, homo sapien
cactcattctttcattcattggtcaygtattacttaaaatgtggttatat

SEQ ID NO: 101247 - DNA, 50 bp, homo sapien
tcaacagcctgatgtgcataggtacrcagttagcccatgccctctagtgt

SEQ ID NO: 101248 - DNA, 50 bp, homo sapien
agatcaaatgcacaacttgaggactktaagtaacacaattgtactgtatc

SEQ ID NO: 101249 - DNA, 50 bp, homo sapien
tgtcaatttggaaatctggaaatcaygtcaggaagaataaggaaactaag

SEQ ID NO: 101250 - DNA, 50 bp, homo sapien
gagaaacatgcctggggcagactaaygccatatacatgtttgataattgc

SEQ ID NO: 101251 - DNA, 50 bp, homo sapien
ttcttgctctgcaacttagaagataygtatgttggtcaagtaactaaacc

SEQ ID NO: 101252 - DNA, 50 bp, homo sapien
ctacgtaatttacatttattgcaagmatttatagactagttaaaaaggca

SEQ ID NO: 101253 - DNA, 50 bp, homo sapien
tttaaaattttgaatatctacaccayggtggtttgtaagttagcttccct

SEQ ID NO: 101254 - DNA, 50 bp, homo sapien
ctgaagatcattttctacaactttargtgtaagaggatgtaaatggtatt

SEQ ID NO: 101255 - DNA, 50 bp, homo sapien
tccaagggaccaaaagaagccatagwatgtgtgggcaggtgtaggcgtga

SEQ ID NO: 101256 - DNA, 50 bp, homo sapien
cccccttttactcttgggtttcttaraatgtctcagtgcacatcttctaa

SEQ ID NO: 101257 - DNA, 50 bp, homo sapien
gtccaatcctgggaatatgccacgaygaaaagacacacagaagcccttgt

SEQ ID NO: 101258 - DNA, 50 bp, homo sapien
tgaaattttctcactaagaatcaaaygaatggttattttctctagaaact

SEQ ID NO: 101259 - DNA, 50 bp, homo sapien
aaactggtgtaatagctcaaaagaaytaagtattccagatttcgggaggg

SEQ ID NO: 101260 - DNA, 50 bp, homo sapien
gtagtttgttgctgttgttttctgtytatcctgctaggctttgttgagat

SEQ ID NO: 101261 - DNA, 50 bp, homo sapien
ttttgtgattttgcctcttttggaartggaagccacctaccgaaattgtg

SEQ ID NO: 101262 - DNA, 50 bp, homo sapien
tctaattatatgtatggttgagattktctcatagagaactgaaagtatgt

SEQ ID NO: 101263 - DNA, 50 bp, homo sapien
ctgagctcttcccagtgctgaaatcraagtttttgttgaaatcaaattat

SEQ ID NO: 101264 - DNA, 50 bp, homo sapien
tatgaagatctctgaggatattgtayagaagttagacaagaacaagaata

SEQ ID NO: 101265 - DNA, 50 bp, homo sapien
gtaggcgcttaaaaaatatttgtggractaaggaattggatgataaaatg

SEQ ID NO: 101266 - DNA, 50 bp, homo sapien
tcagtcacagttctcttctgtatcaygcaaggttccaggtccttccccag

SEQ ID NO: 101267 - DNA, 50 bp, homo sapien
attccattatttaaagggactagaartgccgtgttttcttgcattttgtt

SEQ ID NO: 101268 - DNA, 50 bp, homo sapien
aaaaacacaacagatttggcaagaayacaaaaaaatcaagatttataatt

SEQ ID NO: 101269 - DNA, 50 bp, homo sapien
tagaacgtgttgagtggttgccttcrgaaaatgataaagcagcagaaaga

SEQ ID NO: 101270 - DNA, 50 bp, homo sapien
tggtaaaatttcagagcattagatasaaagaggccttaaaaggaagccaa

SEQ ID NO: 101271 - DNA, 50 bp, homo sapien
aagggaaatggaatgagattaagaaytggaataagaattctagaattctt

SEQ ID NO: 101272 - DNA, 50 bp, homo sapien
tgtttgtgtatatgtgttctaagtawaatttcagaacccaaatcagggta

SEQ ID NO: 101273 - DNA, 50 bp, homo sapien
tgcaattatctaatgatattaataaycagcacttaatgagtacttaccag

SEQ ID NO: 101274 - DNA, 50 bp, homo sapien
atgtcaaggcagtgagaggtaaaaaygagccactcttctcccatccgccc

SEQ ID NO: 101275 - DNA, 50 bp, homo sapien
aggtgtggggaaacactgactaggaygctaatgtagtcgtccaggtgaca

SEQ ID NO: 101276 - DNA, 50 bp, homo sapien
gatgaattctagaagttatccttgarattgtattcacttagtaaaaatac

SEQ ID NO: 101277 - DNA, 50 bp, homo sapien
actggtagattttgtaacagtctaaygattactactttactattaattac

SEQ ID NO: 101278 - DNA, 50 bp, homo sapien
ttttcaaaactgagcaaccagctgasgtttttgaggcgaacagcatgttg

SEQ ID NO: 101279 - DNA, 50 bp, homo sapien
atagaaagcatgacccaattcaagaygtgtccttctactagatctcaacc

SEQ ID NO: 101280 - DNA, 50 bp, homo sapien
tttaattataatctctgctctttaaygtcaatatccaatgctttgctttt

SEQ ID NO: 101281 - DNA, 50 bp, homo sapien
tgttagtgtggtcactggaattagayggttgtcgactggctaacttccag

SEQ ID NO: 101282 - DNA, 50 bp, homo sapien
gagaaaacagcacatgtaaaggaaaygcccgcttagtctggaggtagcag

SEQ ID NO: 101283 - DNA, 50 bp, homo sapien
tggaatcaccatttatgtgcttgccyaatttagaaactggagagttatca

SEQ ID NO: 101284 - DNA, 50 bp, homo sapien
cagtttcctccccagagtgttaatartactaaaacaagttatttctgctg

SEQ ID NO: 101285 - DNA, 50 bp, homo sapien
atcttgtctccattcagactttctcmatccccctaaggattcagatgtat

SEQ ID NO: 101286 - DNA, 50 bp, homo sapien
aaaagaataccatttttataacttamaaccataggcccaaagcattacat

SEQ ID NO: 101287 - DNA, 50 bp, homo sapien
tttttgagggttaaacaggtacttaygccaagtggccagcccagcaccta

SEQ ID NO: 101288 - DNA, 50 bp, homo sapien
gcatgggtttggcaataggggtgccrgtgaacaagtccccactccactcg

SEQ ID NO: 101289 - DNA, 50 bp, homo sapien
agtgccaccgtgagtggttatggaargagttgcgatgagaagggagctgc

SEQ ID NO: 101290 - DNA, 50 bp, homo sapien
gcttaatttctagctgactctgtgtytctaaccgtctgtagagactccac

SEQ ID NO: 101291 - DNA, 50 bp, homo sapien
gcaataaaggactaaaactcgcataratgaatattttaagaaagtctttc

SEQ ID NO: 101292 - DNA, 50 bp, homo sapien
aaaatagaacaggtgcagactcctgrgtaaatattatctgttatcaactg

SEQ ID NO: 101293 - DNA, 50 bp, homo sapien
tggggtactgacattgtgatcattaygcagatgaaggaactagggctaaa

SEQ ID NO: 101294 - DNA, 50 bp, homo sapien
atgagaatcattacctttttatgagragagataatagggagcttggagac

SEQ ID NO: 101295 - DNA, 50 bp, homo sapien
agccgtgacctctcagccaatataakacacctcttttagccctagttcct

SEQ ID NO: 101296 - DNA, 50 bp, homo sapien
tacctagtgttaggaaacagtccccratttctgactcatcctgctataag

SEQ ID NO: 101297 - DNA, 50 bp, homo sapien
cataccatgccctgaactcagttgarccattcagataatcgtctcaattc

SEQ ID NO: 101298 - DNA, 50 bp, homo sapien
tctgactttcatccgtcagaccaagratttaaaaatagatactgctgtct

SEQ ID NO: 101299 - DNA, 50 bp, homo sapien
agagcatcgcagtgctgggtgcgccracatccaagactccaggaattaca

SEQ ID NO: 101300 - DNA, 50 bp, homo sapien
atctgtcaatttgtttcagctacacracgagaagtaatttttaagggatc

SEQ ID NO: 101301 - DNA, 50 bp, homo sapien
catgactgtgagctcaggaaattcartaactgtggtcacattaagtaact

SEQ ID NO: 101302 - DNA, 50 bp, homo sapien
agcctcagggagaatgagcctcctcraaggtttttcagcaggggattgac

SEQ ID NO: 101303 - DNA, 50 bp, homo sapien
actgacctccagacataggagtgaayggcctttccaacaagtacagctgc

SEQ ID NO: 101304 - DNA, 50 bp, homo sapien
gaacactcaaatgtttgccatgcaaygtactgaagttaaatttgtttctt

SEQ ID NO: 101305 - DNA, 50 bp, homo sapien
tggatttaattacaccgatgttcgarataatctgttcaacaaaagtacac

SEQ ID NO: 101306 - DNA, 50 bp, homo sapien
ctcaacacaggcccgaaggactcaakattttcagaagacaattcttttag

SEQ ID NO: 101307 - DNA, 50 bp, homo sapien
tagggggacggggcaagaagcccagygccagggtaggaaggaggccttgg

SEQ ID NO: 101308 - DNA, 50 bp, homo sapien
aattctttgggtatatacctagaaawagaaccgctgcatcatgtggtcat

SEQ ID NO: 101309 - DNA, 50 bp, homo sapien
ttacctcaaatttcaaaggccagggygatccaagctgatatttgagttcc

SEQ ID NO: 101310 - DNA, 50 bp, homo sapien
aaagggcctggccacatttaaagggyatatgactccatgggtccccaggg

SEQ ID NO: 101311 - DNA, 50 bp, homo sapien
cttcataattgtagaatttgggcaaygtcttagagttagtaaatgctaat

SEQ ID NO: 101312 - DNA, 50 bp, homo sapien
aagcagcctacagcagacatccaacsattaaatgaaggtcagctctttgt

SEQ ID NO: 101313 - DNA, 50 bp, homo sapien
atgttgatcttcacttttaacaaacygaggtgcagaatggcctgacagca

SEQ ID NO: 101314 - DNA, 50 bp, homo sapien
aggtggacatctttgagctcctgaargtgtcctatgaggtcagcacccag

SEQ ID NO: 101315 - DNA, 50 bp, homo sapien
gctgtcatggagaaagaggaggtcartatttttgttaactttgttataat

SEQ ID NO: 101316 - DNA, 50 bp, homo sapien
tttttctttgtaatattatttactaygacatttacttggcaaaaatacat

SEQ ID NO: 101317 - DNA, 50 bp, homo sapien
gagttggaggcctcactcttttctcyatattttgtatcatattaaaacaa

SEQ ID NO: 101318 - DNA, 50 bp, homo sapien
ctccatggcagacatcttgtggagaycattttaaccattgattgatttgt

SEQ ID NO: 101319 - DNA, 50 bp, homo sapien
aagatgtctgccatggaggtctccartgccagtttcacctatacctctga

SEQ ID NO: 101320 - DNA, 50 bp, homo sapien
catttacttgaaacacaacatgcaamagattgtgaaatatgtcagtatag

SEQ ID NO: 101321 - DNA, 50 bp, homo sapien
tatgacaagaactacagctgcaatamgtcaattataccatttattgatgg

SEQ ID NO: 101322 - DNA, 50 bp, homo sapien
gagatgagggcacaggaaaaaaaaartgataccagagtgagaaagacttt

SEQ ID NO: 101323 - DNA, 50 bp, homo sapien
tgtagttgggccccaaagagaactayctttcatgtaaatgacaaagaaag

SEQ ID NO: 101324 - DNA, 50 bp, homo sapien
caacacataactcattaactagcgaraaaggaaaactatgtgactgacaa

SEQ ID NO: 101325 - DNA, 50 bp, homo sapien
ggccatctgaccattcagctgaatgyagccctatcagtgatcacagacta

SEQ ID NO: 101326 - DNA, 50 bp, homo sapien
gccactttgtctacaatgataattaracattaaaaggacaatattagggc

SEQ ID NO: 101327 - DNA, 50 bp, homo sapien
cttttcttgaggctgtttttagtgartaagtctaccagcttcagcaaagc

SEQ ID NO: 101328 - DNA, 50 bp, homo sapien
ctcctgaactagacatagctagataratgagagttcatggcttccctctg

SEQ ID NO: 101329 - DNA, 50 bp, homo sapien
cctctgtgttgaaatgtgtttcaggyaaatatcgaagctaaatcagaaag

SEQ ID NO: 101330 - DNA, 50 bp, homo sapien
ttcttacagacatctttgatttgtawacttgtggtaattttctggcaagt

SEQ ID NO: 101331 - DNA, 50 bp, homo sapien
tttatgttaagaaatcagaaacagawcctttggaaaagcctaatattttt

SEQ ID NO: 101332 - DNA, 50 bp, homo sapien
tcctagaacccagagtcatgatcgayggcaactcagcagtgatacctgga

SEQ ID NO: 101333 - DNA, 50 bp, homo sapien
agctcctaagaatggagaggttataygtccacaacgcccctagaattgtg

SEQ ID NO: 101334 - DNA, 50 bp, homo sapien
aagagggaaacagatgaaaaatagamgtaaagtactggtaatggaagccg

SEQ ID NO: 101335 - DNA, 50 bp, homo sapien
caccaacaacccacagatgaagagayggtgatccctaccctggaaaagct

SEQ ID NO: 101336 - DNA, 50 bp, homo sapien
ggcactttctcttttctggatcgagmcccaaattctctacgtgttgtccc

SEQ ID NO: 101337 - DNA, 50 bp, homo sapien
ctgtagtctagtcatcataaggaagmaagtttggtttggtgaatgtatca

SEQ ID NO: 101338 - DNA, 50 bp, homo sapien
catatgtcaatcattccctgggattmgtctccaggcatgattttatgtta

SEQ ID NO: 101339 - DNA, 50 bp, homo sapien
ttagtaatgctattactaacaatcaygacattctaaattcaactttaaca

SEQ ID NO: 101340 - DNA, 50 bp, homo sapien
agatagaaaggaagatgttgtatgastaaagaagatgagtagtggggtct

SEQ ID NO: 101341 - DNA, 50 bp, homo sapien
gtggggagttttatggacaaccttgrtaagaccccactactcatcttctt

SEQ ID NO: 101342 - DNA, 50 bp, homo sapien
tttgctcccaggagagagacagcacrgcaaaaggctcggggagaaatggc

SEQ ID NO: 101343 - DNA, 50 bp, homo sapien
ctaagcacatggctcagttggaaacraaggggcctcagaggatgaacacg

SEQ ID NO: 101344 - DNA, 50 bp, homo sapien
gatacagctcttttaggtcaaaatgscataggtgagatgctggcctcacg

SEQ ID NO: 101345 - DNA, 50 bp, homo sapien
gaattatctttgttctcgataattayagatgccatccattgaccacctgt

SEQ ID NO: 101346 - DNA, 50 bp, homo sapien
tgaaagggatgtgggaagaacatcaygccataaatccccaaattccagca

SEQ ID NO: 101347 - DNA, 50 bp, homo sapien
aagagatcctgtgcaaagatccagcrgcctgctttgggttccagtaaaca

SEQ ID NO: 101348 - DNA, 50 bp, homo sapien
gggctcatacagttaagtatagaaasagcttggccagggtccctcgcttc

SEQ ID NO: 101349 - DNA, 50 bp, homo sapien
tttttagtatctaattggttcaacayattcaatgaaatttttattcctag

SEQ ID NO: 101350 - DNA, 50 bp, homo sapien
ctattgtagcttttttcagaaataasgactcatttttagaaaagaaaaaa

SEQ ID NO: 101351 - DNA, 50 bp, homo sapien
ggtctgaacctctatcagtgagtatyatacgccggtgaacgccaccacca

SEQ ID NO: 101352 - DNA, 50 bp, homo sapien
agacattacagttgtgttttactgaygttgatttcgcctgtcccattttt

SEQ ID NO: 101353 - DNA, 50 bp, homo sapien
tgttgctgtgaaggtattcattggayctgaataaaaatcagtagactttg

SEQ ID NO: 101354 - DNA, 50 bp, homo sapien
taattagcaccatacttaccatgcartacttttccaataatttttggtgt

SEQ ID NO: 101355 - DNA, 50 bp, homo sapien
tgaaatgaattgtgcataagcaggayctaatcttggcccgaagacatttg

SEQ ID NO: 101356 - DNA, 50 bp, homo sapien
tctagtagacttccaattaaaacctyggtggtgaagatttagcaggaaga

SEQ ID NO: 101357 - DNA, 50 bp, homo sapien
gtccttctctgactatggtgtgctawctttttaattcatgtataattctg

SEQ ID NO: 101358 - DNA, 50 bp, homo sapien
taaaattagtatgcagggctgttagmatctatagaccctcccccaccagg

SEQ ID NO: 101359 - DNA, 50 bp, homo sapien
gcagtggtgtctttgatcacaggagracctaggatttggaagggcttgag

SEQ ID NO: 101360 - DNA, 50 bp, homo sapien
tcctccctacctagttttaatttcaygactttcaagcaatcttctgctct

SEQ ID NO: 101361 - DNA, 50 bp, homo sapien
cctcgaggacatcatgccaagtggartaagccagacacaaaaggacaaat

SEQ ID NO: 101362 - DNA, 50 bp, homo sapien
atcaaaatcccaaaagtccttaggaktaacacagattgtactggcattaa

SEQ ID NO: 101363 - DNA, 50 bp, homo sapien
ggcagacatcttaccatattgtatamcgggagctgtttactggttttgaa

SEQ ID NO: 101364 - DNA, 50 bp, homo sapien
aggtgggtgccaggacagacgttcasggcagctttggaagaaacactaat

SEQ ID NO: 101365 - DNA, 50 bp, homo sapien
cctgctgtgagcccagatccagggarccattccatccgcaacacactcag

SEQ ID NO: 101366 - DNA, 32 bp, homo sapien
tccttcttcatttcaaygtctgatttgagcaa

SEQ ID NO: 101367 - DNA, 50 bp, homo sapien
taggtgtattttaagcttggagacaycctgttaatttatttactatagaa

SEQ ID NO: 101368 - DNA, 50 bp, homo sapien
tctttctcaatactgggcctcagtaycaaactattaacgcaagatctcaa

SEQ ID NO: 101369 - DNA, 50 bp, homo sapien
aaatctgaaataaaattaatgtaaaytcaaaactcagttctcctcagtca

SEQ ID NO: 101370 - DNA, 50 bp, homo sapien
caagataaggcgccactacataaaakgattcagaaagtccaagggctcta

SEQ ID NO: 101371 - DNA, 50 bp, homo sapien
attgtccctagagcccactcactacsagcctaagtacccttccctaaagg

SEQ ID NO: 101372 - DNA, 50 bp, homo sapien
gttaactgtggtacatttaaggataragcttgccctgttagagaagggag

SEQ ID NO: 101373 - DNA, 50 bp, homo sapien
actagttcaggctcttacaattttaygttcatccatcaaacactgtattt

SEQ ID NO: 101374 - DNA, 50 bp, homo sapien
ctgtgaacgattaaacactaaaaccrataatcttatggaggcaaaacagt

SEQ ID NO: 101375 - DNA, 50 bp, homo sapien
gtccacacagctatttgtaaccagcrcgtagaattgagtttcaacaagaa

SEQ ID NO: 101376 - DNA, 50 bp, homo sapien
tctctatcatctacccatccatgcarctatctaaacttgcaatctaaact

SEQ ID NO: 101377 - DNA, 50 bp, homo sapien
aactatcatagaagcttcaaatgacratagtttaccttctccttttaaat

SEQ ID NO: 101378 - DNA, 50 bp, homo sapien
caaactaatactcctctatttttacsaacttctgtggagagaattttttc

SEQ ID NO: 101379 - DNA, 50 bp, homo sapien
tttgcccatgatgccagcctgcatasgtcatgttttcatgagacaagtat

SEQ ID NO: 101380 - DNA, 50 bp, homo sapien
aagcaggcaatcctatcaggtctgartagggcaaggcattgtgtttctta

SEQ ID NO: 101381 - DNA, 50 bp, homo sapien
gaactcctcagagggctgctcatccrgactcagcaggagaaatactgggg

SEQ ID NO: 101382 - DNA, 50 bp, homo sapien
tgtgctttgagaataactacaaaatkagtgcatatttctctttgggctcc

SEQ ID NO: 101383 - DNA, 50 bp, homo sapien
ttggtacatagaaaaggaacgtgaartatctcaatcatattttgtattga

SEQ ID NO: 101384 - DNA, 50 bp, homo sapien
agatttgaaaaatgaactttccttcytggaatttgtccaattttggaatg

SEQ ID NO: 101385 - DNA, 50 bp, homo sapien
aaaagtaaaaatggccttgttgaagraattaaatttatgttcaagtgcta

SEQ ID NO: 101386 - DNA, 50 bp, homo sapien
tgaaattttcaaagatagagattttyggttttatccattgatgaattcta

SEQ ID NO: 101387 - DNA, 50 bp, homo sapien
ggatttcacttaataacaaacagacrcaaacagttatgagtgcctataaa

SEQ ID NO: 101388 - DNA, 50 bp, homo sapien
aattttatctacacccagaagtagtkaaaattcgaaggacctttattagg

SEQ ID NO: 101389 - DNA, 50 bp, homo sapien
tgtttctctgtatatactgtgcttayaaaatgtcagctttacaagttact

SEQ ID NO: 101390 - DNA, 50 bp, homo sapien
tctattcctaagatgattttcatggytttttatcatttgttgaaattatt

SEQ ID NO: 101391 - DNA, 50 bp, homo sapien
gttcacctgcctagggctgctacatsatcaaaaatagctgctattgtatt

SEQ ID NO: 101392 - DNA, 50 bp, homo sapien
ttttaagacagccagtctcacaataygaaaaaccaagaaagggaatggtt

SEQ ID NO: 101393 - DNA, 50 bp, homo sapien
aatataccattagcttataagaccargtacccatgggagtacttgatgat

SEQ ID NO: 101394 - DNA, 50 bp, homo sapien
acttgtgaggatgtgtttatactatyaccatcatcagtatcagctaccaa

SEQ ID NO: 101395 - DNA, 50 bp, homo sapien
tttatcaggcaagactaatacaataycctgtaaactcatgtattctgaaa

SEQ ID NO: 101396 - DNA, 50 bp, homo sapien
aggaaaaaaaacatcaacatctccartacttctagcaccatctctgtttt

SEQ ID NO: 101397 - DNA, 50 bp, homo sapien
ttgtaaaaaatcatctggtataccawgggttcatagttatcatcattaat

SEQ ID NO: 101398 - DNA, 50 bp, homo sapien
caaggatgtatactataaactctaaygcaactgctaaacacacacaatag

SEQ ID NO: 101399 - DNA, 50 bp, homo sapien
tgtgtatatatatagctttaaaccaytgattatctttaaaagagatttaa

SEQ ID NO: 101400 - DNA, 32 bp, homo sapien
catttattttcattackcttctaaactgtata

SEQ ID NO: 101401 - DNA, 50 bp, homo sapien
ttgtacccattgcaacatttcccttygggttccagcctcacagcttccag

SEQ ID NO: 101402 - DNA, 50 bp, homo sapien
aataagcatgatgctatcaactgtcraccttaaataatgagattcagaaa

SEQ ID NO: 101403 - DNA, 50 bp, homo sapien
gcattgcagaagcaaacttgttcatygcctatcaagcactacctggtgga

SEQ ID NO: 101404 - DNA, 50 bp, homo sapien
agaacaaaccccactcggaaactacrgacgaaggttcagaatgtcatcct

SEQ ID NO: 101405 - DNA, 50 bp, homo sapien
ttgaagtaaggataaaatggtaaaamgtgtgttaagatatagagaattta

SEQ ID NO: 101406 - DNA, 50 bp, homo sapien
aaggcaaagtagagtttcatgttctmaattctgctgaagatatgaatcat

SEQ ID NO: 101407 - DNA, 50 bp, homo sapien
tccatgtggcactacagaatggattmaaatctcactagaacaatctttct

SEQ ID NO: 101408 - DNA, 50 bp, homo sapien
agtggtctagaaaagatgacatacayggagtttgaaaagctggtaagaca

SEQ ID NO: 101409 - DNA, 50 bp, homo sapien
tccatttaggtgcagatttgtcacastcattaaacagtcttcagtttttc

SEQ ID NO: 101410 - DNA, 50 bp, homo sapien
gggaagttcaacgctaagtcagaccraggctggcccatgggattcatgaa

SEQ ID NO: 101411 - DNA, 50 bp, homo sapien
cttcatccccctcaaaataatgtaakcatagtaacatgtgatgagaggca

SEQ ID NO: 101412 - DNA, 50 bp, homo sapien
atactagatggtaaatactgctgtayggaaaaagtgttcaaaagatgatt

SEQ ID NO: 101413 - DNA, 50 bp, homo sapien
ggggagagatttgccaaagaaattarggcttcagtaattaggaaaccaca

SEQ ID NO: 101414 - DNA, 50 bp, homo sapien
accactgttcttaactacggttatgraatcctgaagaggggcagcggtga

SEQ ID NO: 101415 - DNA, 50 bp, homo sapien
gcagactaacatttctgcagaaaacmactagaaaatctgaattggaaaaa

SEQ ID NO: 101416 - DNA, 50 bp, homo sapien
aggaggccacagctctgggagatacrcttttcggaagtcgtcagattctt

SEQ ID NO: 101417 - DNA, 50 bp, homo sapien
tgacacactttggacccattgttggmgatgaggtcaggaaacttatttct

SEQ ID NO: 101418 - DNA, 50 bp, homo sapien
tagtcatggtccctgttgattcactraacaaatgcctcagttcagtctca

SEQ ID NO: 101419 - DNA, 50 bp, homo sapien
aatgcctcagttcagtctcagctacrtactgtttcattctcacaaccctc

SEQ ID NO: 101420 - DNA, 50 bp, homo sapien
atcaattctttccaatgtctgcaaargaagatgtactacggtaggtgttg

SEQ ID NO: 101421 - DNA, 50 bp, homo sapien
attttgtatctgcccaggaatttccraactttgatgccattacagtctga

SEQ ID NO: 101422 - DNA, 50 bp, homo sapien
acaacaattttaatcttttgacatayagtgtgtttgtatttttgaatcta

SEQ ID NO: 101423 - DNA, 50 bp, homo sapien
tagaaggtgacctgtaacacttagcraaattaagcacacctgtgccctat

SEQ ID NO: 101424 - DNA, 50 bp, homo sapien
atatattgtaataggttgactttgcmaatatttttcctgactgagtcatg

SEQ ID NO: 101425 - DNA, 50 bp, homo sapien
cctctaacactctccatacatgcaamtatttttccctcctcctttgagaa

SEQ ID NO: 101426 - DNA, 50 bp, homo sapien
aattcacttgtctgcaataacataaratatgatgcttgtaaagttgaaat

SEQ ID NO: 101427 - DNA, 50 bp, homo sapien
atgatgcttgtaaagttgaaataaayattaggtgtgatacttgtaaagca

SEQ ID NO: 101428 - DNA, 50 bp, homo sapien
aggggagggtattaatgtaagagaayggtaggctaaaatcacataaatag

SEQ ID NO: 101429 - DNA, 50 bp, homo sapien
gttgattagatctcctttgagtaaawtgattaaaaacaacatttttttaa

SEQ ID NO: 101430 - DNA, 50 bp, homo sapien
aactggggttatcctattagaaaaaygaacatgcatgcaaagctctggat

SEQ ID NO: 101431 - DNA, 50 bp, homo sapien
aattgcatagttaaatgcaacaaacrttcacatagaatatggatttgagg

SEQ ID NO: 101432 - DNA, 50 bp, homo sapien
gaataaatgagcttatgctgctttargtttttgccagaccaaatgaagtc

SEQ ID NO: 101433 - DNA, 50 bp, homo sapien
tatcactttaatcgaatggagaaaakgactgtattgagaagaaaagttac

SEQ ID NO: 101434 - DNA, 50 bp, homo sapien
atattaatatagcattgccatttagyaacagattatgtggttgacataat

SEQ ID NO: 101435 - DNA, 50 bp, homo sapien
ccaacagaaacctcaatttttacaasttaaatgtggctctttccctctct

SEQ ID NO: 101436 - DNA, 50 bp, homo sapien
cataataagacctaagctgtggtgamaagttggtaaatacttaataattg

SEQ ID NO: 101437 - DNA, 50 bp, homo sapien
tactgagccaaaacaatatgaaatgstctttcagaggcacgggcctggcc

SEQ ID NO: 101438 - DNA, 50 bp, homo sapien
aactgatgagtgtttcagttatttaraacctttgtaatcttcattaaagc

SEQ ID NO: 101439 - DNA, 50 bp, homo sapien
atcagtgcagtgatgacttgaggagmaaagatcctagagaagagggaggt

SEQ ID NO: 101440 - DNA, 50 bp, homo sapien
aagttttataatgacttatttggagyagtgattgatgaaaaattattgta

SEQ ID NO: 101441 - DNA, 50 bp, homo sapien
gagtcccttaaatcgcatttagagartcacatctgatgcctacaactggc

SEQ ID NO: 101442 - DNA, 50 bp, homo sapien
atttaaacaaatgtatgcctagagcrcctataacggccaggaccctctgc

SEQ ID NO: 101443 - DNA, 50 bp, homo sapien
ggcttacataaaacagggattcacaragccactaggtgacctatgccagg

SEQ ID NO: 101444 - DNA, 50 bp, homo sapien
agcacctgacttaaaatagcattttwaaaagtacctcttcagtagtaata

SEQ ID NO: 101445 - DNA, 50 bp, homo sapien
tgtaaattgctaccaattgtttccartacgttttcatttcaacagttact

SEQ ID NO: 101446 - DNA, 50 bp, homo sapien
gtaaggcaggtccccaggtctaccaytggcaagagcggattatgggcgca

SEQ ID NO: 101447 - DNA, 50 bp, homo sapien
aactaatgttattataagcagtgacytcaaagtgacagcctgtggccaca

SEQ ID NO: 101448 - DNA, 50 bp, homo sapien
ggccacttctctgccttgggcagtakagattagagagaaaaaaggtcaga

SEQ ID NO: 101449 - DNA, 50 bp, homo sapien
taagagtttaaccacataaatcacakaaacatcagggtgtacagtggctt

SEQ ID NO: 101450 - DNA, 50 bp, homo sapien
cagagtgtatggaccatacttaatgsaacaccggtaccaactggtggagt

SEQ ID NO: 101451 - DNA, 50 bp, homo sapien
gggggacaggttcagtgcagtaatamtatctggcttcttacctgacttct

SEQ ID NO: 101452 - DNA, 50 bp, homo sapien
cttttggaaggaaaaaaaggccatartaaatatccatttccaggattgta

SEQ ID NO: 101453 - DNA, 50 bp, homo sapien
catgccaaagcaaaaacaactctaaytgaagaagccggtgcatttaatct

SEQ ID NO: 101454 - DNA, 50 bp, homo sapien
tgtactgtagtcattgctcacagcasgtggctctgtaatgtgctcctcta

SEQ ID NO: 101455 - DNA, 50 bp, homo sapien
aaatagatataaaaagactaaagcaycaaaaagatataaaaagtagctca

SEQ ID NO: 101456 - DNA, 50 bp, homo sapien
ttattttacggtgaatgaactcataygtagacggtccctgacttaaccaa

SEQ ID NO: 101457 - DNA, 50 bp, homo sapien
tctcattgtgattatagctaaaactraataatcaagtaacagaattataa

SEQ ID NO: 101458 - DNA, 50 bp, homo sapien
tctcttgctttaactgccagctctargctcatgactataaaatctctgtc

SEQ ID NO: 101459 - DNA, 50 bp, homo sapien
taaaacaggggaagaaagattctaamagtatggtgtttatagaaacagta

SEQ ID NO: 101460 - DNA, 50 bp, homo sapien
gactagggctgtagcgccatgaaacragaaaggaagttggtgcccaccag

SEQ ID NO: 101461 - DNA, 50 bp, homo sapien
ctgcaccgggcaaacctatctcccaytagctttgttgaaatcaatataaa

SEQ ID NO: 101462 - DNA, 50 bp, homo sapien
ggtgcccagtgagttggaagattatwagagtaaagaagaatcatgaagag

SEQ ID NO: 101463 - DNA, 50 bp, homo sapien
gttgcatagtaccattcaaccaatayaaggacaaatgaacagtgcatttt

SEQ ID NO: 101464 - DNA, 50 bp, homo sapien
tttcaaattacatatcacttattaasaaaactatcataaagaagaaaact

SEQ ID NO: 101465 - DNA, 50 bp, homo sapien
taaggtaatttgcaacatagcaaacyggaacaggtactaatgggtcttgg

SEQ ID NO: 101466 - DNA, 50 bp, homo sapien
aatagctatgcttatattttttactyaggctatcaaactttggatgcatt

SEQ ID NO: 101467 - DNA, 50 bp, homo sapien
cagctgtcagggtcaagaacgcttgraggaatatcctggttttctccatc

SEQ ID NO: 101468 - DNA, 50 bp, homo sapien
ctgacatcactgtgcattcaacatcygaaaatgtttgtccttttttggaa

SEQ ID NO: 101469 - DNA, 50 bp, homo sapien
atgtcaaagcatgtgaaattataacrctgggcccttgccaaaaaatacaa

SEQ ID NO: 101470 - DNA, 50 bp, homo sapien
tgccaatgagtgtaatggtcatgtargcaaatccctcaaataaaatgttg

SEQ ID NO: 101471 - DNA, 50 bp, homo sapien
caaaaaaatacctatacaagaaaggycataaggatgaaagaatctaaatt

SEQ ID NO: 101472 - DNA, 50 bp, homo sapien
tctcccatcttgcttctcatcctgcrctgaaaatgaatgggatactagtg

SEQ ID NO: 101473 - DNA, 50 bp, homo sapien
ttctgctaagttatttaacttggacwcatctagtagaattcagccaattc

SEQ ID NO: 101474 - DNA, 50 bp, homo sapien
tcatctcaggttattagaatcaaaastgtgaacggagagtccatataaag

SEQ ID NO: 101475 - DNA, 50 bp, homo sapien
tctcagcaaatgtgtacattccagasatccaggaaagatggctgcttcat

SEQ ID NO: 101476 - DNA, 50 bp, homo sapien
aaagaatctagggtcagtaaagaaayctaattgttataaatccatcttta

SEQ ID NO: 101477 - DNA, 50 bp, homo sapien
ctcagagtgtatatagtagttctagyatcttaaaaaataacatctagatc

SEQ ID NO: 101478 - DNA, 50 bp, homo sapien
aaagtaaaatcattaattaagggaakttagcagagttattttggccctga

SEQ ID NO: 101479 - DNA, 50 bp, homo sapien
tatgcttgtgaataatgtccaatgasaacagtggtgtgatgaaatgtcgc

SEQ ID NO: 101480 - DNA, 50 bp, homo sapien
acatcccgagtaatgaagtgtatagycgcttcagctttctcttggcatcc

SEQ ID NO: 101481 - DNA, 50 bp, homo sapien
tgaactgggttaagtttagaaacaaycatagctggaaaaagtatgacttt

SEQ ID NO: 101482 - DNA, 50 bp, homo sapien
tgatgaaactaatcagaagaatccamgcattgatcaataacaaagagggt

SEQ ID NO: 101483 - DNA, 50 bp, homo sapien
cacttatccctctgactttgaagacycattagtaatatccaggattaatc

SEQ ID NO: 101484 - DNA, 50 bp, homo sapien
tgaaaatctttaattccatttgtgaygttactcttttccaaccttagcta

SEQ ID NO: 101485 - DNA, 50 bp, homo sapien
aaaccaaagattccaacagtggctayaatgtataaaatgaccataaagaa

SEQ ID NO: 101486 - DNA, 50 bp, homo sapien
cctatgaggaacaatggtaaagctcyttggtctctggagaactccttacc

SEQ ID NO: 101487 - DNA, 50 bp, homo sapien
ttaaagagtggtgttttattgacatmtactccttctctataaattgtatt

SEQ ID NO: 101488 - DNA, 50 bp, homo sapien
gatgacaaaatcctttctaataaaasgtttgcaacagaagagatggtgga

SEQ ID NO: 101489 - DNA, 50 bp, homo sapien
cccgactaattaaagggctaaaatayatgtatagatagttataattctag

SEQ ID NO: 101490 - DNA, 50 bp, homo sapien
gaggtcacctcatcctgattccctcratgatacattcatatctagatgtg

SEQ ID NO: 101491 - DNA, 50 bp, homo sapien
gtatttactcttattctgacaactcyatgtgatttcccctggggaggtca

SEQ ID NO: 101492 - DNA, 50 bp, homo sapien
tgtagaattttatgtcttttatagarctcattggtggtgtagtgggcact

SEQ ID NO: 101493 - DNA, 50 bp, homo sapien
aaattctaaagatttttacaacgtawgacacaccagttaggaaatcataa

SEQ ID NO: 101494 - DNA, 50 bp, homo sapien
gcgccttttgccaacactagtggaamaggtaattcccaagccatgctggg

SEQ ID NO: 101495 - DNA, 50 bp, homo sapien
ggtcaaggcctgattaagctagtggyagagtatatcctaagaccttgaat

SEQ ID NO: 101496 - DNA, 50 bp, homo sapien
ggaagagaagttgtcaaggaagatasaggagaaatcccatgctgggagaa

SEQ ID NO: 101497 - DNA, 50 bp, homo sapien
gcgagagctgacctttgaatgctaayctgtttggggaacctgccttaaga

SEQ ID NO: 101498 - DNA, 50 bp, homo sapien
gcaaatcttaggtgctcaataaatgyctactgagaaataaaactgagtga

SEQ ID NO: 101499 - DNA, 50 bp, homo sapien
tgaaatagtgaaatcgaggagtaatmataaaacgtctacatatgggtgtt

SEQ ID NO: 101500 - DNA, 50 bp, homo sapien
tccaacatcactcctttgtgcgaccrgcccatgggaagctaagatgagtc

SEQ ID NO: 101501 - DNA, 50 bp, homo sapien
ttatttggcaccatattttctaagaygaaagctattatagaccttggttt

SEQ ID NO: 101502 - DNA, 50 bp, homo sapien
attggactgtttatttggggctgcayctaacttctgccaaccctttcccc

SEQ ID NO: 101503 - DNA, 50 bp, homo sapien
aaattttacttggttatttttcatayctgctaggtcactttttttttttt

SEQ ID NO: 101504 - DNA, 50 bp, homo sapien
aaaggtgcttataaagcattgactaygccaggtacttcacttcctatccc

SEQ ID NO: 101505 - DNA, 50 bp, homo sapien
atgggtgccacagaaggaaacacccrggctttcttatcagtttgccaagt

SEQ ID NO: 101506 - DNA, 50 bp, homo sapien
ttactgtcttggttcatttagctagyagtagaacgagagttttcacaaaa

SEQ ID NO: 101507 - DNA, 50 bp, homo sapien
aatgggttttgtgtttgtgcaaatcytaggtgctcaataaatgcctactg

SEQ ID NO: 101508 - DNA, 50 bp, homo sapien
tacaacttgtcctcctaatttcaatstaagttagccatttgtgaccaaga

SEQ ID NO: 101509 - DNA, 50 bp, homo sapien
atgcacctggagacagcgataccackctcttccacgtaggaaatcatcca

SEQ ID NO: 101510 - DNA, 50 bp, homo sapien
taccattggaaaacaaaatttggtarccaggatatattgcttaagttaaa

SEQ ID NO: 101511 - DNA, 50 bp, homo sapien
ccggagaggggaaaatagtgaatccmgacattgtgcttccctcctcagaa

SEQ ID NO: 101512 - DNA, 50 bp, homo sapien
tcagggatgaaagcggggactccagscttataaaatatgattgatccctt

SEQ ID NO: 101513 - DNA, 50 bp, homo sapien
aatttattaagaaaaggctgcataaytgttaagtgaccacaaagattcca

SEQ ID NO: 101514 - DNA, 50 bp, homo sapien
gcatgtaatatctaaactgcagtcgyaccctggatccttctataatgcca

SEQ ID NO: 101515 - DNA, 50 bp, homo sapien
acgtttgaagattcagatgcataacratatttataattgaaaaaaatcta

SEQ ID NO: 101516 - DNA, 50 bp, homo sapien
gggctaggagataaggcaaggtttayggccctgaggatgccgaaagcttc

SEQ ID NO: 101517 - DNA, 50 bp, homo sapien
aggtcccaggggatgcatctgtaaastctgagaggcgctgatttaaataa

SEQ ID NO: 101518 - DNA, 50 bp, homo sapien
tgctcagaatgcaagaaagctttgcrccagaaccgttaaacattcatgaa

SEQ ID NO: 101519 - DNA, 50 bp, homo sapien
agaaatttggctcaggcttttccagsatagttgcctttgagctgagacaa

SEQ ID NO: 101520 - DNA, 50 bp, homo sapien
gttgcaactgactctcattaaacgarctaactgttcactctagcagcact

SEQ ID NO: 101521 - DNA, 50 bp, homo sapien
gggttgtctagaatgtaaattcctgratggtggcagtgaggaaagcgtct

SEQ ID NO: 101522 - DNA, 50 bp, homo sapien
ttgatttttaaaggtttcctaattayttcaccaaaatcaggttgaatgaa

SEQ ID NO: 101523 - DNA, 50 bp, homo sapien
gattatttgaggctgagataataaaytgtctaagaagcaaccatttttct

SEQ ID NO: 101524 - DNA, 50 bp, homo sapien
ggaagtgtcaggacaccacatgaacraaaggtgcttgccaggttgccaga

SEQ ID NO: 101525 - DNA, 50 bp, homo sapien
acagcgccatctggtggttatgatcmgcatgtacccgccaatgcctgcag

SEQ ID NO: 101526 - DNA, 50 bp, homo sapien
aatatgaacttgcagggtgcttaacrctatttcaaataccactttaaaac

SEQ ID NO: 101527 - DNA, 50 bp, homo sapien
gtaaaaaggcagcaatgtttccatargatctgcttcatactgctggtttt

SEQ ID NO: 101528 - DNA, 50 bp, homo sapien
ggcagcactagctaaagcaagatcartattaattaagaaacctagagaga

SEQ ID NO: 101529 - DNA, 50 bp, homo sapien
taatgaagaaaatgatttggaagtcrcaacaccaattacatggtagctca

SEQ ID NO: 101530 - DNA, 50 bp, homo sapien
atgacctgttgaccttttaatggatrgattacacagagcaaattcccaaa

SEQ ID NO: 101531 - DNA, 50 bp, homo sapien
taatccatccattaaaaggtcaacargtcatgatcataagaaatttaagc

SEQ ID NO: 101532 - DNA, 50 bp, homo sapien
aaggctgccatggatcatagttgccygaaagggatagtctctaaccaagc

SEQ ID NO: 101533 - DNA, 50 bp, homo sapien
tttgcattcatttgtgtgattcctcyataagcggatgtctccacactgct

SEQ ID NO: 101534 - DNA, 50 bp, homo sapien
tttaacgaagagcttttaacatgtawctattctatcaaagagcggtcgtg

SEQ ID NO: 101535 - DNA, 50 bp, homo sapien
gcctttattgatattcttcttcaggkactagacttcctatgcatcctaaa

SEQ ID NO: 101536 - DNA, 50 bp, homo sapien
acagtgtgtaacactggtgcaactayacataggtgaatgtcgaatttcac

SEQ ID NO: 101537 - DNA, 50 bp, homo sapien
tgaagcagtcgttaactctgcacacrctggtggtcctgaagcacctctct

SEQ ID NO: 101538 - DNA, 50 bp, homo sapien
gattacatttgagttttaatgcttaraagtttgagtactctatgctttct

SEQ ID NO: 101539 - DNA, 50 bp, homo sapien
ctaggttgaatttctaagatattcarctctcaacattagaatcattaaga

SEQ ID NO: 101540 - DNA, 50 bp, homo sapien
agtggtccaaggggaactgttatggmcttcattctaagaagcttaaattt

SEQ ID NO: 101541 - DNA, 50 bp, homo sapien
gtcacatttcaggaagatcagctaayatattccatggaatcaaaggtatt

SEQ ID NO: 101542 - DNA, 50 bp, homo sapien
tctttgggattatcttatcttaaacsctatgtcttcttatttcaaaaatc

SEQ ID NO: 101543 - DNA, 50 bp, homo sapien
atttctaacataaactcacaaacgarctcaggatggactgttaaaaatac

SEQ ID NO: 101544 - DNA, 50 bp, homo sapien
tttcggagccttcccttttctccackatgaaagcttccccactcctctga

SEQ ID NO: 101545 - DNA, 50 bp, homo sapien
ctctcatttctgtaacactgtaatamccagagatatgtggtttcagctga

SEQ ID NO: 101546 - DNA, 50 bp, homo sapien
tgtctgtttgtttagctttccagtcrcattactctttcccagggttgccc

SEQ ID NO: 101547 - DNA, 50 bp, homo sapien
tggccatcttaattagcttcctaaasgattattacatcaaagtatgtcac

SEQ ID NO: 101548 - DNA, 50 bp, homo sapien
aaaaaattttgccctccttattactsaaacagttgaacaaacaaccaaaa

SEQ ID NO: 101549 - DNA, 50 bp, homo sapien
agagtgggcacatgacccagttgtgraccatgagatgcaaggggaatgtt

SEQ ID NO: 101550 - DNA, 50 bp, homo sapien
aaaaacagtcatgtgtcacttaaccraagggaatatgttctaagaaatat

SEQ ID NO: 101551 - DNA, 50 bp, homo sapien
tccatatgccaattcctatgatatarcatgaaataggaaatgttttgaac

SEQ ID NO: 101552 - DNA, 50 bp, homo sapien
gtagttgtttgttttattgtgagatkacatcatttagggtatatttaaag

SEQ ID NO: 101553 - DNA, 50 bp, homo sapien
tcctattatcatctacctgatcagcrcagtctgtttgaagaaagcccact

SEQ ID NO: 101554 - DNA, 50 bp, homo sapien
gcctcaccaaagaagatctacagaastcaataaagcatatgaaaagacgc

SEQ ID NO: 101555 - DNA, 50 bp, homo sapien
taggtaacacaggtaagtggtacagytatcattagaaaccaggcttactg

SEQ ID NO: 101556 - DNA, 50 bp, homo sapien
aaaagaggtactacttgtctacataytaagaggagagctgcagtgaatct

SEQ ID NO: 101557 - DNA, 50 bp, homo sapien
tggaggaagttaaatgcttatcttaygtaaaaacaagctttagcagttcc

SEQ ID NO: 101558 - DNA, 50 bp, homo sapien
tattgtggatcctgatataattgaaytccacagatgctgagtgaggtcgg

SEQ ID NO: 101559 - DNA, 50 bp, homo sapien
ctttaggggaaatgagagtcagcaaygatatgcttgggtgtttttccttc

SEQ ID NO: 101560 - DNA, 50 bp, homo sapien
cctgtgactccttctcaaaacttacyacatacattttctctttacccttt

SEQ ID NO: 101561 - DNA, 50 bp, homo sapien
caccctcatgtttcaggttctgttayggtaacactccacctccaggtacc

SEQ ID NO: 101562 - DNA, 50 bp, homo sapien
ggcatgttctatatcatttaaatcaktacacctcaaagtgtggtgctcag

SEQ ID NO: 101563 - DNA, 50 bp, homo sapien
ggggatagctgtgatatagcactggscaaagcatgcttcagagatgtttt

SEQ ID NO: 101564 - DNA, 50 bp, homo sapien
atgattagaatatttgagaggaataraagtcttcttttctgcttttcccc

SEQ ID NO: 101565 - DNA, 50 bp, homo sapien
aagtgacactggccctaatcagtgcmttctaataggaggtacataatgtc

SEQ ID NO: 101566 - DNA, 50 bp, homo sapien
aaaatacatatacacaaatatatgcwcatatacatttcctattgaaaaga

SEQ ID NO: 101567 - DNA, 50 bp, homo sapien
aatgtaatcacaaggttcttagaaamaaagcaagagggaagcaagagaag

SEQ ID NO: 101568 - DNA, 50 bp, homo sapien
taccataatttataggggaaagtctrtgggatcaaagcattttaataaaa

SEQ ID NO: 101569 - DNA, 50 bp, homo sapien
tatgtttccatgaatctatttagacwagtattaatttcccaaacaacact

SEQ ID NO: 101570 - DNA, 50 bp, homo sapien
caatggaaaagtatgacacttgttcyggctctaatctggttatggctatg

SEQ ID NO: 101571 - DNA, 50 bp, homo sapien
ttacagctgtgtttatcaaggactaygaaaagtattaattcaaacaacag

SEQ ID NO: 101572 - DNA, 50 bp, homo sapien
atgtctacaaaggctgaacttggacrccattgtctagcatcttttgaact

SEQ ID NO: 101573 - DNA, 50 bp, homo sapien
cctgcaggcagcttgctagcaagttyaactggtaccccagccagcaaccc

SEQ ID NO: 101574 - DNA, 50 bp, homo sapien
gagaagtcttcccagatgcagaatcsgatcacatctcgcccctgtccttt

SEQ ID NO: 101575 - DNA, 50 bp, homo sapien
cagagcactctaagcgactggatcasattgcacatttaggttctgagtgt

SEQ ID NO: 101576 - DNA, 50 bp, homo sapien
ttctccccatcttctggctctgagawtatcttcatgccacgccttctgtc

SEQ ID NO: 101577 - DNA, 50 bp, homo sapien
atttcaacggcctagactttgcaggyaagtgaaaaagaagggttttttgt

SEQ ID NO: 101578 - DNA, 50 bp, homo sapien
cccatggggttcttaagagattgaartaggctagtatataaaaagagttt

SEQ ID NO: 101579 - DNA, 50 bp, homo sapien
gactgaacgaataactgacaaggcastcacttccaatagatcctcataac

SEQ ID NO: 101580 - DNA, 50 bp, homo sapien
taagaaagaagaattagcagattaarccttaataatatataaatacttta

SEQ ID NO: 101581 - DNA, 50 bp, homo sapien
atgtatccaaccaatcaaaactcaasagggtcagagaagatcctgcaagt

SEQ ID NO: 101582 - DNA, 50 bp, homo sapien
atccaagccctctgccctaacaaackgtctaaactcaggcaaatggccgg

SEQ ID NO: 101583 - DNA, 50 bp, homo sapien
aatgtttgaactctggaaaggaacayaagtggatataaaaagtttaaaat

SEQ ID NO: 101584 - DNA, 50 bp, homo sapien
aatataaaatgtgaacttaaaactaygttacccagtgagagcatcaaatg

SEQ ID NO: 101585 - DNA, 50 bp, homo sapien
tcaaaaaaaaagaaaagtaaagtaamgctggctgtgcatctctcagagaa

SEQ ID NO: 101586 - DNA, 50 bp, homo sapien
tagtggttatttgtagtaaatttgcygagaaccttaaagcaggattcctc

SEQ ID NO: 101587 - DNA, 50 bp, homo sapien
ggttaaatgagttaacgtttacaaartgcttataatagtttggtatgtag

SEQ ID NO: 101588 - DNA, 50 bp, homo sapien
atcatctgactttggactttctgaarcaataacatcggaaagttaatcag

SEQ ID NO: 101589 - DNA, 50 bp, homo sapien
tgcctaaatcctcctgagttgttcayaggtatttcatgtgttagttattc

SEQ ID NO: 101590 - DNA, 50 bp, homo sapien
ttggggttgcacttggccatgagtaygtggaaggctggtggaagtgagat

SEQ ID NO: 101591 - DNA, 50 bp, homo sapien
tgctgtaataaatgaaattcttctcmatctaaggttagtttgatctcact

SEQ ID NO: 101592 - DNA, 50 bp, homo sapien
tcaggcattcctaagtggtttttgaygaatgacttatagatagaaaaata

SEQ ID NO: 101593 - DNA, 50 bp, homo sapien
ccatgcctggccagctgcagttctartaaaatttatctatatggtagaat

SEQ ID NO: 101594 - DNA, 50 bp, homo sapien
agacaaggccagatatgggatcgaaygaaatagaaaggagaagagaactg

SEQ ID NO: 101595 - DNA, 50 bp, homo sapien
aaacatcaaaagaatactccatactyaaacaagagacacagaaacaattc

SEQ ID NO: 101596 - DNA, 50 bp, homo sapien
agagttcaggataataaggttgtcartctcaagtattttatgtaaaagga

SEQ ID NO: 101597 - DNA, 50 bp, homo sapien
tttatcggtggcaattacaagtgagwagtctcctccaatgggtgtgtttt

SEQ ID NO: 101598 - DNA, 50 bp, homo sapien
agagggctcaacattttgctaggccmatgctgctgtggtagtgcgactgt

SEQ ID NO: 101599 - DNA, 50 bp, homo sapien
gaataattctagctcaaatctggaaygatgtggatacatagcatgtactc

SEQ ID NO: 101600 - DNA, 50 bp, homo sapien
actgtgttcctcttgtttattcttcrctttcctttgttcttgcttcccac

SEQ ID NO: 101601 - DNA, 50 bp, homo sapien
cttttgtgaaagtctattagatccaycaagtaactcctacacaggtcatt

SEQ ID NO: 101602 - DNA, 50 bp, homo sapien
tgaagaattatgacaaagtatagaayaaacctatgtaaaagaaaaagtta

SEQ ID NO: 101603 - DNA, 50 bp, homo sapien
tgtgctttctgtagtctctgataaayctagctttttaaggaccttaggtt

SEQ ID NO: 101604 - DNA, 50 bp, homo sapien
ttagttaacccatgggtcacattcargtcctatgaactgacagtgagtta

SEQ ID NO: 101605 - DNA, 50 bp, homo sapien
catgttaagaaaaatatagcaagcaygtaaatgtttaattcagggcattt

SEQ ID NO: 101606 - DNA, 50 bp, homo sapien
ttcttgaaatcagtgctatgcaaaawcacaatttgaaacttggttactca

SEQ ID NO: 101607 - DNA, 50 bp, homo sapien
ccctgaaaggaacccttcagaaaaaytaccatgcctgtaatcctgccata

SEQ ID NO: 101608 - DNA, 50 bp, homo sapien
aagcttcgagaagagatatccaaaaracaaggagatgtggcagaaggcct

SEQ ID NO: 101609 - DNA, 50 bp, homo sapien
taaatcgtaggcctttcgcctgtaayacctgatccaaatcaatcccaaat

SEQ ID NO: 101610 - DNA, 50 bp, homo sapien
ctgctgctgcagctggtctcagggcmatgactgatacttttcattttcct

SEQ ID NO: 101611 - DNA, 50 bp, homo sapien
aacaattatgtcatataagtatgtayccccaaacaatatattttctagtt

SEQ ID NO: 101612 - DNA, 50 bp, homo sapien
aggattaaaaaatatatacagtacawcatatagagccagggtaaatactg

SEQ ID NO: 101613 - DNA, 50 bp, homo sapien
tagcaaagaggccagatgagaacaarctttcttacctgtccctaaactac

SEQ ID NO: 101614 - DNA, 50 bp, homo sapien
actctattgtctgtcttgctgattakagtcatttcagtgggtgtgtagtg

SEQ ID NO: 101615 - DNA, 50 bp, homo sapien
agagaaaatcaatgacaccgaaaatkagtgacaccgaaagctagttcttt

SEQ ID NO: 101616 - DNA, 50 bp, homo sapien
ttctggctataaaattttctctaatsactgctttagctatagtctacaaa

SEQ ID NO: 101617 - DNA, 50 bp, homo sapien
tcgacctcctactctctattgttccrcagacattcttagacagagtggaa

SEQ ID NO: 101618 - DNA, 50 bp, homo sapien
aggttgttaacatttaagccaagtartaaaaagttgaaagaacccatgtt

SEQ ID NO: 101619 - DNA, 50 bp, homo sapien
tgaaaacaaggacttaaaagcacacrctgtctatgttgcatcttccactc

SEQ ID NO: 101620 - DNA, 50 bp, homo sapien
atggctaaatctagtcctatttcaamcttttgagtaatactgtgttttta

SEQ ID NO: 101621 - DNA, 50 bp, homo sapien
gactccattcattacttgattcttawaaggccccacttcaacaaggggtc

SEQ ID NO: 101622 - DNA, 50 bp, homo sapien
acagatgagtacagtttcaatcacayggtggtcgactgcggctgctgtgc

SEQ ID NO: 101623 - DNA, 50 bp, homo sapien
gacagggtcttgctctgttgcctagsctagcgtgcagtgtcacaatctca

SEQ ID NO: 101624 - DNA, 50 bp, homo sapien
aaacatgtaaccctgggtgaacccgracttcaaagtgttttgggggagtg

SEQ ID NO: 101625 - DNA, 50 bp, homo sapien
ctatcatttaaggaacttaatgataktagcttttctcctatctttaataa

SEQ ID NO: 101626 - DNA, 50 bp, homo sapien
cctattctgcaaatttgttctaatgmaataagttgtgtatgcagaaaagg

SEQ ID NO: 101627 - DNA, 50 bp, homo sapien
tagaagggagtctgtcagtcatgcaytcgaggtaaacagatgcatgggaa

SEQ ID NO: 101628 - DNA, 50 bp, homo sapien
gcacaaagtaagaaaacaaggaagaytcggagctgatctcatacctcgct

SEQ ID NO: 101629 - DNA, 50 bp, homo sapien
gtgatgcttctaatcggcgtccacastcattcttgatactgggatgggta

SEQ ID NO: 101630 - DNA, 50 bp, homo sapien
gtccaaaatgtgaataaataggtgcratgaagtatggcaaatttctttgt

SEQ ID NO: 101631 - DNA, 50 bp, homo sapien
agttctgaaacccaaaatgtcggcartataagcgcacatcagttaacata

SEQ ID NO: 101632 - DNA, 50 bp, homo sapien
gagcctggatgagacaaagatgatamagatagtgaagactatgaaaggat

SEQ ID NO: 101633 - DNA, 50 bp, homo sapien
ttctaaaagactgttaaagacagagracttgaccttgatgaatgtagtcg

SEQ ID NO: 101634 - DNA, 50 bp, homo sapien
accgatctcctaccattcagtcttayctactgccaatcctttaaattcta

SEQ ID NO: 101635 - DNA, 50 bp, homo sapien
aacataagaaacactttatgaatgaygagactgtattgacaccaattaac

SEQ ID NO: 101636 - DNA, 50 bp, homo sapien
aggagaagtctctacaaactaaagakctctgtaaacatctactcaggtcc

SEQ ID NO: 101637 - DNA, 50 bp, homo sapien
ataataggaagaagtgtgtttatacsatcttttcctggaaagagagagca

SEQ ID NO: 101638 - DNA, 50 bp, homo sapien
aagctcttgtttcagattgtgtcggycacaggtattcccctaggaaagtc

SEQ ID NO: 101639 - DNA, 50 bp, homo sapien
caatcatggagtcctgcgagaataasaagtggacaagtaaaaacaagaat

SEQ ID NO: 101640 - DNA, 50 bp, homo sapien
aaagccgagtggttgtccatttgaasaggcattaaaaaaaattgtctctg

SEQ ID NO: 101641 - DNA, 50 bp, homo sapien
accaacaggacgcaggtagtgagaayactaggaaaatagaaatgcaatca

SEQ ID NO: 101642 - DNA, 50 bp, homo sapien
gaattgtagcatatctaaatatcaaygtctcaggttaatcattatcttaa

SEQ ID NO: 101643 - DNA, 50 bp, homo sapien
aagttaattgaatacaaggttaccaraatgattgttccatatgatttcat

SEQ ID NO: 101644 - DNA, 50 bp, homo sapien
tttgaaagaaagtaattcaccttcaraaatacatggggaaaaaacttcat

SEQ ID NO: 101645 - DNA, 50 bp, homo sapien
cttgaaaagcattaacagagctaccrcagtatttattagactttataata

SEQ ID NO: 101646 - DNA, 50 bp, homo sapien
cacattggagtagagctgggaggtcraataagataaggagttaaaaattt

SEQ ID NO: 101647 - DNA, 50 bp, homo sapien
tgcctcatgtcatagcccagaattarcagagacattcttctaccttttga

SEQ ID NO: 101648 - DNA, 50 bp, homo sapien
aagaatgctaattatataatagttaygtatccacttgttcagtttggaat

SEQ ID NO: 101649 - DNA, 50 bp, homo sapien
aacatctttagctcacagcataatgsaaagaaagtgcccttcaggggaac

SEQ ID NO: 101650 - DNA, 50 bp, homo sapien
tacattcagagcacaaagaagagccraaaaggacagacactgccagggga

SEQ ID NO: 101651 - DNA, 50 bp, homo sapien
aaaacctcaggcacatttttgttagsatacctgatacttgctagcaagcc

SEQ ID NO: 101652 - DNA, 50 bp, homo sapien
gcgcctttaaaattctacttcttgaytaagataatgccgcagacagactt

SEQ ID NO: 101653 - DNA, 50 bp, homo sapien
aggtggaaaaactggactttcttggmggtagatgccacatgtgtggttta

SEQ ID NO: 101654 - DNA, 50 bp, homo sapien
tagtgtggtatgtgagtccgaagaargagtcattagttaggatgcattta

SEQ ID NO: 101655 - DNA, 50 bp, homo sapien
tgggaaataagcattcagtccatagyaactgcctaactcacagtaaatgc

SEQ ID NO: 101656 - DNA, 50 bp, homo sapien
actattagagaagtataaaggttaaygtaataataatcacatagaatttt

SEQ ID NO: 101657 - DNA, 50 bp, homo sapien
atatttgttctgagaaactagattcmagttaatgaggaccaggataaacc

SEQ ID NO: 101658 - DNA, 50 bp, homo sapien
ttcatcaattccactgcatgtgctcrtgggacactaagctctgaaaaagg

SEQ ID NO: 101659 - DNA, 50 bp, homo sapien
accaaaagtatgaggaagactaggtraagagatctgggctgccatgtgtg

SEQ ID NO: 101660 - DNA, 50 bp, homo sapien
cttctcccttattctgtgcacagtgrcaactactgcccattttacagatg

SEQ ID NO: 101661 - DNA, 50 bp, homo sapien
aagtgctttgtagatatcagttaatyggtaatatctcctagaggggaacg

SEQ ID NO: 101662 - DNA, 50 bp, homo sapien
atgactctccatcaaattaaattgcwtgttcttggaggaggggggaggta

SEQ ID NO: 101663 - DNA, 50 bp, homo sapien
tcacagaaactaggcaaaaatttaaraaaacattctagtctctaaaaccc

SEQ ID NO: 101664 - DNA, 50 bp, homo sapien
gtggagtgaggctgtgaagaggttayagtgttttgcacatcttgtgtggc

SEQ ID NO: 101665 - DNA, 50 bp, homo sapien
actttacatacataagcactatatgratgcgactagaaatttagaaataa

SEQ ID NO: 101666 - DNA, 50 bp, homo sapien
ttatgttaaattcaacacttatagcratgaactcagtagtttgtataagc

SEQ ID NO: 101667 - DNA, 50 bp, homo sapien
gatacctagagtgctcttcaatgccrcaaaacagatgagcaagtctgggg

SEQ ID NO: 101668 - DNA, 50 bp, homo sapien
agtcctgtctaaagtatcccattacrgtaaggacgaaggagatcgtaaag

SEQ ID NO: 101669 - DNA, 50 bp, homo sapien
ctcattggatgactcacatttaaaargtagctttattgctttaaaacaga

SEQ ID NO: 101670 - DNA, 50 bp, homo sapien
tatggaagataatgactatcctaaayaatatcaggcactttaaatatata

SEQ ID NO: 101671 - DNA, 50 bp, homo sapien
cttcagggatgagcccatcagtgacmaagtacaaactgttggccgattat

SEQ ID NO: 101672 - DNA, 50 bp, homo sapien
tggtagtgagaagggcatatggaacragaaagcttgctcggaagtgtttt

SEQ ID NO: 101673 - DNA, 50 bp, homo sapien
gagaaggaaatcaggagaatgtgatraacagaaaacaagagttgtatgaa

SEQ ID NO: 101674 - DNA, 50 bp, homo sapien
ttatgttgtccactggaatggaacaraattaagaaggcctatgaatttat

SEQ ID NO: 101675 - DNA, 50 bp, homo sapien
tctcagtttggggaaacatcagaatwatcataaatggagataatttatgt

SEQ ID NO: 101676 - DNA, 50 bp, homo sapien
cttaagtatacgtagctagcgaccarattaaaacagaacaaataggacct

SEQ ID NO: 101677 - DNA, 50 bp, homo sapien
tgggggaaagagcaattattttaagscagaatgtccaaaatgatgccgtc

SEQ ID NO: 101678 - DNA, 50 bp, homo sapien
attattagactagacatagctcatayactttacaataaattatgagatct

SEQ ID NO: 101679 - DNA, 50 bp, homo sapien
aaataatcttaaatattattgtcctwacagctgcttctagaaacacatca

SEQ ID NO: 101680 - DNA, 50 bp, homo sapien
attttatgttgacatatccatgaatwtaatgctacaatatatgaatatga

SEQ ID NO: 101681 - DNA, 50 bp, homo sapien
catttctagaaatttatcctaaggamataatcagcgagatgcacaaatat

SEQ ID NO: 101682 - DNA, 50 bp, homo sapien
caatcatcaatgttacaaaccagaaygctgatatcaggtagtcatgttta

SEQ ID NO: 101683 - DNA, 50 bp, homo sapien
gcctaagagatttattagctaaatayatgagtagtccttgtttggattct

SEQ ID NO: 101684 - DNA, 50 bp, homo sapien
ttagttaaatctagtcaattgcttargatccagctcagatgtcaccttct

SEQ ID NO: 101685 - DNA, 50 bp, homo sapien
gtggctgagtgctacaagtgagatayaacgttttttagggaagtataaaa

SEQ ID NO: 101686 - DNA, 50 bp, homo sapien
aggaattcgaagtaactgtagggtawccaaacatagatatggatctagaa

SEQ ID NO: 101687 - DNA, 50 bp, homo sapien
aaggtacatttaattgaacaagtcaycagaaatgcattcagtatatgagt

SEQ ID NO: 101688 - DNA, 50 bp, homo sapien
taaatacttgtgtgcaaagacattcrctgcggctttacaacagtaaacaa

SEQ ID NO: 101689 - DNA, 50 bp, homo sapien
aaattgatgtgcctctaaattgataygttgggatcatttgcctctagttc

SEQ ID NO: 101690 - DNA, 50 bp, homo sapien
cccagttgaggaccactgctttagartataaattgatgtgcctctaaatt

SEQ ID NO: 101691 - DNA, 50 bp, homo sapien
atctccccatctccagatccttaatrtcatcacatctgtgaaatcgcttt

SEQ ID NO: 101692 - DNA, 50 bp, homo sapien
tggcagcctccctgactagggcctaragagatcagtcaggaatctcaggc

SEQ ID NO: 101693 - DNA, 50 bp, homo sapien
aaaagcaaacttatatttgcagaaaycccaagtctggttaaccatatttc

SEQ ID NO: 101694 - DNA, 50 bp, homo sapien
tttagtttaaaatgaaatcattgcayaatactgatgttagaggttagaat

SEQ ID NO: 101695 - DNA, 50 bp, homo sapien
tgtttgtcaaatatctatcattctayaccagggtctctcagcctcagcac

SEQ ID NO: 101696 - DNA, 50 bp, homo sapien
gatagatccaattatttcatttctasgcgagacattagtggagacagtat

SEQ ID NO: 101697 - DNA, 50 bp, homo sapien
acttgcaatatgtatttctctctcaygttatatgtgtgcttggtggtcac

SEQ ID NO: 101698 - DNA, 50 bp, homo sapien
tcctagaagcatgtcctgtgaggcaytgccaagtcgcattgatgcatttc

SEQ ID NO: 101699 - DNA, 50 bp, homo sapien
gctcaggaagggaatttgcacaatgraaataacttaagaactgtgaaact

SEQ ID NO: 101700 - DNA, 50 bp, homo sapien
atgtcagattagagaaaccaaacaaygtgacggtacatgtgatgaaaagc

SEQ ID NO: 101701 - DNA, 50 bp, homo sapien
atgacaatttaaagactttccatctsaattgtacagacaaccatagagag

SEQ ID NO: 101702 - DNA, 50 bp, homo sapien
agattagaactatatgttcttcaaayaggatgaaacgtgttctagaccta

SEQ ID NO: 101703 - DNA, 50 bp, homo sapien
cgttatgtaatgttcttctttgttcytttctaccattactggtttaaagt

SEQ ID NO: 101704 - DNA, 50 bp, homo sapien
cccggagaagagctacaacaggaaasgaatcagggtagcatcgtgcctct

SEQ ID NO: 101705 - DNA, 50 bp, homo sapien
tttatgacagacagactcttggattyaggcttaggacaagcaaacctttc

SEQ ID NO: 101706 - DNA, 50 bp, homo sapien
tcaactttccacctctgttaactacrctgcagaaacttttgacactgaac

SEQ ID NO: 101707 - DNA, 50 bp, homo sapien
acacacatctgcaccaccagagtgasagcaagaaaatgcaaaactcagca

SEQ ID NO: 101708 - DNA, 50 bp, homo sapien
gttttgcttttttatgttctatcatmaaatcttggaagagacatgacttt

SEQ ID NO: 101709 - DNA, 50 bp, homo sapien
gcttagtggacccacagaagtgaccrgacccaggagtctctctgagcgcc

SEQ ID NO: 101710 - DNA, 50 bp, homo sapien
accaaggacttgttccaggtattaaygatgtgtcccagaagcaaaatctg

SEQ ID NO: 101711 - DNA, 50 bp, homo sapien
caattccttcctcccaactttcttamaatgataacatatatgagaagaaa

SEQ ID NO: 101712 - DNA, 50 bp, homo sapien
taaatttaattcagaaatataaaaartcctattcttgcctctttgcgtca

SEQ ID NO: 101713 - DNA, 50 bp, homo sapien
cccccgcccgattagagtccgtccartgaatatctgtttaacagaataat

SEQ ID NO: 101714 - DNA, 50 bp, homo sapien
atagctctactctttttagtgtggtyatctagcttttgactgataatttc

SEQ ID NO: 101715 - DNA, 50 bp, homo sapien
aaccacactaaaaagagtagagctawatatgctagctgtattctggcagt

SEQ ID NO: 101716 - DNA, 50 bp, homo sapien
ctctaacgtgtgaatgaggaaaatasaacctttgtaaagcctttggcacc

SEQ ID NO: 101717 - DNA, 50 bp, homo sapien
ttaacttttaaagaagaggatctcaygggaaatcagatgccatgggaaag

SEQ ID NO: 101718 - DNA, 50 bp, homo sapien
tgccatgggaaagctatgtgactgartaaacaataagccaataaaggaag

SEQ ID NO: 101719 - DNA, 50 bp, homo sapien
atgcatagtgtcgtcaaatgattgcmcaatagttaagtgtaacaatatga

SEQ ID NO: 101720 - DNA, 50 bp, homo sapien
cagcagcattccaccatgctcatccrcgtggcaggatgacatacccaatt

SEQ ID NO: 101721 - DNA, 50 bp, homo sapien
aactctcctcaaatgacccagttggwatacgcctttcatttcctgtaaga

SEQ ID NO: 101722 - DNA, 50 bp, homo sapien
catggatgctccccagtcttcttaaygtgcctttatttagcatgttcaaa

SEQ ID NO: 101723 - DNA, 50 bp, homo sapien
agcatacattccaaatactgtatgaytcaaaggctatctcgaacacttat

SEQ ID NO: 101724 - DNA, 50 bp, homo sapien
caaaatactcttatgactccagagaytcaaaggattttaggagctgtaca

SEQ ID NO: 101725 - DNA, 50 bp, homo sapien
tcttctgcaatgctagaaagtagcaygaagctatattagaatttcagcaa

SEQ ID NO: 101726 - DNA, 50 bp, homo sapien
ctttccatcttggcaacggttcatamccatgtaaagctgataacaaaata

SEQ ID NO: 101727 - DNA, 50 bp, homo sapien
ccgttgccaagatggaaagcccttcraggactgttattcctcatcctcag

SEQ ID NO: 101728 - DNA, 50 bp, homo sapien
taaatctagaatgcaggaaatgctgyagattaaaggatccattttccata

SEQ ID NO: 101729 - DNA, 50 bp, homo sapien
agattagaggaccgagagagatgcaygtcaggaaaatcagctaacagact

SEQ ID NO: 101730 - DNA, 50 bp, homo sapien
cccgaagacctacatgcttgaagctraaccatttgctctccttgcttgag

SEQ ID NO: 101731 - DNA, 50 bp, homo sapien
aaagtttattaattaaatattatgaycagtttatggaccaaattatatag

SEQ ID NO: 101732 - DNA, 50 bp, homo sapien
tccaaattgactgtgaaagacaagcygagtgtgaataatatattctgttg

SEQ ID NO: 101733 - DNA, 50 bp, homo sapien
aatagtaatttttgtctcatcttgaytattgccaaagtttattaattaaa

SEQ ID NO: 101734 - DNA, 50 bp, homo sapien
aagtgaaatatttcacaaaacatacrataagcaattaagacttaaaaccc

SEQ ID NO: 101735 - DNA, 50 bp, homo sapien
tggttagttgagagtgctgatccgtraccaccattgagtcattgatctcc

SEQ ID NO: 101736 - DNA, 50 bp, homo sapien
acaagtaaaactgcttcatttgaaaycaaaccctccagcagtatgcttga

SEQ ID NO: 101737 - DNA, 50 bp, homo sapien
aagcagggacctcatgccttatacayggaaggtctttaataaattcactt

SEQ ID NO: 101738 - DNA, 50 bp, homo sapien
ccctgtgttctattcaaaatggtcaragagagttagagaatcaccaaact

SEQ ID NO: 101739 - DNA, 50 bp, homo sapien
ttttctcctaattatgagtaggtcasatatgattatgatttagctatgtc

SEQ ID NO: 101740 - DNA, 50 bp, homo sapien
caggttccttatttgaatcaattacyaccttcttatatataaattaactc

SEQ ID NO: 101741 - DNA, 50 bp, homo sapien
tgctgtcaacagcaacaaagccatcrataacagcagtaataataccaata

SEQ ID NO: 101742 - DNA, 50 bp, homo sapien
aaaaagaaacctagtatttgtggacrataatgccttcttcccaggggttt

SEQ ID NO: 101743 - DNA, 50 bp, homo sapien
atatctgataaactgcaaatgattaygtttttcttttacttgagaataaa

SEQ ID NO: 101744 - DNA, 50 bp, homo sapien
gcttcacatacctttactcaatttayattccctcaaatgtttttgtttat

SEQ ID NO: 101745 - DNA, 50 bp, homo sapien
atttactgtgttttaaataggttcaytcaggataaatgggaaccaaaaca

SEQ ID NO: 101746 - DNA, 50 bp, homo sapien
caggacacgtgtttgctgtaaaacastgaactaaaaatacagaagaggga

SEQ ID NO: 101747 - DNA, 50 bp, homo sapien
ttattactataatgaccttacttcaygctgggttttgcttatctctctcc

SEQ ID NO: 101748 - DNA, 50 bp, homo sapien
tgtcccgttttctgcatcagttgatytcttttcatgtttttctaggaaag

SEQ ID NO: 101749 - DNA, 50 bp, homo sapien
ccttctaattttaatactctataacrctattacttctacatagctgaatc

SEQ ID NO: 101750 - DNA, 50 bp, homo sapien
aagagcttaacatatcaaagttctcrcaataggaaagcttctgccgggtg

SEQ ID NO: 101751 - DNA, 50 bp, homo sapien
taaatatactttattgaattgcacakagttagttcttcccagttcactgt

SEQ ID NO: 101752 - DNA, 50 bp, homo sapien
atttttaggttttaatactgtgatcycaaagcattccattcccatctaga

SEQ ID NO: 101753 - DNA, 50 bp, homo sapien
gcaatttactcatttgtaaagtgggmaagttagacctcgggatcttatga

SEQ ID NO: 101754 - DNA, 50 bp, homo sapien
tgtcctccaaaaattgtatgaaatcraagtctgtgcaaattaattagaaa

SEQ ID NO: 101755 - DNA, 50 bp, homo sapien
tgtttgttataacttctacctggaayatatctccttgcatggttggctgc

SEQ ID NO: 101756 - DNA, 50 bp, homo sapien
ctgtagggctagagttctacactacrcatttgttacttgctgtgtactgt

SEQ ID NO: 101757 - DNA, 50 bp, homo sapien
gttagaaaatcagtcatcttaccaakgtccatttttagagattcagagaa

SEQ ID NO: 101758 - DNA, 50 bp, homo sapien
atcctttgtaaacttcttgcatgttwtatggcttttgctgcctagaaatt

SEQ ID NO: 101759 - DNA, 50 bp, homo sapien
ctaagttttacttcagccattacaargttaggaaaaaccacggagcaatt

SEQ ID NO: 101760 - DNA, 50 bp, homo sapien
gaattgcccacagtcaattccaggaygaaatttactcacatggaatgata

SEQ ID NO: 101761 - DNA, 50 bp, homo sapien
aaggcagactgaagtgttcataaacygtagtggtctttgaataataactc

SEQ ID NO: 101762 - DNA, 50 bp, homo sapien
gaaaataacttagcttaaaggtacaraaactctcatttcgaaacttagca

SEQ ID NO: 101763 - DNA, 50 bp, homo sapien
tcctctttcctatgagaactttgtcyatatgcgcataggtacaccgagag

SEQ ID NO: 101764 - DNA, 50 bp, homo sapien
aaattaaaggagatgcaaataaatcrcccatagaacacattaaatttctc

SEQ ID NO: 101765 - DNA, 50 bp, homo sapien
agagtgaaatttaaaaaatcacactkaggacgttaaataatgcttgtgca

SEQ ID NO: 101766 - DNA, 50 bp, homo sapien
atgctggcttcagaatggcgtcctcrgagagtagaaagaacaacatcttc

SEQ ID NO: 101767 - DNA, 50 bp, homo sapien
aaggagtagaactcataaattcaaayacaaaaggaggtgcagggcttgga

SEQ ID NO: 101768 - DNA, 50 bp, homo sapien
gcacctgattcatctcacagtgcaarttctctaaaggtgacatggatgcc

SEQ ID NO: 101769 - DNA, 50 bp, homo sapien
taactatgacagtatttctgaactcyatctacagtgaaaatcaaaaagcc

SEQ ID NO: 101770 - DNA, 50 bp, homo sapien
aaaagatttgcttcctttaaattgargtagatttctttctcaggggagtt

SEQ ID NO: 101771 - DNA, 50 bp, homo sapien
ccagaataaaccaaatctcagttcartatagtaatagacctgattattta

SEQ ID NO: 101772 - DNA, 50 bp, homo sapien
tctgacagcagaaagccatttgaaamaacattcagaaccagaaacctagc

SEQ ID NO: 101773 - DNA, 50 bp, homo sapien
ggagaagtgtcagtgcatcttacttyatgagaaatgcatgctcttgagaa

SEQ ID NO: 101774 - DNA, 50 bp, homo sapien
aatttttaataaatgaggaagaaggyattttgccccacacaccctctaaa

SEQ ID NO: 101775 - DNA, 50 bp, homo sapien
tcaaaagtccaaattgctcacataamataaatcctttgcccttcaataaa

SEQ ID NO: 101776 - DNA, 50 bp, homo sapien
acttgcttctagcaaacagaatataraagaaggcatggtatttgacctca

SEQ ID NO: 101777 - DNA, 50 bp, homo sapien
tggacactgaacttctctgtacctgragaaagctccttatgcctctgaat

SEQ ID NO: 101778 - DNA, 50 bp, homo sapien
gcaacaggtgtgttcttggaataaarttcaacccccacttctggctgatg

SEQ ID NO: 101779 - DNA, 50 bp, homo sapien
acttggaatagtctgtggtacatagracaagctggaacctttctcttcag

SEQ ID NO: 101780 - DNA, 50 bp, homo sapien
tctgggatgtcgtttacagtcatacrccatttaacagtgatacattcgca

SEQ ID NO: 101781 - DNA, 50 bp, homo sapien
attcagatgactaataagacactcaycgtaaagatcagtaaagccaatga

SEQ ID NO: 101782 - DNA, 50 bp, homo sapien
agttttaaaaaactgtacttgagatkaatgttaattccttgttttgaatt

SEQ ID NO: 101783 - DNA, 50 bp, homo sapien
ctaatttagtttagattattttttawagtgcacctggcattcaagctatg

SEQ ID NO: 101784 - DNA, 50 bp, homo sapien
aaggcctcataggtaagaaaaggtaracatccaagattgtttctttaaag

SEQ ID NO: 101785 - DNA, 50 bp, homo sapien
aggtgttgggaattcccgagaaagcrgatcggcattattgtttattgctt

SEQ ID NO: 101786 - DNA, 50 bp, homo sapien
ttaccaattaggcaatttctccctcmgaattgaaacagacagagggtgta

SEQ ID NO: 101787 - DNA, 50 bp, homo sapien
gttgttatcttcctggatatattagraaatccacagatttgtgttcctta

SEQ ID NO: 101788 - DNA, 50 bp, homo sapien
gaacttcaataaaggaataggattayactaccctctagtggaagttcaag

SEQ ID NO: 101789 - DNA, 50 bp, homo sapien
tgtctctcttgttctaacctgtgtawacctgccttaagggcggggattct

SEQ ID NO: 101790 - DNA, 50 bp, homo sapien
  misc_feature (45)..(45): n is a, c, g, or t
aatatcttgattacagggggtaaggwtgtctcatatcagtatcangctag

SEQ ID NO: 101791 - DNA, 50 bp, homo sapien
cccaaatatctgttatctccaaacartcaatttttaaacttgcctccacc

SEQ ID NO: 101792 - DNA, 50 bp, homo sapien
cttgttcttccatgatcagaactaakcacaataggaaaacagaagactca

SEQ ID NO: 101793 - DNA, 50 bp, homo sapien
aagggttttgtaaattcctcacaacragttcacaaaacaagtaagagata

SEQ ID NO: 101794 - DNA, 50 bp, homo sapien
tatcttacaaccagggccagaggaamattatgaactaaaaaatctgctga

SEQ ID NO: 101795 - DNA, 50 bp, homo sapien
ggccttccttagctcctcagaacaaytgaattttgctttggacttttgcc

SEQ ID NO: 101796 - DNA, 50 bp, homo sapien
ggcgagaatcttgcccttaacaacarcgtaagagcgtgctggggaacatt

SEQ ID NO: 101797 - DNA, 50 bp, homo sapien
ttcactagccagattcaacagcctarggcaaaagtccaaagcaaaattca

SEQ ID NO: 101798 - DNA, 50 bp, homo sapien
caattcaggtgttcggtgatctccaygggcgagtgacttttattgggaga

SEQ ID NO: 101799 - DNA, 50 bp, homo sapien
aataattatagagatgggtttcatarcataaaaataataggcattacaaa

SEQ ID NO: 101800 - DNA, 50 bp, homo sapien
atcatttcaccctcaaaaatattaaygctcagtgctgccacaggtatggt

SEQ ID NO: 101801 - DNA, 50 bp, homo sapien
ttgtcatgagtatcctgactcattargtggactcattaggtccagtagac

SEQ ID NO: 101802 - DNA, 50 bp, homo sapien
ttacattctgtgcaatactttgagasgatgatcttcaatcctaaggggtt

SEQ ID NO: 101803 - DNA, 50 bp, homo sapien
gtcgcacttctagaaaagtgagatargggactgacaattatttgaagaat

SEQ ID NO: 101804 - DNA, 50 bp, homo sapien
atatttttttgaattgacaataataygtgaacatgtgtatgtacatctaa

SEQ ID NO: 101805 - DNA, 50 bp, homo sapien
taaatgcagttatttggtactccaarcttctgaagatttaaaaaataatt

SEQ ID NO: 101806 - DNA, 50 bp, homo sapien
gataattctgaagttttgttttctartacttccttgaattcagcatgtac

SEQ ID NO: 101807 - DNA, 50 bp, homo sapien
aatctttagaacaaagtataacagayatatttaagagattatggcgtatc

SEQ ID NO: 101808 - DNA, 50 bp, homo sapien
agagtaatgtcatcatgaacatctcycggtgctactgatagatttttctc

SEQ ID NO: 101809 - DNA, 50 bp, homo sapien
aaacacacaacagtgctgccaactaygtattattattcccattctacaga

SEQ ID NO: 101810 - DNA, 50 bp, homo sapien
gtccctgaagaaactgacaggagaargttcctcaggagttttgatgggtc

SEQ ID NO: 101811 - DNA, 50 bp, homo sapien
gcgattctttcactggaagggatgaytcagagaggaagagttggcattaa

SEQ ID NO: 101812 - DNA, 50 bp, homo sapien
ttattattgaggtgtgtaaaagatgytagaggagcatagaggagggaaaa

SEQ ID NO: 101813 - DNA, 50 bp, homo sapien
tggtcactctctgttccctttccagwcgaatctttcccctcttccaaatg

SEQ ID NO: 101814 - DNA, 50 bp, homo sapien
ctttttacacactacttcagatcctygagtgctaacattatgctagaata

SEQ ID NO: 101815 - DNA, 50 bp, homo sapien
catctaggctaaataaattacgtaamgaattatgtgattacttattgtgt

SEQ ID NO: 101816 - DNA, 50 bp, homo sapien
tattatttatgactgttggtatacartcaaatataatctaacttggcctc

SEQ ID NO: 101817 - DNA, 50 bp, homo sapien
agaaatggagagactaaaataaatamctctgtacctgtgtaaacagcatt

SEQ ID NO: 101818 - DNA, 50 bp, homo sapien
cgtatattttcaattctcttggacayatacctagaaatggaattgctgag

SEQ ID NO: 101819 - DNA, 50 bp, homo sapien
tatctgatctaaatgacaactacatraaacaataaatataaatgtatgtt

SEQ ID NO: 101820 - DNA, 50 bp, homo sapien
ctgcagatgtaagctcttttagaagsaacacatagcgaaggaggaataaa

SEQ ID NO: 101821 - DNA, 50 bp, homo sapien
cataagagagttgtgcaataacataraacgtgcaatttataacatgtgta

SEQ ID NO: 101822 - DNA, 50 bp, homo sapien
gtgatgagctgttcaccttcaccggycatttctctcactgctttagtgcg

SEQ ID NO: 101823 - DNA, 50 bp, homo sapien
taggattagttttcctctggcgtgasttcatcttgactaattacatgtcc

SEQ ID NO: 101824 - DNA, 50 bp, homo sapien
caatcacaaaatatatgtgaatacastcttaattatgggccaggtactga

SEQ ID NO: 101825 - DNA, 50 bp, homo sapien
tacacatggaggatgggaatcttctmacacaatttcattttagggtgcat

SEQ ID NO: 101826 - DNA, 50 bp, homo sapien
agaatgcagcaagcagcaaagccacygtggatgctctaggccagtggctc

SEQ ID NO: 101827 - DNA, 50 bp, homo sapien
taattttttggtaatgcttgctttamagatttgcagataaatcatggcag

SEQ ID NO: 101828 - DNA, 50 bp, homo sapien
acaatggttctaattcttgtggcaaycataggcccctttgagaacatgat

SEQ ID NO: 101829 - DNA, 50 bp, homo sapien
aacctcagacatcttagctccacttrtctggaatacagctcctgtaacac

SEQ ID NO: 101830 - DNA, 50 bp, homo sapien
aaaaattaattacctgattgaaatcracggatgagtttattatttttcaa

SEQ ID NO: 101831 - DNA, 50 bp, homo sapien
gggggcaataatgtggattaaattawcagttttgtatcaaatgaccacat

SEQ ID NO: 101832 - DNA, 50 bp, homo sapien
agataccagagtctaagtgtttcatytagtgtggaaattaaggggaaaaa

SEQ ID NO: 101833 - DNA, 50 bp, homo sapien
taatatacatgtcagtctttgaaatragaacattgaagcttgactactct

SEQ ID NO: 101834 - DNA, 50 bp, homo sapien
tcagccaaagtgtgtgccactgtctsacataaaacgaagatgtttcctga

SEQ ID NO: 101835 - DNA, 50 bp, homo sapien
gctaagttgtaagatacacatggaarataacaatcacgctgtattcagaa

SEQ ID NO: 101836 - DNA, 50 bp, homo sapien
gttcagctactatattacctacttgrattatattggtagccaggactctg

SEQ ID NO: 101837 - DNA, 50 bp, homo sapien
aaaaaagaatgaacagagtttgtcargttctagtacccatatgaagcatc

SEQ ID NO: 101838 - DNA, 50 bp, homo sapien
agcagaggccaaatggccacagctgratgagagaggtcccctggggctgt

SEQ ID NO: 101839 - DNA, 50 bp, homo sapien
aggcattttggacatgtacagaaaaragtcaatggctagccaaatctgac

SEQ ID NO: 101840 - DNA, 50 bp, homo sapien
ttagaatattttcagtgtccatatawacagatgagttaatctagagaaac

SEQ ID NO: 101841 - DNA, 50 bp, homo sapien
ttttctgccctccagttttgtatgaragacgtgtgagtaagccaatgatt

SEQ ID NO: 101842 - DNA, 50 bp, homo sapien
taaatgagatgatgaacatttacaayacgctttcatagggcactaaagga

SEQ ID NO: 101843 - DNA, 50 bp, homo sapien
ctgcaggaatgctgtcagctctgcartgcaaggaataggaacagcccagc

SEQ ID NO: 101844 - DNA, 50 bp, homo sapien
ttatccatgttaacacagatgtacaytgactatgccagcagaggtaaagc

SEQ ID NO: 101845 - DNA, 50 bp, homo sapien
tcattaccaagatacctggagaacaytctcatttaacaagaacaggtagc

SEQ ID NO: 101846 - DNA, 50 bp, homo sapien
ggagagaaatcaacctgtaagcaaarccacctcttcctcccctgccatga

SEQ ID NO: 101847 - DNA, 50 bp, homo sapien
accaccctgctgaccgtgccgtaagracctttggaagcttgggagcccgt

SEQ ID NO: 101848 - DNA, 50 bp, homo sapien
tgcaaagcctgcaagcgctctacaartacaaggtaacacggcttcagaaa

SEQ ID NO: 101849 - DNA, 50 bp, homo sapien
aatgataacaacaaaaacagagaaaytggaattacacagccaaaaaccca

SEQ ID NO: 101850 - DNA, 50 bp, homo sapien
ggcaatgtctcaatcccgtcttttakgcttctttgttcactttatcttca

SEQ ID NO: 101851 - DNA, 50 bp, homo sapien
aattaaaggaagcctgagcctcagayggagagttgggaagacctggactt

SEQ ID NO: 101852 - DNA, 50 bp, homo sapien
ggatccacccaaagaggtaatcgccyggagcaaggtgaggtagaagcagg

SEQ ID NO: 101853 - DNA, 50 bp, homo sapien
ctgatggctgatcattgtagtgcccwttggaggttggcatgattagttat

SEQ ID NO: 101854 - DNA, 50 bp, homo sapien
tagtagatctcatcagacatcttagscagtctttctcccatttaaaaaat

SEQ ID NO: 101855 - DNA, 50 bp, homo sapien
aaaagactcaccttttggaatctaarataaatgtgcttgtcagttcaggc

SEQ ID NO: 101856 - DNA, 50 bp, homo sapien
cttgaaattttcatgtggttttgcaytcctgtgaaatgaagatattatta

SEQ ID NO: 101857 - DNA, 50 bp, homo sapien
aaataaaaaatattacttagcagtamaaaactatagagaataaaatttaa

SEQ ID NO: 101858 - DNA, 50 bp, homo sapien
tagctataaatctgtatgtgaaaatragtcaatctgaaactaagatattt

SEQ ID NO: 101859 - DNA, 50 bp, homo sapien
catttggcaaataatccacacctagmagaggaaaagctagtgctcactct

SEQ ID NO: 101860 - DNA, 50 bp, homo sapien
gacttactttaaccacaggacgagtraaatgatgtgtcactggacacttg

SEQ ID NO: 101861 - DNA, 50 bp, homo sapien
ggctacgcaaaccacagcagagaatrcatgtgtttttttgtttttgtttt

SEQ ID NO: 101862 - DNA, 50 bp, homo sapien
tttgatctataaattcaacacaatastaatgaaaccacacaaatattttg

SEQ ID NO: 101863 - DNA, 50 bp, homo sapien
acaggagaactagagaaccctgctcyggtgggatttgcagttttgattct

SEQ ID NO: 101864 - DNA, 50 bp, homo sapien
gagaggacctacagtagatttaacaytggaagttcaacactgactgaaga

SEQ ID NO: 101865 - DNA, 50 bp, homo sapien
aaagaccatggggcctaagtcacttmtctgagtcagcccttccggatgaa

SEQ ID NO: 101866 - DNA, 50 bp, homo sapien
atgcaagcagaactgtgccacaagcwattgtagatgcatgaaagaactca

SEQ ID NO: 101867 - DNA, 50 bp, homo sapien
aaagaggtgtcttaagctggaaaccrgaaggcagtgccaggatggatctt

SEQ ID NO: 101868 - DNA, 50 bp, homo sapien
ttctcattacttgcagacttgacaayaataccttctatgtcttcatgcac

SEQ ID NO: 101869 - DNA, 50 bp, homo sapien
atcctgagaacactgcctaccacacracctttttatttggtatacactgt

SEQ ID NO: 101870 - DNA, 50 bp, homo sapien
atgtgtgctgaagtacattaaaacaytggtataaaacactagcacattgc

SEQ ID NO: 101871 - DNA, 50 bp, homo sapien
gagagatttcataatggttacagaayagcattgctaacaaccttagaaat

SEQ ID NO: 101872 - DNA, 50 bp, homo sapien
tcgcttttggcacatatctacagaartaattgtctctctcaaaatgccag

SEQ ID NO: 101873 - DNA, 50 bp, homo sapien
ctgagtcaggattctatgattgcaamtaaccaggacatggctgcactcct

SEQ ID NO: 101874 - DNA, 50 bp, homo sapien
tgtgttctctaatccaactatgtcarctcttcaaaagtacatattttgat

SEQ ID NO: 101875 - DNA, 50 bp, homo sapien
tatggtgttccttccatagctataaytgctttactaatttttaggttatt

SEQ ID NO: 101876 - DNA, 50 bp, homo sapien
tcaactcaagtgatagccaaaattgraagctattgaactttgtgctgatt

SEQ ID NO: 101877 - DNA, 50 bp, homo sapien
gttacatccctgacctcatcaccaasagaaaccataccacgtgcaagatt

SEQ ID NO: 101878 - DNA, 50 bp, homo sapien
accatagagcaattttgtggtcattytcctcactcgaaaaagacataagc

SEQ ID NO: 101879 - DNA, 50 bp, homo sapien
gagattgtgaactatgcagaaagagragaaacaaggataggacctagatt

SEQ ID NO: 101880 - DNA, 50 bp, homo sapien
attgtcagtttaaagcattttgtcaytaaaatcaaagaatttgaactgcc

SEQ ID NO: 101881 - DNA, 50 bp, homo sapien
ccaggtggctaactgggcctaagttyaaaatagagccaagaagcaatttt

SEQ ID NO: 101882 - DNA, 50 bp, homo sapien
gaaggacactgagagaggtagtaacragtggctacccacaagatggacaa

SEQ ID NO: 101883 - DNA, 50 bp, homo sapien
tgagactgttgttgagattgctttayatttgatgcaaagtccgtatatta

SEQ ID NO: 101884 - DNA, 50 bp, homo sapien
gccacctgggatccatcttgaagaaytggcttgaaggattcacatttgtt

SEQ ID NO: 101885 - DNA, 50 bp, homo sapien
ttcaattaacatgtttaaccagaaaytgctgaaggcctctctgtgacaat

SEQ ID NO: 101886 - DNA, 50 bp, homo sapien
ttctgattttgtttatatagtacaawttagctgttttagaacttcatata

SEQ ID NO: 101887 - DNA, 50 bp, homo sapien
ctctatactgtgctggaattgaaccrcccttctttattataagctgtcct

SEQ ID NO: 101888 - DNA, 50 bp, homo sapien
ggaatttgaatagaacatattattasactaccttataagctaatcttctg

SEQ ID NO: 101889 - DNA, 50 bp, homo sapien
aggaagttttctaaacaaaccaaaaktacgagggccgtaaggcagtgtgg

SEQ ID NO: 101890 - DNA, 50 bp, homo sapien
catttgtactaaaactgagtatgcgraacacatggaaaaaaccagcacac

SEQ ID NO: 101891 - DNA, 50 bp, homo sapien
atgctcagccactgatagatcctcasattcattccctgatacgtggaata

SEQ ID NO: 101892 - DNA, 50 bp, homo sapien
ctagaatcttatgggatagaaaagtwacagttgtcccaagtagtagatat

SEQ ID NO: 101893 - DNA, 50 bp, homo sapien
tggagctgattgggaggaaaaatacsaaattagagccagatcttttggcc

SEQ ID NO: 101894 - DNA, 50 bp, homo sapien
cttccctggcacccaggctactatamggatgtgcctcactggttattatt

SEQ ID NO: 101895 - DNA, 50 bp, homo sapien
caagtttgtccgaaaaaacaggtcarattagctcagttttacacacaaaa

SEQ ID NO: 101896 - DNA, 50 bp, homo sapien
tattaggacataaatattcaaatatragagcaatcgggtccaaccaccaa

SEQ ID NO: 101897 - DNA, 50 bp, homo sapien
agccccatagcgcttcctctttgagwccatgttacagtttattcaaccaa

SEQ ID NO: 101898 - DNA, 50 bp, homo sapien
caagacagtttcaattagattgtacyctttcaaaaggtatctcatttgaa

SEQ ID NO: 101899 - DNA, 50 bp, homo sapien
ctttgtgaagaatttgcatttttaaygagagcataccaatataaggtgct

SEQ ID NO: 101900 - DNA, 50 bp, homo sapien
acaaaagctttcagtagtcctagtartaatataagatagttttttttaaa

SEQ ID NO: 101901 - DNA, 50 bp, homo sapien
aacattttcaccagcaggaatctcaytaccctcatatctggaaatgaaac

SEQ ID NO: 101902 - DNA, 50 bp, homo sapien
attatgttcaggtgacctcaaactcrcagaaagcatcttgcaaagaaaaa

SEQ ID NO: 101903 - DNA, 50 bp, homo sapien
agaagaaaatactgaaatcttagaaygtttactgtagaaattctcatgga

SEQ ID NO: 101904 - DNA, 50 bp, homo sapien
gggcccactatgggtgacaaagatawggaattctacaatatttaacatat

SEQ ID NO: 101905 - DNA, 50 bp, homo sapien
aatatttcatttaatcctcatgacaygctaggtagttgtaattattatga

SEQ ID NO: 101906 - DNA, 50 bp, homo sapien
tatattaaaaaaaattacttgacacmgtataggttgaatttgagaaaaaa

SEQ ID NO: 101907 - DNA, 50 bp, homo sapien
gagaagaaaacaggggtctctaggayaaggttacaaagggagaatttcct

SEQ ID NO: 101908 - DNA, 50 bp, homo sapien
cacaccttagagtgtgaagtctccaktaaggctttctcccctctctgagg

SEQ ID NO: 101909 - DNA, 50 bp, homo sapien
taaaagcagtgtatgcttattgtgawaccattagacttttgttaaaaggg

SEQ ID NO: 101910 - DNA, 50 bp, homo sapien
aaaatttgcgtagaaaatttgaaaakttgcctgaaaccacatgatgcaca

SEQ ID NO: 101911 - DNA, 50 bp, homo sapien
gaatactgaatcttttagcttactcrataacagaattacattatttactc

SEQ ID NO: 101912 - DNA, 50 bp, homo sapien
gtacctcagtccaagagtaactagcmaacagttgtgcaaatgtttgtcac

SEQ ID NO: 101913 - DNA, 50 bp, homo sapien
tttcctctgtagaactgacataaatyagagtggttttgttctgtatattt

SEQ ID NO: 101914 - DNA, 50 bp, homo sapien
cagaacagtataactgagaataatamaaggaaacagcttcacaagttggc

SEQ ID NO: 101915 - DNA, 50 bp, homo sapien
gagaaatctccaggctaacctggttyctaacacgtctattcttcccaact

SEQ ID NO: 101916 - DNA, 50 bp, homo sapien
gatactaaatagttggaggggagccragtgattgcgtgacttatttttag

SEQ ID NO: 101917 - DNA, 50 bp, homo sapien
ctatcataaccctgcgtataaagaawgccttgagaaagaaaagaagtgac

SEQ ID NO: 101918 - DNA, 50 bp, homo sapien
cgccttctcccttctaatctcagtcrctagttgttaccattaattaaccc

SEQ ID NO: 101919 - DNA, 50 bp, homo sapien
gataagcaatacaaatctcaaataarttaagtttataacttaaggctccc

SEQ ID NO: 101920 - DNA, 50 bp, homo sapien
acatgatcttgcagcaaatcttgaamaactctatggaattaacagaacat

SEQ ID NO: 101921 - DNA, 50 bp, homo sapien
gacattaagcaaaatttaggataacmaccaatgataagagataatcaata

SEQ ID NO: 101922 - DNA, 50 bp, homo sapien
tcgaattagactaaatgattagaagsaaaggaagatttgtaaacttgcag

SEQ ID NO: 101923 - DNA, 50 bp, homo sapien
aaattcatcagaatcctcaattagayatgttgagacatggaagcaaatgg

SEQ ID NO: 101924 - DNA, 50 bp, homo sapien
aatactaggtacatggagaaaaagasaaacgaccagaatcaagaaaaaac

SEQ ID NO: 101925 - DNA, 50 bp, homo sapien
atttttaccccactttttaagagacycttttcatagtttgttattgattg

SEQ ID NO: 101926 - DNA, 50 bp, homo sapien
tcacccagtgaaaacattacaaaccraatataatcccatggggaagagta

SEQ ID NO: 101927 - DNA, 50 bp, homo sapien
caaggcatagaaaagatgttagctcyatatcattaagttatatagaaaga

SEQ ID NO: 101928 - DNA, 50 bp, homo sapien
agcatgttgaagcttctactacatcraaataatcagccaataaaatttgt

SEQ ID NO: 101929 - DNA, 50 bp, homo sapien
tggtttcttatagtaccgagtgaaaygtaattttggcatggcttatttta

SEQ ID NO: 101930 - DNA, 50 bp, homo sapien
tatggaggaggtcaaagaatgaatgrcaatttgacatgaagaggttgatt

SEQ ID NO: 101931 - DNA, 50 bp, homo sapien
gttccaaaatgagggtgtaggcaacrctaggcccattaaattcagtcagc

SEQ ID NO: 101932 - DNA, 50 bp, homo sapien
agtgttaccctatttcagtatgtacrgacatcataaatggtatgacaagt

SEQ ID NO: 101933 - DNA, 50 bp, homo sapien
gtgtcacttaaataaaacaacataaytgtggagaaaacaatgctgtaaaa

SEQ ID NO: 101934 - DNA, 50 bp, homo sapien
cccagaatagacttcaatttataccmatggaaatgagctgcttttttttt

SEQ ID NO: 101935 - DNA, 50 bp, homo sapien
cctacactctcatttgaatttttgartaatcatgatgatcagatctggac

SEQ ID NO: 101936 - DNA, 50 bp, homo sapien
ttagttgtattacggtaatcgggcayatgtcttctaaccttgatgatctc

SEQ ID NO: 101937 - DNA, 50 bp, homo sapien
ttgtgaaatgttcagtattagaactsaattgtctctggatggagatgtca

SEQ ID NO: 101938 - DNA, 50 bp, homo sapien
attacaaagaatcaaagtttgtgaayggcacacttgtaatataagctatt

SEQ ID NO: 101939 - DNA, 50 bp, homo sapien
aaaacttgcacttcaaaggatgcaaytaagaaactgaaaatacaatgtct

SEQ ID NO: 101940 - DNA, 50 bp, homo sapien
tccctatggtgtcctttaatcagagratgggtcacacaggttgctctgat

SEQ ID NO: 101941 - DNA, 50 bp, homo sapien
aattaagaagccaaacagtttaccaraaagcttggccaataacttttctc

SEQ ID NO: 101942 - DNA, 50 bp, homo sapien
cttggaaagccaccacctctacatayctggtgttataaaatcaagcccat

SEQ ID NO: 101943 - DNA, 50 bp, homo sapien
agcagggaggcaaagctcgcgccaargccaagacccgctcttctcgtgcc

SEQ ID NO: 101944 - DNA, 50 bp, homo sapien
gctctaaattttacacaattatagtytgtatgctttctattttgcttatt

SEQ ID NO: 101945 - DNA, 50 bp, homo sapien
acagtaatttacacagtgctatggcratttgttttgtatgtattatcttc

SEQ ID NO: 101946 - DNA, 50 bp, homo sapien
aaattttaataaaatgcatgggagamggaaaataacgaaagggtccttga

SEQ ID NO: 101947 - DNA, 50 bp, homo sapien
aaaatatatgaacaaaagctcaacasatttatcattagagaagtgcaaat

SEQ ID NO: 101948 - DNA, 50 bp, homo sapien
tcaaattgaggccatacaaattaatsaagtgtttctactgaagctaccca

SEQ ID NO: 101949 - DNA, 50 bp, homo sapien
gttaagatgagtacagctggtcacamaaaacccacagctttctacagcta

SEQ ID NO: 101950 - DNA, 50 bp, homo sapien
gctttaataatgccctttttttggascgcaatgagaaacctgaaaacatt

SEQ ID NO: 101951 - DNA, 50 bp, homo sapien
cttttaagaagttaaaacatgctccraagctctgtatgaggttgttagct

SEQ ID NO: 101952 - DNA, 50 bp, homo sapien
tgtaatgaatcaataataaatagcaytgaattaagatgtgaccattttat

SEQ ID NO: 101953 - DNA, 50 bp, homo sapien
acagagttaagaggaaagaaaacctraaggagttgtaatacagcaaactt

SEQ ID NO: 101954 - DNA, 50 bp, homo sapien
tatagatatgttagagatgccaatgkacttggtctatgccaaggtgacta

SEQ ID NO: 101955 - DNA, 50 bp, homo sapien
agatgaaaatctactaagtgtactcratatagaattggctagaatttgct

SEQ ID NO: 101956 - DNA, 50 bp, homo sapien
tatttcgggatgaattacatgtaaaygatgaacagttaatttaagcacaa

SEQ ID NO: 101957 - DNA, 50 bp, homo sapien
acaaggatagttggagagttctaatraaacagaaattggatgtctaatat

SEQ ID NO: 101958 - DNA, 50 bp, homo sapien
atatgattacattatgctattgttaygagttgaactgcatcccccagaag

SEQ ID NO: 101959 - DNA, 50 bp, homo sapien
tataaaataagaaaaaccaattacaraccgattgagtgcatatttgtgca

SEQ ID NO: 101960 - DNA, 50 bp, homo sapien
tcttacctgctcaggttgtggaatcragttctaggattgagattctggca

SEQ ID NO: 101961 - DNA, 50 bp, homo sapien
gcatccaataagggtcttgtgaaaaygctgcagtgaggtaaactgagact

SEQ ID NO: 101962 - DNA, 50 bp, homo sapien
ttaaacagatatgtcttcaccttgtyaaatcagtcagagagatgttgacg

SEQ ID NO: 101963 - DNA, 50 bp, homo sapien
gttagtataaagtgtaaatgtaacartaaaatccagcaaagtaagttact

SEQ ID NO: 101964 - DNA, 50 bp, homo sapien
tcactattccacactttattctttargtatttcacacatatatttaatac

SEQ ID NO: 101965 - DNA, 50 bp, homo sapien
ggtatctgatagatttgcatttctayggagaatcttgatgtcatcagaaa

SEQ ID NO: 101966 - DNA, 50 bp, homo sapien
ataatcttaatgattatcattatcayaccgtacctcatttatgaacttgg

SEQ ID NO: 101967 - DNA, 50 bp, homo sapien
tagcaaaaccaacaaatgattggaayactgtgatttaaactcaaaaccaa

SEQ ID NO: 101968 - DNA, 50 bp, homo sapien
ttttttgaaaatataatatgctccartgaggaaactatagtatagagtag

SEQ ID NO: 101969 - DNA, 50 bp, homo sapien
ttatatcaggatattttagcattgaytattataacctgataaagggaaaa

SEQ ID NO: 101970 - DNA, 50 bp, homo sapien
tgactcttgttttatcaacacaaacygagccaattaatggggctacattc

SEQ ID NO: 101971 - DNA, 50 bp, homo sapien
aaatagtgaatctacaacaccttaarcgcctgataacttcacaatgcatg

SEQ ID NO: 101972 - DNA, 50 bp, homo sapien
tccagatacgaggatttctctacacratgagtatcctaaatcatgtatta

SEQ ID NO: 101973 - DNA, 50 bp, homo sapien
agacaagtgtgtctaataaagaggartagctacagtggctcagttggtac

SEQ ID NO: 101974 - DNA, 50 bp, homo sapien
gttgaaagcagcttcacaaacacaaytacctgttactaaaataagagggt

SEQ ID NO: 101975 - DNA, 50 bp, homo sapien
attcctagtccagctttggaattccyatgtggatttaggtgaactgcccc

SEQ ID NO: 101976 - DNA, 50 bp, homo sapien
gctgggattacaagtgtgtgcctccrtattttagcagagacaggagtttg

SEQ ID NO: 101977 - DNA, 50 bp, homo sapien
agagaccacttcagagagagtaaaaygatagagggttaagtgctatttaa

SEQ ID NO: 101978 - DNA, 50 bp, homo sapien
cagactcagtggctgaatgataaaarctgactggaattaaagagatttgg

SEQ ID NO: 101979 - DNA, 50 bp, homo sapien
ctgtgattttctctctttgaaattcmctttagatgtctgagtgccttttt

SEQ ID NO: 101980 - DNA, 50 bp, homo sapien
attcccagaaccattccttgtatgcractgaacgagtgacacaattttat

SEQ ID NO: 101981 - DNA, 50 bp, homo sapien
gaagggaaattcatctgtattctgaractgacctgtaggcaactgttcca

SEQ ID NO: 101982 - DNA, 50 bp, homo sapien
aaacatgaaatattgtcctgaatcaycttcgtcaatcaaggtgtttcttt

SEQ ID NO: 101983 - DNA, 50 bp, homo sapien
agggtaaatgcaccaggctaaaaggycaaaccaaatcatcttctagagaa

SEQ ID NO: 101984 - DNA, 50 bp, homo sapien
attttaacaattattagtaaaagatkaatgtgttccaacggcccttctac

SEQ ID NO: 101985 - DNA, 50 bp, homo sapien
cttctgcttcctttccaagcgcggtyggctgtgtcagggctgagctatct

SEQ ID NO: 101986 - DNA, 50 bp, homo sapien
tgtttcctttgcccaacatgtgcaaytaatgctggtgtttattaatgggc

SEQ ID NO: 101987 - DNA, 50 bp, homo sapien
gcacaatgagtggtttgattgaatckgacaattggttcccgagagtaaca

SEQ ID NO: 101988 - DNA, 50 bp, homo sapien
tttatctgtggagcactttttccackctcaataatgtcttggtttagaca

SEQ ID NO: 101989 - DNA, 50 bp, homo sapien
agttctcttatatgcaaaaaggtcasaacctccatgttagttatttctag

SEQ ID NO: 101990 - DNA, 50 bp, homo sapien
gatcaagtgagtcctccaacttggtkaagtgaaaatctttgtacagtgta

SEQ ID NO: 101991 - DNA, 50 bp, homo sapien
tactaagagaattttagatctttaaycattagaccctaactgttaaccta

SEQ ID NO: 101992 - DNA, 50 bp, homo sapien
cactgaaaatatgattgtgaattaarggcttttgattaaagtagacttac

SEQ ID NO: 101993 - DNA, 50 bp, homo sapien
tggctacatcaaacactgagttatcmgaggcacattaggatgaggatgta

SEQ ID NO: 101994 - DNA, 50 bp, homo sapien
aaaggtttcttatttttctgtactgyatgattaattagagccattgggtg

SEQ ID NO: 101995 - DNA, 50 bp, homo sapien
gtggtatgtccctgatactgcataawcacaacctctatttgtgattcaaa

SEQ ID NO: 101996 - DNA, 50 bp, homo sapien
gagttgccaagctctagggaaaacargctgcatgcaaatatgcctgaagg

SEQ ID NO: 101997 - DNA, 50 bp, homo sapien
tttaactagccatgtgtagctacccmctactgtattggatagttcagctc

SEQ ID NO: 101998 - DNA, 50 bp, homo sapien
ccctccgttgtacattgcaacactcrcagggtattggtttttcttattct

SEQ ID NO: 101999 - DNA, 50 bp, homo sapien
attaaacactgaactattttaaagcrccattttatttaatcttcatggga

SEQ ID NO: 102000 - DNA, 50 bp, homo sapien
agtcgctgcagtgctaaaatagaagygtaagggagacatcacacacacaa

SEQ ID NO: 102001 - DNA, 50 bp, homo sapien
cggagagaaactcagagttcatcaayacctactctgtgccagatactgaa

SEQ ID NO: 102002 - DNA, 50 bp, homo sapien
ttagagcccttaacccatttcagtamaactcaaatttgtttcccatttgc

SEQ ID NO: 102003 - DNA, 50 bp, homo sapien
agctccttttccaaccttcacataarctttcacgaactatgcttaactcg

SEQ ID NO: 102004 - DNA, 50 bp, homo sapien
ctaatacaatgtagataaagaaaggwcactcaaaaatagatgacagactc

SEQ ID NO: 102005 - DNA, 50 bp, homo sapien
atttagagctccaattcttatgcccraggattaaaatgaagccacaaata

SEQ ID NO: 102006 - DNA, 50 bp, homo sapien
agaggaccctgcctagttagcataayctttgtttgtttgtttgtttgttt

SEQ ID NO: 102007 - DNA, 50 bp, homo sapien
acgtcctatccatcatgcaaaaatcrgaataaccaggcatgtgcaaggca

SEQ ID NO: 102008 - DNA, 50 bp, homo sapien
cgtgtgaatttcagaccaaagaccargtaaatgttaaagtattcctttct

SEQ ID NO: 102009 - DNA, 50 bp, homo sapien
attttttatgctttgaaatttatcartctaattcgccagaagttcatcaa

SEQ ID NO: 102010 - DNA, 50 bp, homo sapien
gaggcctccaaacgaaatacgtgtayggaggacaatgagagagaaaggaa

SEQ ID NO: 102011 - DNA, 50 bp, homo sapien
aatatttcagttttgaaataatagamccaaatcaacatgttgaaatgtac

SEQ ID NO: 102012 - DNA, 50 bp, homo sapien
gctcttctacaatccctagctcctaygcatttctgtagggtcaggagatt

SEQ ID NO: 102013 - DNA, 50 bp, homo sapien
tatcatatataccaggttagcaatgyatgtatggcacaggtggcaaactc

SEQ ID NO: 102014 - DNA, 50 bp, homo sapien
atgtatggcacaggtggcaaactctyaccataccacatgtgatacacaca

SEQ ID NO: 102015 - DNA, 50 bp, homo sapien
catccattactggtgagaatgcacastactacatccattcgtgaaaagaa

SEQ ID NO: 102016 - DNA, 50 bp, homo sapien
ttgggtattacaacttgaactaaaawattgtccctggcatgccacattct

SEQ ID NO: 102017 - DNA, 50 bp, homo sapien
aatgtgaccttatttggaaataagarctttgcaactataatcaaattaag

SEQ ID NO: 102018 - DNA, 50 bp, homo sapien
aggggagttggagaggttggaaatayggaatgaggaaataatttctagaa

SEQ ID NO: 102019 - DNA, 50 bp, homo sapien
tgatttttttttttgacaagtctatsaaacggtggtattatttatttcca

SEQ ID NO: 102020 - DNA, 50 bp, homo sapien
tcatcatgagcatacaaactacacaytcatagacagcatgaaggtaagaa

SEQ ID NO: 102021 - DNA, 50 bp, homo sapien
gatttattagatataatgtgaattcraaagacacctggacacagcatctg

SEQ ID NO: 102022 - DNA, 50 bp, homo sapien
aagggtgacacagagtgtttattcaygggacattccctctcctctatctc

SEQ ID NO: 102023 - DNA, 50 bp, homo sapien
gggtgtcaacagtcagcagaggtctractaagcattcgaatgacatcttg

SEQ ID NO: 102024 - DNA, 50 bp, homo sapien
catggattgctgccatttatacatcrtcactctctggaatgctctagacc

SEQ ID NO: 102025 - DNA, 50 bp, homo sapien
ggagaagactattggttcacaatgayggacaaattgcgtgcataacctat

SEQ ID NO: 102026 - DNA, 50 bp, homo sapien
tttgtttgtttgtttgtttgaataayacacattaggtactcagctgcctt

SEQ ID NO: 102027 - DNA, 50 bp, homo sapien
ttgacccccatatccaaaaatcctgraaaatatgagaattcctctttccc

SEQ ID NO: 102028 - DNA, 50 bp, homo sapien
agcaataataccttaatgatagacamaacgaacacaagtgaggagtaaaa

SEQ ID NO: 102029 - DNA, 50 bp, homo sapien
gcctaatgtggtttctttgagagcartctgtctgaggggtcccctttgct

SEQ ID NO: 102030 - DNA, 50 bp, homo sapien
acatcttttcaccagagtgataatayggaaaacatgtacacagaatgtaa

SEQ ID NO: 102031 - DNA, 50 bp, homo sapien
tagatttgaggcagcaattagaagastacattctgacattggtaactttg

SEQ ID NO: 102032 - DNA, 50 bp, homo sapien
gaccctgtgtctttcttattctgaayctcgtcagggtccagaatgaggtc

SEQ ID NO: 102033 - DNA, 50 bp, homo sapien
attattcttagaaagtacattggggyagatcaatcaggataggatttgtc

SEQ ID NO: 102034 - DNA, 50 bp, homo sapien
ctaagttaatggaatttctcttattkcaaaattctattgcccaactccag

SEQ ID NO: 102035 - DNA, 50 bp, homo sapien
gggcttattatgtgaattaggtacartgggatccagcatcatatacagac

SEQ ID NO: 102036 - DNA, 50 bp, homo sapien
ccttcctgattcccagctactctaaycattgatcctttactttctctaca

SEQ ID NO: 102037 - DNA, 50 bp, homo sapien
gtaacctggcaactaaaaaattacaygatttgtgcaggcccctgcctgag

SEQ ID NO: 102038 - DNA, 50 bp, homo sapien
ctcacactttataagcctttcattaygttgagttcatccaatggcattgc

SEQ ID NO: 102039 - DNA, 50 bp, homo sapien
acagtgaactgtcccaggcttgtgawatcctagtggccactctaacacag

SEQ ID NO: 102040 - DNA, 50 bp, homo sapien
agtttctgaagcaatggtgtaactargtcttttgatataatgttaaatgt

SEQ ID NO: 102041 - DNA, 50 bp, homo sapien
catctaacttaagaattcctaaccayaaattggccctcatacatgtttgc

SEQ ID NO: 102042 - DNA, 50 bp, homo sapien
gcatgtatttgcctattcactgatgrctgttataattttaggcaaattat

SEQ ID NO: 102043 - DNA, 50 bp, homo sapien
aaaccactgtcttcttttccaaatcsagcactggggaccgacgtgtgggc

SEQ ID NO: 102044 - DNA, 50 bp, homo sapien
aatgtgagagactgaatagagagtgrtctgaacaactaagccagggaatg

SEQ ID NO: 102045 - DNA, 50 bp, homo sapien
agctgggaatcaggaaggtaagataycaagttgggaagttaagtaaaaaa

SEQ ID NO: 102046 - DNA, 50 bp, homo sapien
caaaagcttcacgaagttatagtcaygagcagggacagaaatgaggagga

SEQ ID NO: 102047 - DNA, 50 bp, homo sapien
ctgatttatttcctgtgggtcatgarcctctactcactacctagctaatc

SEQ ID NO: 102048 - DNA, 50 bp, homo sapien
ttcaagaagggagaaagggttaacaktgtcctgtgctgctacaaagttaa

SEQ ID NO: 102049 - DNA, 50 bp, homo sapien
cctgcctacttgaaatgtggttgacyaacatcatcagatcctgtcactcc

SEQ ID NO: 102050 - DNA, 50 bp, homo sapien
aatattgcctaaagcagtgtttcatraacttatttgaatctgatgcgtta

SEQ ID NO: 102051 - DNA, 50 bp, homo sapien
ctcacttttactcttccattaattgygtctcttttctatttacctaacca

SEQ ID NO: 102052 - DNA, 50 bp, homo sapien
caccctttcctttaaacaaccaaaamattgtgtataataggtgtccagca

SEQ ID NO: 102053 - DNA, 50 bp, homo sapien
aaatgctagtgctgtggctctggaargattcattttatttcctgcaacaa

SEQ ID NO: 102054 - DNA, 50 bp, homo sapien
acagcactttgggaggccgagatggktctatcaatggaggccaggagttt

SEQ ID NO: 102055 - DNA, 50 bp, homo sapien
ataatgacaattctctgatcacaagrttttggaaaagccccagctctgtt

SEQ ID NO: 102056 - DNA, 50 bp, homo sapien
gagagagaaggatagggattataacsatgaagcggcactttggccacctc

SEQ ID NO: 102057 - DNA, 50 bp, homo sapien
cacactgttgtgcaacagattttcaraagttttcattttgcaaaacagaa

SEQ ID NO: 102058 - DNA, 50 bp, homo sapien
tcagattgatggtatcttcttatccyaataattaactgactgaacagaaa

SEQ ID NO: 102059 - DNA, 50 bp, homo sapien
ttcctaaaaaactttcatgtagaatsaccgtatcatccggcaatttcatt

SEQ ID NO: 102060 - DNA, 50 bp, homo sapien
ttgaaatgagttcaaagtgtagggayaaaattccagtgagaggcagaaaa

SEQ ID NO: 102061 - DNA, 50 bp, homo sapien
ttaaaaaatagtggggacagctttgwaagtgccaaccattagccaaagtg

SEQ ID NO: 102062 - DNA, 50 bp, homo sapien
ttccatgttaatcaatcaagtccatmaattgtttatatgtgtagctttct

SEQ ID NO: 102063 - DNA, 50 bp, homo sapien
gtcttcttatcaagtaaaaataaagwcacggtagtgctgacagacatggc

SEQ ID NO: 102064 - DNA, 50 bp, homo sapien
ccatgagtattagttattttctgatyagtggaactctcaaaactgaccag

SEQ ID NO: 102065 - DNA, 50 bp, homo sapien
taaaacatgatatgctttcactgatyactttatataatgaattttttttt

SEQ ID NO: 102066 - DNA, 50 bp, homo sapien
tatctttctccttgtagtattttcasggcattgaagagtgtttggcacat

SEQ ID NO: 102067 - DNA, 50 bp, homo sapien
tgccaacccagccttatctaaacaarctccttcacccattcctaccacag

SEQ ID NO: 102068 - DNA, 50 bp, homo sapien
ctctctgtggtcacatagccgctcaygtttaattctttctaagctcacag

SEQ ID NO: 102069 - DNA, 50 bp, homo sapien
atccctgtcgctgagacttcggttaygaatattttcagtcagcacacatg

SEQ ID NO: 102070 - DNA, 50 bp, homo sapien
gactgataataactaggaatacttakgctaggaagtgccagaagactttc

SEQ ID NO: 102071 - DNA, 50 bp, homo sapien
tacacaattcaattagcatgctctayggtttttgatgtctgtagcagaga

SEQ ID NO: 102072 - DNA, 50 bp, homo sapien
ggcatgctattggctttgttatagcrgaatttgtcacagggccagaaatt

SEQ ID NO: 102073 - DNA, 50 bp, homo sapien
ggctccacagagtggcatctacaggkcatagttgtcagtgactcagggag

SEQ ID NO: 102074 - DNA, 50 bp, homo sapien
tgttcccttctgcattcagggtatgraagaaataactgtctagaactcaa

SEQ ID NO: 102075 - DNA, 50 bp, homo sapien
gtcttgtaactgaggacctaactccygaagaagagccgagaccccctcac

SEQ ID NO: 102076 - DNA, 50 bp, homo sapien
tccttgatctctgaagccctcagtayggttgggcaacctttcctctcacc

SEQ ID NO: 102077 - DNA, 50 bp, homo sapien
tatgaaaatgtttacccagatcaagratattaaagaaacttagattaata

SEQ ID NO: 102078 - DNA, 50 bp, homo sapien
cattcacataacctccatggtcacakcatcatacatatacatatatatgc

SEQ ID NO: 102079 - DNA, 50 bp, homo sapien
cctggtaatatcactctcaatatcartatagtccagaaaccagcttcaaa

SEQ ID NO: 102080 - DNA, 50 bp, homo sapien
aaattgtttagatacacaatttgaakaaactctgtggtctaactcaaatt

SEQ ID NO: 102081 - DNA, 50 bp, homo sapien
ctgttgaataaaacgccaagtggagraattgaagatccctgattgtggaa

SEQ ID NO: 102082 - DNA, 50 bp, homo sapien
tagtgaacttccatgcaggccatgayaggctcatttcaaaagaagcagaa

SEQ ID NO: 102083 - DNA, 50 bp, homo sapien
ttggccagatcctggtagtgactgarccactgaattgctgctggcctcaa

SEQ ID NO: 102084 - DNA, 50 bp, homo sapien
aagaatagtgcactagatttactacsacagatttttgtacttatacgtta

SEQ ID NO: 102085 - DNA, 50 bp, homo sapien
agttgttgaacatcatggttgccgayggtcataaataacagttggaacaa

SEQ ID NO: 102086 - DNA, 50 bp, homo sapien
gatctctgtattttgaaagtgatgartaactggctggtctagagaagaac

SEQ ID NO: 102087 - DNA, 50 bp, homo sapien
aaggggttaacagaagaagtcagtgraaggaacttaatctctacatttta

SEQ ID NO: 102088 - DNA, 50 bp, homo sapien
aattggtctcagtcttattaaggtcraaagacaacattttttaaaccaga

SEQ ID NO: 102089 - DNA, 50 bp, homo sapien
ttgtcatattaggaaattaatagaargtgactacaattgattaatcaaaa

SEQ ID NO: 102090 - DNA, 50 bp, homo sapien
gatcatgtaagatctccagcaaattmaatgtattcgggaagcagatattt

SEQ ID NO: 102091 - DNA, 50 bp, homo sapien
atgtccaagcacaggcagttgtaacrgtagtagccacaccaccagtacct

SEQ ID NO: 102092 - DNA, 50 bp, homo sapien
ttatttgcccgagcctttgtggccaygaaatgaactaagatattatgcac

SEQ ID NO: 102093 - DNA, 50 bp, homo sapien
caggcattcagtcttgccatcctaartaactacttttgacgaaatttatt

SEQ ID NO: 102094 - DNA, 50 bp, homo sapien
tactttttattcttctatgaaatccrtaagcctccatatatacttattct

SEQ ID NO: 102095 - DNA, 50 bp, homo sapien
tcgctattaggcgtgaggaatattayctgtttcccagtagtcagttctac

SEQ ID NO: 102096 - DNA, 50 bp, homo sapien
aaaaaaaagaggctgggcaggactcytctttaagcagagagcatgatttg

SEQ ID NO: 102097 - DNA, 50 bp, homo sapien
ccctggaagggaaaatagagctgacyctcttatgtgcgtgtgcttggtag

SEQ ID NO: 102098 - DNA, 50 bp, homo sapien
aatggcgatgcaaaaagtcatagatytaaataaatggagagatttattgt

SEQ ID NO: 102099 - DNA, 50 bp, homo sapien
agtctggatgaagttcatcttcaaaytgtttgccatagatagatgcacca

SEQ ID NO: 102100 - DNA, 50 bp, homo sapien
gtggaaggcaggctgagacgtcatargtgagataggaggaaggggacctg

SEQ ID NO: 102101 - DNA, 50 bp, homo sapien
gatatcaaaagtgtcctcaaagaaayaggaaaccttgctgggtttttgag

SEQ ID NO: 102102 - DNA, 50 bp, homo sapien
tggcaagcctgaatgttaggaatatraggccataccaaggaatcaatgtc

SEQ ID NO: 102103 - DNA, 50 bp, homo sapien
aaatatggattccctcatggattacratggccagagttctactgcttcat

SEQ ID NO: 102104 - DNA, 50 bp, homo sapien
agaaatctttcccttcaagataaaarcaaagtaacaataaagcaagaaac

SEQ ID NO: 102105 - DNA, 50 bp, homo sapien
ctacagggaggggagtagaatcttayggcccagcattggcattgaggcat

SEQ ID NO: 102106 - DNA, 50 bp, homo sapien
tattataaatatcatctgttatccaygcttaaaatctttaaatgcttccc

SEQ ID NO: 102107 - DNA, 50 bp, homo sapien
tgatgcccctgaaagctgtgtaatckattgtgaagaagaggctgggatag

SEQ ID NO: 102108 - DNA, 50 bp, homo sapien
taaacataaaacagatactttgacaraagtgccacaatggacaaaattct

SEQ ID NO: 102109 - DNA, 50 bp, homo sapien
ttttgttctggtattgaatcagataygatagaagtgatttggacaccact

SEQ ID NO: 102110 - DNA, 50 bp, homo sapien
ccttttctagaggaaggaagtaaggrtgatcagagccctagaaactccac

SEQ ID NO: 102111 - DNA, 50 bp, homo sapien
tttaagctgtggatcttggactttaygccataggtgaagaggagccctga

SEQ ID NO: 102112 - DNA, 50 bp, homo sapien
tggaatatcaaagcttcaaatcttayccatttttaaagacttcacgtctt

SEQ ID NO: 102113 - DNA, 50 bp, homo sapien
aaatgcatctaaaagcattacaacasgactcacaaagctcttaagtttca

SEQ ID NO: 102114 - DNA, 50 bp, homo sapien
gtgacagcaggttcagtgccgcacayggatggtgagggtccctcactgag

SEQ ID NO: 102115 - DNA, 50 bp, homo sapien
aagttgttggcatttgaaagacctaygggatagtatcttagctttacctg

SEQ ID NO: 102116 - DNA, 50 bp, homo sapien
gcttaatagacagagaaatttgggcyatgttcagaagaagagtgttttgt

SEQ ID NO: 102117 - DNA, 50 bp, homo sapien
ttgtatcaatctgggtacagaattayggatgttttgcataactaagtcca

SEQ ID NO: 102118 - DNA, 50 bp, homo sapien
acagaaaataagtgattaaagccaakatagtggtctaaggtcaagccaaa

SEQ ID NO: 102119 - DNA, 50 bp, homo sapien
agaagtgatgtctgaggtggccacargatggtggattcccacactccctc

SEQ ID NO: 102120 - DNA, 50 bp, homo sapien
gcacaccaagataaaatgtaagatayctcatgaaactatcccccatttcc

SEQ ID NO: 102121 - DNA, 50 bp, homo sapien
cctaaacccatgtttcagtgaaaatkaactgctcggttcacttgcaagag

SEQ ID NO: 102122 - DNA, 50 bp, homo sapien
tatgtagtctaatataattttcccaktaacctcatgaggcaaataacatt

SEQ ID NO: 102123 - DNA, 50 bp, homo sapien
ggcaaataacattcagctaactagaygcatagtcagaatttgaatcctgt

SEQ ID NO: 102124 - DNA, 50 bp, homo sapien
caaggcagcatgtatttgcacatcargtatcagatgagtggggccatccc

SEQ ID NO: 102125 - DNA, 50 bp, homo sapien
aagtagccaagggtagctcaaacaawcccctcgattctgaaggagaatta

SEQ ID NO: 102126 - DNA, 50 bp, homo sapien
attgaagtcatcaaaattcatcaaarcgtatatttcaaatctgtgcattt

SEQ ID NO: 102127 - DNA, 50 bp, homo sapien
gcctctggaacatgctaagtacgtakgtaggaaataaatgtatgtattag

SEQ ID NO: 102128 - DNA, 50 bp, homo sapien
agacagaaatgacccatggacgatayaggttgtttcccttgtccctgaag

SEQ ID NO: 102129 - DNA, 50 bp, homo sapien
ggagaagatggagaatgggtgaataygtaggatgctacacagaatgcagg

SEQ ID NO: 102130 - DNA, 50 bp, homo sapien
cagcagaccatgtgtcaacatatgcrgagtttgtgcagacgcacagaccc

SEQ ID NO: 102131 - DNA, 50 bp, homo sapien
tacccctctgagcaccaaagtcaaargtgtgaataaactctggtagaggc

SEQ ID NO: 102132 - DNA, 50 bp, homo sapien
tttttgtttctgtaaaagcacttatsatgagatctatagtcttgttaaca

SEQ ID NO: 102133 - DNA, 50 bp, homo sapien
gttgtatctaacctttaagaaattaycacttgctaggacttccagtacta

SEQ ID NO: 102134 - DNA, 50 bp, homo sapien
attctttgggaggttgaacatttatraaatagcagtcacatctcttctaa

SEQ ID NO: 102135 - DNA, 50 bp, homo sapien
ctaatcattgtctatattgcactggrattctgttgttattgtttgcttta

SEQ ID NO: 102136 - DNA, 50 bp, homo sapien
gttattaatgattttttgaaagttcrcattctgctgattcatattaaaaa

SEQ ID NO: 102137 - DNA, 50 bp, homo sapien
ttatgactcctgaattgctatatacyatctcctaggttgcacctccaaca

SEQ ID NO: 102138 - DNA, 50 bp, homo sapien
tgtacatacatgtgcctctcatccgkagttccagcatttcctctctaaag

SEQ ID NO: 102139 - DNA, 50 bp, homo sapien
atgggagaatctgccatgcctcttayaccttccaagaatgtatggacaaa

SEQ ID NO: 102140 - DNA, 50 bp, homo sapien
gttacagggaaaactgtatagtctgmacaataaatgctgtataggaaaca

SEQ ID NO: 102141 - DNA, 50 bp, homo sapien
tgcctggtgtttagttcccagcctcmatttttgctttcagtacatatctc

SEQ ID NO: 102142 - DNA, 50 bp, homo sapien
agaacaccaaagataatcagtataayggcatttattatttattgagcact

SEQ ID NO: 102143 - DNA, 50 bp, homo sapien
ctgccttcctcaatcccatgttttayggtcactttatccaaatttcacca

SEQ ID NO: 102144 - DNA, 50 bp, homo sapien
ccttggtgccccagaggtccatgaamtaatccaggtgcctgagaccatgg

SEQ ID NO: 102145 - DNA, 50 bp, homo sapien
tatgctatagatttttggttcactayctttaacatgtcatgaaattgatt

SEQ ID NO: 102146 - DNA, 50 bp, homo sapien
cgtctgcatgtaaaatacaggttggwaaagcatttgattagctgagttga

SEQ ID NO: 102147 - DNA, 50 bp, homo sapien
cctgagaagaggctaaaatgctgaargaagagaactgttcctatgtgtga

SEQ ID NO: 102148 - DNA, 50 bp, homo sapien
tgacagaatgcaaagagtcatttcartactccgcagtagcctgagtgatc

SEQ ID NO: 102149 - DNA, 50 bp, homo sapien
caatgataaagcagtgtaatcagtgycaccaatgatcattccagattaca

SEQ ID NO: 102150 - DNA, 50 bp, homo sapien
gctctctttagctgtcatagctaagscaacaatgatctttggaaactata

SEQ ID NO: 102151 - DNA, 50 bp, homo sapien
gacagaattggcctcatgggtggaaragcttcccaagcagctgtccctgt

SEQ ID NO: 102152 - DNA, 50 bp, homo sapien
aatgaaaatatttgattttgtgggasagccagttaaatatctgtcatttg

SEQ ID NO: 102153 - DNA, 50 bp, homo sapien
gaagagctatcattattacaagaggrccttttgcttaatttgtggtggct

SEQ ID NO: 102154 - DNA, 50 bp, homo sapien
agtggaggtccctaacgcagtccgaygtagcaaccttcagctactcttca

SEQ ID NO: 102155 - DNA, 50 bp, homo sapien
ttggatcgcttggcagtgtgacaccratatggcatcaagccttactatga

SEQ ID NO: 102156 - DNA, 50 bp, homo sapien
ataatgtgacagttgtcagtttcacrataaccccctacttacttttccac

SEQ ID NO: 102157 - DNA, 50 bp, homo sapien
taaattgttcttatcaatcaaatggwatcatgttgaataaaatatttcag

SEQ ID NO: 102158 - DNA, 50 bp, homo sapien
caagacaaaacttaattcagaacaaycttggagcttttaacccagaaggg

SEQ ID NO: 102159 - DNA, 50 bp, homo sapien
atataagaatgtctggcaatatccayaatgttctaaaattactgtcaaag

SEQ ID NO: 102160 - DNA, 50 bp, homo sapien
atcgtctagaaaactagaacctacartcgtctcagaacacaaaggaggct

SEQ ID NO: 102161 - DNA, 50 bp, homo sapien
atcttacaatataaaatgtgcctaawctacaatgtcttcataggaacaaa

SEQ ID NO: 102162 - DNA, 50 bp, homo sapien
cagacctgctcccagtcagctgtcayttcggaaaccatctgataaacctc

SEQ ID NO: 102163 - DNA, 50 bp, homo sapien
tagaaaattcttgtatattgttataraagacattatgactatttctgggg

SEQ ID NO: 102164 - DNA, 50 bp, homo sapien
ggagaaagcacaactgacaaaatgtraattaactcttgcagcttcatatt

SEQ ID NO: 102165 - DNA, 50 bp, homo sapien
agcatcacatatggaagagaataaartgaaagttcatattgtgacgagct

SEQ ID NO: 102166 - DNA, 50 bp, homo sapien
tttaaaatgagacattcctttaaagkcacccaagtgtttacagctataaa

SEQ ID NO: 102167 - DNA, 50 bp, homo sapien
aagtttatgctcccaaaaggccgcamtcaaccaacaggaaggggctggag

SEQ ID NO: 102168 - DNA, 50 bp, homo sapien
gctccctagaggttcccatgtagccrgataagtattgtcagaacactgaa

SEQ ID NO: 102169 - DNA, 50 bp, homo sapien
tgttctagctccaatttttacattascaaggttgcccaaatcacatctta

SEQ ID NO: 102170 - DNA, 50 bp, homo sapien
aagttttagatgtctcttagtacaarctctttcccatataggaatccatt

SEQ ID NO: 102171 - DNA, 50 bp, homo sapien
gtatggtgtgataaatgctgtaatasaataaacaatatgccatgagagca

SEQ ID NO: 102172 - DNA, 50 bp, homo sapien
tgtctccatctctgtctcaactttaygtgcactgagctgcaacttcttac

SEQ ID NO: 102173 - DNA, 50 bp, homo sapien
ctttgaatatcacatttatttgaaaygaagcacttactgtaaattgctac

SEQ ID NO: 102174 - DNA, 50 bp, homo sapien
caaaatagaactaaagatgaagatargcctccaaaatccagaatgggact

SEQ ID NO: 102175 - DNA, 50 bp, homo sapien
cataacggaactcaaatacatcctasaaagaggcacaaactcaaaactat

SEQ ID NO: 102176 - DNA, 50 bp, homo sapien
caggccaatctggaagataaaaaagscaaggtagattcaaatgtaggagg

SEQ ID NO: 102177 - DNA, 50 bp, homo sapien
ggagcagtgaaggtgacccagctgasgactaaccacataaagcccatgat

SEQ ID NO: 102178 - DNA, 50 bp, homo sapien
cagacactgatggtcttcagatcacrcttttagtagcaagaatgtagacc

SEQ ID NO: 102179 - DNA, 50 bp, homo sapien
ttttctgtattttactgtcacagagyactatattgaaagcctctgtggat

SEQ ID NO: 102180 - DNA, 50 bp, homo sapien
ctgtctgtttttatgcgagggttcaraaataccgaaagactacattgcca

SEQ ID NO: 102181 - DNA, 50 bp, homo sapien
gatgaacataaagatagaatctatargataaaggagcttaatgaatgcca

SEQ ID NO: 102182 - DNA, 50 bp, homo sapien
ccaagataaccaacaactattaaatraaaagcaatggggactgatttgac

SEQ ID NO: 102183 - DNA, 50 bp, homo sapien
tccattttccatatagaaatgttgamtagaggatcaaaagtacctatttt

SEQ ID NO: 102184 - DNA, 50 bp, homo sapien
ttcaggaaagaacagtccttgatgaygggtccaatttcacagacaaatgt

SEQ ID NO: 102185 - DNA, 50 bp, homo sapien
aagagataatggcaagacttctcgtyaataatctagctaaatgatagaac

SEQ ID NO: 102186 - DNA, 50 bp, homo sapien
acccaagaaacagtaaatgtatcaarttatatgcatgccaattacagtgg

SEQ ID NO: 102187 - DNA, 50 bp, homo sapien
gatttatccccttggaagtataggascagcttttcccagagtcatctctg

SEQ ID NO: 102188 - DNA, 50 bp, homo sapien
agggtcactgaacaaatattagactsaatcaaagttgtgcatttgactac

SEQ ID NO: 102189 - DNA, 50 bp, homo sapien
tgatacagctaataggctggacaaaytaatattctgtggaagtagtactg

SEQ ID NO: 102190 - DNA, 50 bp, homo sapien
aaggactaggcctataagagggtccygattcagcgcactcattctgtcaa

SEQ ID NO: 102191 - DNA, 50 bp, homo sapien
cataatcagatttttatgttagaccrttctggcagcaatgtgagagatga

SEQ ID NO: 102192 - DNA, 50 bp, homo sapien
atgttgctgaaaaatttctatccagwatgtggaatggatgtcatttaggt

SEQ ID NO: 102193 - DNA, 50 bp, homo sapien
cacgttgtttttggaagtgaaacagragagggtgaaaacaatgactatga

SEQ ID NO: 102194 - DNA, 50 bp, homo sapien
tcactgaagaacttaccgaaattgcraaagagagtctaatgtagaacgag

SEQ ID NO: 102195 - DNA, 50 bp, homo sapien
atttttccacataagagaaacttaaygaggctatcaactctaacacaccc

SEQ ID NO: 102196 - DNA, 50 bp, homo sapien
aggctgcaaagtccatgtgctgttayagaccgagacccttattttctttg

SEQ ID NO: 102197 - DNA, 50 bp, homo sapien
caagggtgggaaaacattttctacckaatttaaaccagtggcatttgtgt

SEQ ID NO: 102198 - DNA, 50 bp, homo sapien
gacagacgacattcagcatgactgayatgaagcaaattttgtaaaatatc

SEQ ID NO: 102199 - DNA, 50 bp, homo sapien
cccatcaataagacatttttacagasgatttcggccccatctgacccatt

SEQ ID NO: 102200 - DNA, 50 bp, homo sapien
ttagtaaaggtatttcagggtatatragaatcagattcctagggccctgg

SEQ ID NO: 102201 - DNA, 50 bp, homo sapien
aaaataggaaaatgactttgtcacgrttgtgttcactgtagtgagatttt

SEQ ID NO: 102202 - DNA, 50 bp, homo sapien
tgttaataaagatactggctttagartaggaggtgctctacactgatcat

SEQ ID NO: 102203 - DNA, 50 bp, homo sapien
tggggaacaccattgaagtaaaatcrgaaaaatatctgagcatatgcttc

SEQ ID NO: 102204 - DNA, 50 bp, homo sapien
ctgtcccgttggtcatttcttcaaawtataaaaactgcaatttgtaaggt

SEQ ID NO: 102205 - DNA, 50 bp, homo sapien
gccacaataaagtttggagccaaaaytgtagatataaagagagttccttt

SEQ ID NO: 102206 - DNA, 50 bp, homo sapien
ctcactaatccagttcactaaggtasgaagccacaataaagtttggagcc

SEQ ID NO: 102207 - DNA, 50 bp, homo sapien
ctggtccagatccactaattctttcyctgtacctcacagcaccagacctc

SEQ ID NO: 102208 - DNA, 50 bp, homo sapien
attaatttttaggcagtcccacatamggtgttaaaggccaaatgcaagga

SEQ ID NO: 102209 - DNA, 50 bp, homo sapien
taattaggaaatgatgaaaataagcragttaccaaagcttctgtgatatg

SEQ ID NO: 102210 - DNA, 50 bp, homo sapien
tagagtggggtgtgggggatgaactyaatctccacaggaagacagaccaa

SEQ ID NO: 102211 - DNA, 50 bp, homo sapien
actagactcaatattttaccacacartctacattacaggatgaaaacaaa

SEQ ID NO: 102212 - DNA, 50 bp, homo sapien
gatatttgttgatatgtattacaaamgttggacaacatagtcatgaaata

SEQ ID NO: 102213 - DNA, 50 bp, homo sapien
ttattatttttcacagttctccataygtagcttcaagaaaaacttgctaa

SEQ ID NO: 102214 - DNA, 50 bp, homo sapien
ggaatttgccaccggattggtcaaarggactccattggtctcctagggct

SEQ ID NO: 102215 - DNA, 50 bp, homo sapien
ctgctactggtggtcagatgtgccayagagtataagaaaccttgggagaa

SEQ ID NO: 102216 - DNA, 50 bp, homo sapien
tcttaacagtgtcatctctgatatcyactcatggccccatctccagtggg

SEQ ID NO: 102217 - DNA, 50 bp, homo sapien
gtgagcatgttggaggctcagaggarcatggagctgaagaattgggagtc

SEQ ID NO: 102218 - DNA, 50 bp, homo sapien
tcattgtaacagtattactaaatgcyctgtacttcagatttgaagattaa

SEQ ID NO: 102219 - DNA, 50 bp, homo sapien
attgtaatgacagaagctttggtgayagataaggaatactgaaaaagagc

SEQ ID NO: 102220 - DNA, 50 bp, homo sapien
cactgcataaagaaaatgcctaaacraaaaggtgacctattttatgaaac

SEQ ID NO: 102221 - DNA, 50 bp, homo sapien
ctgtgtcactcccagttgctgaccamgtttatcgacctgctgccgggcca

SEQ ID NO: 102222 - DNA, 50 bp, homo sapien
agtcgttttgatgctttagttggaawagaaaccaaattgaaaagtgcaat

SEQ ID NO: 102223 - DNA, 50 bp, homo sapien
tggtggtgatgacagagtatagatayggtaaggaaactgataaattaata

SEQ ID NO: 102224 - DNA, 50 bp, homo sapien
ggaagagaaggggatgaaccaacacygaatgctattcttttagagtagtt

SEQ ID NO: 102225 - DNA, 50 bp, homo sapien
tgtgtctagagtatgcatcactccaytagtgcaataataaagcagcaggc

SEQ ID NO: 102226 - DNA, 50 bp, homo sapien
ttctattccaactaaagcatcaaaaygactcagatactaaacccagtaaa

SEQ ID NO: 102227 - DNA, 50 bp, homo sapien
gcttgcatggctgacctacccaataygtagacaacccaatacaactactc

SEQ ID NO: 102228 - DNA, 50 bp, homo sapien
aagatacaccatagcctaagtctaaytgtaagaaggaaagatgcagtggc

SEQ ID NO: 102229 - DNA, 50 bp, homo sapien
tctttatcatcagtgctctgacttasaagagacctgcagaatattttcaa

SEQ ID NO: 102230 - DNA, 50 bp, homo sapien
gcctggtcccctctgtggtcagaacraggctgccttcccagagatagcct

SEQ ID NO: 102231 - DNA, 50 bp, homo sapien
accaatattctataatactcaaaacyctaaaggtacacaaaatagtatag

SEQ ID NO: 102232 - DNA, 50 bp, homo sapien
tggcaataactgctgctgtttatcaytaagagagtacttgggttaaagtc

SEQ ID NO: 102233 - DNA, 50 bp, homo sapien
tagatctgccctttatatttccattsaacttgagggcccacagtgttccc

SEQ ID NO: 102234 - DNA, 50 bp, homo sapien
ctttgacttctctgtgggatactgcyagattaactcaacactcccagtac

SEQ ID NO: 102235 - DNA, 50 bp, homo sapien
gatcatccttcataggaactgaatcytgagttctaactaactaatcctag

SEQ ID NO: 102236 - DNA, 50 bp, homo sapien
cacagataactactgtgtacattttsatagcttatcttttctctagatct

SEQ ID NO: 102237 - DNA, 50 bp, homo sapien
tcagaatagccctctgctggtttgcygattttttattaaataaaggacag

SEQ ID NO: 102238 - DNA, 50 bp, homo sapien
ctccagtaggtcattcagatctccaygtcctactaagaaactcccctcat

SEQ ID NO: 102239 - DNA, 50 bp, homo sapien
gtattagacctgatagctccaagaaytgatgatccaacaacccacataga

SEQ ID NO: 102240 - DNA, 50 bp, homo sapien
gatcatacacactgaaaagcgtgtaycatcttggaatatttgagaagtgt

SEQ ID NO: 102241 - DNA, 50 bp, homo sapien
cttaggtctgatcaatctgctccacrcaatttctcagtgatcctctgcat

SEQ ID NO: 102242 - DNA, 50 bp, homo sapien
cctgggcaaatgccctaaaccaaaaycagatataatacctcaaggaagag

SEQ ID NO: 102243 - DNA, 32 bp, homo sapien
tcagagagagatcaagrtaaaacgaaaaactc

SEQ ID NO: 102244 - DNA, 50 bp, homo sapien
gacagtgaaagaaaccgtttctcagytctgtttgcccgctgtaggcacaa

SEQ ID NO: 102245 - DNA, 50 bp, homo sapien
caatttagctgcatatagaattctasgttgatacatgttttctctcaata

SEQ ID NO: 102246 - DNA, 50 bp, homo sapien
caattcttgtctcagattctgtttayggagaacagaagccaagtcaagag

SEQ ID NO: 102247 - DNA, 50 bp, homo sapien
cctcaatgtattacatggaaaataaygatagcaacaactataataataat

SEQ ID NO: 102248 - DNA, 50 bp, homo sapien
gggatctgtagccaatcattcacgasgtaaacagaacgaccgagtttctc

SEQ ID NO: 102249 - DNA, 50 bp, homo sapien
tttcacattttccattcactcttcawcccaatttatcctttatccactcc

SEQ ID NO: 102250 - DNA, 50 bp, homo sapien
ggtcccggtgctatatcaataattarcaaataagtaacaatggacagagc

SEQ ID NO: 102251 - DNA, 50 bp, homo sapien
gtcaccaaccatgaatggggcccaaytaagaatctaggaatcccagggta

SEQ ID NO: 102252 - DNA, 50 bp, homo sapien
ataaaaacctccatgactagaggaamaatgtataaaggaagatggaaatg

SEQ ID NO: 102253 - DNA, 50 bp, homo sapien
ccctgcaactcacctatgttttaaawgtattgtcctactatccattacaa

SEQ ID NO: 102254 - DNA, 50 bp, homo sapien
gtgtccaagctttttgctttaaagaycagcaagttgaaaccagagaattc

SEQ ID NO: 102255 - DNA, 50 bp, homo sapien
taatcaccaaagtgtcagctgtagayctctctgaatagtgtgattattgc

SEQ ID NO: 102256 - DNA, 50 bp, homo sapien
taaaaaatcctccctacttttaattkgcaacaagaaaaaggacttatccc

SEQ ID NO: 102257 - DNA, 50 bp, homo sapien
gggctcatgtcttttggaaataaagratatactcaagctaggatgagcat

SEQ ID NO: 102258 - DNA, 50 bp, homo sapien
ctctggaggggaagtgaggctatgcsaagtaaaagtagctattttggtgg

SEQ ID NO: 102259 - DNA, 50 bp, homo sapien
acaatatgagcactatagttaatacygaattgtactcaggatttttgcta

SEQ ID NO: 102260 - DNA, 50 bp, homo sapien
atcatattgattagaaattaactctycttgcttatctttccatcagacca

SEQ ID NO: 102261 - DNA, 50 bp, homo sapien
tgccagaagatactgtatttataaarcacatgatctatataatgcatatg

SEQ ID NO: 102262 - DNA, 50 bp, homo sapien
gctccattataatcttttgggaacaycattttgtatgcagttcattgttg

SEQ ID NO: 102263 - DNA, 50 bp, homo sapien
aagggtttgcacagtctcccacttcrctattctgtgcctcaggatgtgac

SEQ ID NO: 102264 - DNA, 50 bp, homo sapien
ttcacagagttcaaagaccttaaaawctcatttcataaatacactcctcc

SEQ ID NO: 102265 - DNA, 50 bp, homo sapien
tcataatgccaaactcctaatcaaasaatcaattgccttttagaatcttt

SEQ ID NO: 102266 - DNA, 50 bp, homo sapien
ttcctttgtttactagacatagacakacccagtccccttgaagatccaca

SEQ ID NO: 102267 - DNA, 50 bp, homo sapien
gtgatttttatattgcataccaatartaaagtcattttctactattattg

SEQ ID NO: 102268 - DNA, 50 bp, homo sapien
aataagaaaaagttactatccaaaayatacacacttgataaaatatataa

SEQ ID NO: 102269 - DNA, 50 bp, homo sapien
taatgtttttattttgctgctttaaraaataagtggatatgttaacagaa

SEQ ID NO: 102270 - DNA, 50 bp, homo sapien
taacagttgcttatcttgctcataartaaggtttttactcagtctaaata

SEQ ID NO: 102271 - DNA, 50 bp, homo sapien
gtttttaatggtacagcttctctcartaatgaattaaatatttagtagta

SEQ ID NO: 102272 - DNA, 50 bp, homo sapien
atgttttttgtttattcattcacaawtaccaagtgggtgcctactgtgta

SEQ ID NO: 102273 - DNA, 50 bp, homo sapien
atttattcaacatttactaagtacawgtggtgtgccatgaactgtgtata

SEQ ID NO: 102274 - DNA, 50 bp, homo sapien
cagagaaagtttaaagttatataaayaggtatgtatgcatgtgtacacat

SEQ ID NO: 102275 - DNA, 50 bp, homo sapien
acaaatagactctggcttccatgtgsagaatagattgaagaacaacagtg

SEQ ID NO: 102276 - DNA, 50 bp, homo sapien
ttttatatggttacaaatatcaatamgcatactgggctaaatacaacaga

SEQ ID NO: 102277 - DNA, 50 bp, homo sapien
attgctttacaaacttacaggaatartacatagtgtttgtaaaacattta

SEQ ID NO: 102278 - DNA, 50 bp, homo sapien
gcggttcctgcccagtgctactaagrctctgctaggatatctcctccagc

SEQ ID NO: 102279 - DNA, 50 bp, homo sapien
cagcacaaacatagaacagaaaaacsgattatcaactaatagttttgaga

SEQ ID NO: 102280 - DNA, 50 bp, homo sapien
agaatgggggtccaccatgagcaacmgatttgaggtaccagtgcatagca

SEQ ID NO: 102281 - DNA, 50 bp, homo sapien
gagcccagcagcaatgtgagggagaygtagaaatcaaaacaactcacatt

SEQ ID NO: 102282 - DNA, 50 bp, homo sapien
agaggagcacatatttatgaagcaaraataggtacagtcattttccaact

SEQ ID NO: 102283 - DNA, 50 bp, homo sapien
ccttgatataacttcagacataaacracataagcacagggtcccaattcc

SEQ ID NO: 102284 - DNA, 50 bp, homo sapien
cagaggtgtaagttcagaggttgccrtctagccttcctcactacaatagc

SEQ ID NO: 102285 - DNA, 50 bp, homo sapien
gaagatagatttcaacagcttccacsatagcctgtgttccttgggacagc

SEQ ID NO: 102286 - DNA, 50 bp, homo sapien
ccaataaaccacagcagggaaaccayaccccatagctctccccagccttg

SEQ ID NO: 102287 - DNA, 50 bp, homo sapien
gattaaagaatgagttggcttaaaayagtaattcaagtcacaattctagc

SEQ ID NO: 102288 - DNA, 50 bp, homo sapien
ggtgtctgttttccttgaccccattrttgatgtcttgggagatctctgga

SEQ ID NO: 102289 - DNA, 50 bp, homo sapien
acaaccaggtggactgtacctgagasagaagcgggatgagaataaaaggg

SEQ ID NO: 102290 - DNA, 50 bp, homo sapien
ccatcctccaacctcacagctggaaycctagaggagatgcttctagaact

SEQ ID NO: 102291 - DNA, 50 bp, homo sapien
ggcttctcactcatatacagtcctcrtcaacacacaaagtgacctcttga

SEQ ID NO: 102292 - DNA, 50 bp, homo sapien
ctaactgttgtgttttaagagcggtmgtggcatgtccctagacccccttt

SEQ ID NO: 102293 - DNA, 50 bp, homo sapien
tgatctgggggagccaggatccttayatgaatgaatgagagatctcaggt

SEQ ID NO: 102294 - DNA, 50 bp, homo sapien
gagtcaacccaaataccggatgtgaraataatctttaagctgaactttcc

SEQ ID NO: 102295 - DNA, 50 bp, homo sapien
aagatactttttacattttggttgarattaagattatatttttaagtata

SEQ ID NO: 102296 - DNA, 50 bp, homo sapien
gaaaatggcattggtgttaggtatargaaaattcttcagatttaataact

SEQ ID NO: 102297 - DNA, 50 bp, homo sapien
ccagaggtagaattttaattctgtaygttatcatggggccttcagtataa

SEQ ID NO: 102298 - DNA, 50 bp, homo sapien
attgttaagtgatgcatgactgtatmaaataagtatttcctaaaatctaa

SEQ ID NO: 102299 - DNA, 50 bp, homo sapien
cccggcggaccccatactacatggargtcaaacagtgcctctgcttaagc

SEQ ID NO: 102300 - DNA, 50 bp, homo sapien
cacattttaatgttatggatgagccyaattagatttctttctaacatttt

SEQ ID NO: 102301 - DNA, 50 bp, homo sapien
ttctgggcagtggcaggacaatatawgcaggcaacttggctctggctgtt

SEQ ID NO: 102302 - DNA, 50 bp, homo sapien
gaggagttgctgtgggcacttgtgcrgatatggcaattcacccatttggt

SEQ ID NO: 102303 - DNA, 50 bp, homo sapien
acattggagtgacaatttggctgaayacaaaacactggatacaaagtttt

SEQ ID NO: 102304 - DNA, 50 bp, homo sapien
tgaattgtcttcttttctctagtgtycttcttaagaagtctaattcttat

SEQ ID NO: 102305 - DNA, 50 bp, homo sapien
ttcaaaataatgtaaatatgcttaasactactgaactatacacttaaaca

SEQ ID NO: 102306 - DNA, 50 bp, homo sapien
taaaatgaaagtactatctcatgtaycaaaagggataagtatcaaaaaca

SEQ ID NO: 102307 - DNA, 50 bp, homo sapien
agtgaattaggaaagtataggaacaytacctggaaaggttcaaaggtctg

SEQ ID NO: 102308 - DNA, 50 bp, homo sapien
tttttatgtcagtactatgaggatamaagtcatgtggaatagagaattga

SEQ ID NO: 102309 - DNA, 50 bp, homo sapien
gaaggaaagcaaactagaatgggtcrcagatggtagtggaggagacagcg

SEQ ID NO: 102310 - DNA, 50 bp, homo sapien
tcacattttacatgccaatatatgamctagaatatttgcctatggtgagc

SEQ ID NO: 102311 - DNA, 50 bp, homo sapien
tctgccccatctccctaaatttcgawctttgaattctctccatttgaact

SEQ ID NO: 102312 - DNA, 50 bp, homo sapien
ttggatattaaaatatatagcactaygaggtattaaaatgcaatataaag

SEQ ID NO: 102313 - DNA, 50 bp, homo sapien
gtagggagatgtgctaagctagaccrgacaagatctaagtccacttatgt

SEQ ID NO: 102314 - DNA, 50 bp, homo sapien
taaatcaatctatccatcgatttacyaacctatcatttatctatgtgtta

SEQ ID NO: 102315 - DNA, 50 bp, homo sapien
ttaagacattagctatttggaatgastatctttcatttttaaccagatga

SEQ ID NO: 102316 - DNA, 50 bp, homo sapien
aacactgaggagttgagctcattcayacaggcttttatcatgcttaattt

SEQ ID NO: 102317 - DNA, 50 bp, homo sapien
gccaacctgcctggggcaggggagaytccttgactttctggccctctgtt

SEQ ID NO: 102318 - DNA, 50 bp, homo sapien
atcacaatgggcataagttatacaargactatagagtgagatagttccag

SEQ ID NO: 102319 - DNA, 50 bp, homo sapien
cagaaataaaaaaatcagattctaarcctgagaaatatctacataaaccc

SEQ ID NO: 102320 - DNA, 50 bp, homo sapien
gtaaccctttcctctgaggtttaaayttacaattgtagggcattctgact

SEQ ID NO: 102321 - DNA, 50 bp, homo sapien
caactcttgccttgttcctatatgayaatgcagccaaacctttgtgcctc

SEQ ID NO: 102322 - DNA, 50 bp, homo sapien
attgcttgtttacttgtctgtgaacyggagggcaaccgcacatggcaggc

SEQ ID NO: 102323 - DNA, 50 bp, homo sapien
atgtttatttttcagattaacttccyacatcttctatgagttttgttttg

SEQ ID NO: 102324 - DNA, 50 bp, homo sapien
tcaagcttgcatggccacaatcttamattgaccttgaagccccaagctcc

SEQ ID NO: 102325 - DNA, 50 bp, homo sapien
taggtatcacttcaccccatgaaaarttggcacctagttcttaaataaag

SEQ ID NO: 102326 - DNA, 50 bp, homo sapien
tttgtttgaaacaagatctagccttmaaccactttgtgatttaaggagca

SEQ ID NO: 102327 - DNA, 50 bp, homo sapien
ctcatgcataaactaaggctctgcamagaattccataaagagaaaaaaat

SEQ ID NO: 102328 - DNA, 50 bp, homo sapien
tttctccagtctttggtttcttcctyacttggttaactgaccatcctata

SEQ ID NO: 102329 - DNA, 50 bp, homo sapien
acacagttttaactgagaaagttcayataactgcaaagcatcttaacatt

SEQ ID NO: 102330 - DNA, 50 bp, homo sapien
tctatttccatcaactaataatatcycaacattacacagacacatgtgaa

SEQ ID NO: 102331 - DNA, 50 bp, homo sapien
aaagctgattcccaggacagctgccrgtagtgccctctgcctttatttta

SEQ ID NO: 102332 - DNA, 50 bp, homo sapien
atctcaccgttggctgactccatctractttatgtgttcattcatatgtg

SEQ ID NO: 102333 - DNA, 50 bp, homo sapien
gttcagggctggttaagccagaggcycagtgaagttatcgcaaggtgctg

SEQ ID NO: 102334 - DNA, 50 bp, homo sapien
ccagatctgaaactccaatctcaccrttggctgactccatctgactttat

SEQ ID NO: 102335 - DNA, 50 bp, homo sapien
gatgatttctatcagtccttactctsagaccttagggttatcattttctt

SEQ ID NO: 102336 - DNA, 50 bp, homo sapien
ttttttttttcactgactatgactarggtcaaaaataaaatcagatcaag

SEQ ID NO: 102337 - DNA, 50 bp, homo sapien
ctagcaagtcatgaagataagatacraagtcaaattatgttttttctatt

SEQ ID NO: 102338 - DNA, 50 bp, homo sapien
ttccaactattaagacatctgcatgwttttccttaaatagttttcaaaat

SEQ ID NO: 102339 - DNA, 50 bp, homo sapien
caacaatgtctaagatattctgtgayagtagcccaaatggacaaagatac

SEQ ID NO: 102340 - DNA, 50 bp, homo sapien
taccacttctaggactcaattacaartaaacaatgataaacttgcacagt

SEQ ID NO: 102341 - DNA, 50 bp, homo sapien
ccaggaaacaaatacacaaggctctygacttacctgagaaggtgcccagg

SEQ ID NO: 102342 - DNA, 32 bp, homo sapien
ctggcgtgtgtctcaargaattacatcacctc

SEQ ID NO: 102343 - DNA, 50 bp, homo sapien
taccaatgctccacactccaagaagytttatcttctagctgcagctctca

SEQ ID NO: 102344 - DNA, 50 bp, homo sapien
aatttctttctcattacaaaaactayatgtgcttcttagacaaaaatcag

SEQ ID NO: 102345 - DNA, 50 bp, homo sapien
cgagtatctcttaccattgtaagaartaatctcattttttatccttcccc

SEQ ID NO: 102346 - DNA, 50 bp, homo sapien
ataatgctaaaaacataccaatgaayctctaacaacaatgactgacaaaa

SEQ ID NO: 102347 - DNA, 50 bp, homo sapien
atgctggatagagctaaggtgaatcraagccttgtaggcaaggataggga

SEQ ID NO: 102348 - DNA, 50 bp, homo sapien
gagcactgctggtgacattgtagaawtataagagaactcagtgactagac

SEQ ID NO: 102349 - DNA, 50 bp, homo sapien
ggctggctggagtgaaagtgaattcrgaaagccaggcctgcctaggacac

SEQ ID NO: 102350 - DNA, 50 bp, homo sapien
gtttaattttagatagggcattttaygttggtttattaagtcatttgaag

SEQ ID NO: 102351 - DNA, 50 bp, homo sapien
cacttgaattgcaactcacccatggraagttatggaatcttggcatgaac

SEQ ID NO: 102352 - DNA, 50 bp, homo sapien
aaaatacaattcacataccataaaaytggattcatttaaaatgtagaatt

SEQ ID NO: 102353 - DNA, 50 bp, homo sapien
catttgttttttacatatccaaaaartaaagactcagccctacaatgctt

SEQ ID NO: 102354 - DNA, 50 bp, homo sapien
ttcagctcagattatactttcactcygaattgcttcaacaattacgtttt

SEQ ID NO: 102355 - DNA, 50 bp, homo sapien
agccatttgcccacgtcctacattcrcagacagaaaagagactgcttttg

SEQ ID NO: 102356 - DNA, 50 bp, homo sapien
gcaatgcactagtgaaaagtggaatsaagtagacccactagcttctttga

SEQ ID NO: 102357 - DNA, 50 bp, homo sapien
gttcatcctgcgttttggaccatcartgctttcctaattatacaatccaa

SEQ ID NO: 102358 - DNA, 50 bp, homo sapien
attggcatttaatatggagaactgcratttcccttctagctttgtactta

SEQ ID NO: 102359 - DNA, 50 bp, homo sapien
ctttaggcacactttcaaatgaacartgtatacagtttttataaattttt

SEQ ID NO: 102360 - DNA, 50 bp, homo sapien
gtatgataagtccattatcttttaayatgtgattctgttcagaaattgac

SEQ ID NO: 102361 - DNA, 50 bp, homo sapien
ataatgagggttcacgtttgtaaacyaagtatgataagtccattatcttt

SEQ ID NO: 102362 - DNA, 50 bp, homo sapien
tgcttgacagatataaggcattcacyaaatacatatgggaagaaaggcag

SEQ ID NO: 102363 - DNA, 50 bp, homo sapien
tggcccacttggaaatcctaactccrcagaacaaaattttacaagcttcc

SEQ ID NO: 102364 - DNA, 50 bp, homo sapien
tatgggcagtagagcaggagaaatgkaagctgaatctatttgtgtttatt

SEQ ID NO: 102365 - DNA, 50 bp, homo sapien
ttgtttacctgaatgagaagacggamtcagcaggtatttttgagcctggg

SEQ ID NO: 102366 - DNA, 50 bp, homo sapien
gttgaaattacataatttaaatgagkatctgattccaaaacagtgtatga

SEQ ID NO: 102367 - DNA, 50 bp, homo sapien
gcatacatttgatggtcttggaacaygtgaaaatatttgtttaaacaata

SEQ ID NO: 102368 - DNA, 50 bp, homo sapien
taaatacctcagaactcacatgcaaktattgacatagaggacatctttgg

SEQ ID NO: 102369 - DNA, 50 bp, homo sapien
taatcagaactaaaatcataaacacrggtataggcttttataggtgatac

SEQ ID NO: 102370 - DNA, 50 bp, homo sapien
tgatggtctttgacatcgttccctcmaaagctggaacaccccttcactct

SEQ ID NO: 102371 - DNA, 50 bp, homo sapien
catcccctctccaactatgcctaccygattctgatagtttcattattctt

SEQ ID NO: 102372 - DNA, 50 bp, homo sapien
accagactgagaagatactcggtctycttaattcaggatctaatctatgt

SEQ ID NO: 102373 - DNA, 50 bp, homo sapien
agtgcatccacaaattatatacaaarccaatagttcctatcctgagaatc

SEQ ID NO: 102374 - DNA, 50 bp, homo sapien
gtacagtgttatggtccaacttctayaaaggctatatggtgggaataaat

SEQ ID NO: 102375 - DNA, 50 bp, homo sapien
agcacctttatacagtctgttctaayaagccctactagtgatgctgatgc

SEQ ID NO: 102376 - DNA, 50 bp, homo sapien
atggagaattagtaaaattagagtaygtcatcgtggattaggtatgattt

SEQ ID NO: 102377 - DNA, 50 bp, homo sapien
gaaagcacatgtcaagtgctcagtayagtagctggcccatggagaccctt

SEQ ID NO: 102378 - DNA, 32 bp, homo sapien
caggaacttggtgagcrtcatcactaaggcca

SEQ ID NO: 102379 - DNA, 50 bp, homo sapien
cgccctaagagtttttggcatatcaygtaagcaggtttggtagctcttcc

SEQ ID NO: 102380 - DNA, 50 bp, homo sapien
gaaggtacctctcttctgaacacacmctgcttataatactaggtgaagga

SEQ ID NO: 102381 - DNA, 50 bp, homo sapien
gcatacttgctccaaggtttaaatartataatattgcatgtcaagtgctt

SEQ ID NO: 102382 - DNA, 50 bp, homo sapien
cagtgcctcccatgtcccaggcatcrccctaagagtttttggcatatcat

SEQ ID NO: 102383 - DNA, 50 bp, homo sapien
tcctacccatgccccctccgaatgcracctatttccatagtagctggaat

SEQ ID NO: 102384 - DNA, 50 bp, homo sapien
atgttttaaaaagttgcaacacataycatttgagtcaacttataaaaggg

SEQ ID NO: 102385 - DNA, 50 bp, homo sapien
ttgagttgatatcagccctttgataycctgctttaataatttgataggga

SEQ ID NO: 102386 - DNA, 50 bp, homo sapien
ctctagaggcccaagaacacagaggwccatgtataataaatggaaaacat

SEQ ID NO: 102387 - DNA, 50 bp, homo sapien
gaagcaacagaaaatgttaccttcarcaggatgccacatggaggtgtctg

SEQ ID NO: 102388 - DNA, 50 bp, homo sapien
gcacatcttaccgatctaaatctggkaatgtaatctagtagcataaaaat

SEQ ID NO: 102389 - DNA, 50 bp, homo sapien
tgattatattattgttaaactgctakccatttattttgattattatgaat

SEQ ID NO: 102390 - DNA, 50 bp, homo sapien
ccactatgttcttagtaagaatcacrgtaaaacaacaactaacacttctt

SEQ ID NO: 102391 - DNA, 50 bp, homo sapien
ttcagaggggttgactgagagaacaygtacacgagtactgagaactccta

SEQ ID NO: 102392 - DNA, 50 bp, homo sapien
gggtcttatgtgctagggcatataaygtaaatcttctcttaacattttat

SEQ ID NO: 102393 - DNA, 50 bp, homo sapien
ttgcccagatctggtcctggaacccmctcatcttccatggagtactgacc

SEQ ID NO: 102394 - DNA, 50 bp, homo sapien
aaaagcattttggaaatagtggacamctaaggtttctcttaacgattaca

SEQ ID NO: 102395 - DNA, 50 bp, homo sapien
ggcactaagaacacattatacaaatraagtaaagttaccatgtaataata

SEQ ID NO: 102396 - DNA, 50 bp, homo sapien
ctattcctcattaagtctttaccaaytcagtcaatgtcatcactgaccat

SEQ ID NO: 102397 - DNA, 50 bp, homo sapien
ctagataagccacctgtcttctgtaygtaagccactatgtaaacctacca

SEQ ID NO: 102398 - DNA, 50 bp, homo sapien
ctctgcaagctgcagtagccgataawgtgtttaaatattggtaggataac

SEQ ID NO: 102399 - DNA, 50 bp, homo sapien
ggattgaaaggataaagtgatgacartaagaggtagttatctgctggatg

SEQ ID NO: 102400 - DNA, 50 bp, homo sapien
gtttcacttggatgttctcttatcakgtatgtctaacattgcatacatca

SEQ ID NO: 102401 - DNA, 50 bp, homo sapien
ttaggttacaacatcaactgcattaygtaacagttattgaaagcaagtca

SEQ ID NO: 102402 - DNA, 50 bp, homo sapien
taacatttgtcttacataagtcacaragagtatatagaaccaaacaaata

SEQ ID NO: 102403 - DNA, 50 bp, homo sapien
ttagcaaatcaaatgaacactactayggcttacaacaagcctttgtcttc

SEQ ID NO: 102404 - DNA, 50 bp, homo sapien
ttaattatttccaataacattaactraattcttactacattccaggcctt

SEQ ID NO: 102405 - DNA, 50 bp, homo sapien
tctgggaagactttagtggacatcartaaagctccaggtgtagtcctggg

SEQ ID NO: 102406 - DNA, 50 bp, homo sapien
gttatgggcaagtgatggtaacgtcragcctctaattcatatatttgcca

SEQ ID NO: 102407 - DNA, 50 bp, homo sapien
accctttgcatcatttacaaggtcawactatatcagggaggattcttgat

SEQ ID NO: 102408 - DNA, 50 bp, homo sapien
tggttcaactgaaatcattcactcayggtcactccattttcttgtcagca

SEQ ID NO: 102409 - DNA, 50 bp, homo sapien
actctaggaggatgtccgaagtgtcyaatcttaccacccagtgaaggtct

SEQ ID NO: 102410 - DNA, 50 bp, homo sapien
attgtcaatatttttaagcaaggtargtgaagtctctgtgccacttccaa

SEQ ID NO: 102411 - DNA, 50 bp, homo sapien
gcaaagttccttacaagagaaatgcmaggagagtcggaagaaggcaatgg

SEQ ID NO: 102412 - DNA, 50 bp, homo sapien
tgtgcagcgtgtgctgaccgcattaycaaaacccttagcaagaccaagaa

SEQ ID NO: 102413 - DNA, 50 bp, homo sapien
tataccagtgcaggtttagtattcaycaactaagttgctcaaatcctgtg

SEQ ID NO: 102414 - DNA, 50 bp, homo sapien
ttgggttctcccttggccttggtaawagtcttatttgtatctggactgtg

SEQ ID NO: 102415 - DNA, 50 bp, homo sapien
tactaagtgcctggtacatggtagasacccaaaaactatttcttgaatta

SEQ ID NO: 102416 - DNA, 50 bp, homo sapien
caacaaagactatctggccctttaayaacaagagttctccaaccctccca

SEQ ID NO: 102417 - DNA, 50 bp, homo sapien
tgtatagctaaaacatagataaccarggctagttgagcttaataagtggc

SEQ ID NO: 102418 - DNA, 50 bp, homo sapien
ctccttgcatctgtaggcctaaagayaaagtcaaatacagcaacttatta

SEQ ID NO: 102419 - DNA, 50 bp, homo sapien
tctgtacattcactcacaactgtgarcagcccataaatattcaatactca

SEQ ID NO: 102420 - DNA, 50 bp, homo sapien
aagcatctctttctgaagtaataacrctatgtcctcactggctattgata

SEQ ID NO: 102421 - DNA, 50 bp, homo sapien
tcacaaagcaaaccagttcatatggrcacctagaaaataattttgaataa

SEQ ID NO: 102422 - DNA, 50 bp, homo sapien
attggtggtcttctgtgtccactcayggtcagtattagcagtaaaaagtg

SEQ ID NO: 102423 - DNA, 50 bp, homo sapien
aagtacacagatacaacccactgacracctagggctgggagggagctggc

SEQ ID NO: 102424 - DNA, 50 bp, homo sapien
aacaattctttttggataagtttacygagtctatgaatgaactaataaat

SEQ ID NO: 102425 - DNA, 50 bp, homo sapien
cctgtaccatgcttggggctgaaggwatctcctgcaagtgatgaagggcc

SEQ ID NO: 102426 - DNA, 50 bp, homo sapien
gcattttcattgctatatgatactcyaaatggaatcctatgcagacatca

SEQ ID NO: 102427 - DNA, 50 bp, homo sapien
ctataccgtatttgaataagacatamcttaacagaagaagaaaaaaagaa

SEQ ID NO: 102428 - DNA, 50 bp, homo sapien
ggggcaagcacaaacatggatataarctagtgagatctgtgtaaggaata

SEQ ID NO: 102429 - DNA, 50 bp, homo sapien
gttaaaagatccgtggctccttataygaaattaaactctttctctctggt

SEQ ID NO: 102430 - DNA, 50 bp, homo sapien
acattatgtacctagtgaatttccastacctgagtctcacacctgacaaa

SEQ ID NO: 102431 - DNA, 50 bp, homo sapien
catcccaaaggaaaacattggaataraaaattaccattagttgaagacag

SEQ ID NO: 102432 - DNA, 50 bp, homo sapien
gtcatataactgcttcaagaaaagayagcttgctggtaaaggtatagaag

SEQ ID NO: 102433 - DNA, 50 bp, homo sapien
tgtcagctttccaaatgatgctataygctttatatatttttcaattttca

SEQ ID NO: 102434 - DNA, 50 bp, homo sapien
ggttgttatcactgaaacctcagaayattagttgtttcttaaacaatgta

SEQ ID NO: 102435 - DNA, 50 bp, homo sapien
actggctctgcctacagcaacaatascaagtttcccaaataaatttaaat

SEQ ID NO: 102436 - DNA, 50 bp, homo sapien
cttctttttcacttctctaataacayggcaaggagttggaaaaaaatttc

SEQ ID NO: 102437 - DNA, 50 bp, homo sapien
cattagatctgtgttaattagttagyactccactgcacatgctaatgact

SEQ ID NO: 102438 - DNA, 50 bp, homo sapien
tatttgtaaaatgtaaaacttgaaayggagaactcttgatagttttcatt

SEQ ID NO: 102439 - DNA, 50 bp, homo sapien
attcagatgaacttggttttgatcaygttagaacagttactgttgcttgg

SEQ ID NO: 102440 - DNA, 50 bp, homo sapien
agacaattctagttcagttccatgaktatttctgcaacagatctagcatt

SEQ ID NO: 102441 - DNA, 50 bp, homo sapien
tagcaattggttcaagaatggatatrtaactttgactcatccaattaaaa

SEQ ID NO: 102442 - DNA, 50 bp, homo sapien
gtagcccagttacagttaggttataygagtatgaatgaccacacaaaggc

SEQ ID NO: 102443 - DNA, 50 bp, homo sapien
tctctggaggcccttatccaaaggasgtgttaggctaattgtgagggtta

SEQ ID NO: 102444 - DNA, 50 bp, homo sapien
cacaaatttagagactgtcttgtccmaatgctttattttagaaacgtctt

SEQ ID NO: 102445 - DNA, 50 bp, homo sapien
tgtggcctctacccaaaagaagatcrcaatccagttggtgaggtaaatta

SEQ ID NO: 102446 - DNA, 50 bp, homo sapien
acagcataaattgttagtagtgtagyaaggtccttccttaaggggaccca

SEQ ID NO: 102447 - DNA, 50 bp, homo sapien
gtttgtttttctcaatatcttattaygaaaaatttccaataaatagcaaa

SEQ ID NO: 102448 - DNA, 50 bp, homo sapien
attctgataatttagatctcccttgmaggcttgggcagcatttaatcatt

SEQ ID NO: 102449 - DNA, 50 bp, homo sapien
agatcatttaaggaacaggcaaatamcagttgacaagtaaattaccactt

SEQ ID NO: 102450 - DNA, 50 bp, homo sapien
attctgtgtaatctcttcagtattamagttcattgattttaatgtttacc

SEQ ID NO: 102451 - DNA, 50 bp, homo sapien
tgtaccaaatgtttacatttacatawcacttgacttagcaattctatttc

SEQ ID NO: 102452 - DNA, 50 bp, homo sapien
gaacgtgaacatggtggtgcccgcaytgcggagtgttccctgtgacgtct

SEQ ID NO: 102453 - DNA, 50 bp, homo sapien
ggtaatagaatttgtgaggctaaaayattgaaggacatcctgtgtctaga

SEQ ID NO: 102454 - DNA, 50 bp, homo sapien
gtaatttgaaaccaacttgataacarcttgttcaaatgaagaatggatag

SEQ ID NO: 102455 - DNA, 50 bp, homo sapien
tcactccaatgaacaacactgaggamcctaagctagtaatcctagctcca

SEQ ID NO: 102456 - DNA, 50 bp, homo sapien
gccatggatacctctcagaacttcaygtcacagagaaaatgtccttggat

SEQ ID NO: 102457 - DNA, 50 bp, homo sapien
aaataacctttaaatatctatcagcraacagtaaactgagggataaaaag

SEQ ID NO: 102458 - DNA, 50 bp, homo sapien
attgacagcaagtcctgaaaattacwcactttttacaataattgaatgta

SEQ ID NO: 102459 - DNA, 50 bp, homo sapien
cctgtctgtccagctcagcactctayctaagaaatcctagaagctgggaa

SEQ ID NO: 102460 - DNA, 50 bp, homo sapien
gcatcatcacattcctagatgccaaractacagtatcttggaatcacata

SEQ ID NO: 102461 - DNA, 50 bp, homo sapien
atctaaatgtttacttaggcagccarattaccaactatattggttttctt

SEQ ID NO: 102462 - DNA, 50 bp, homo sapien
taggaatgtgatgatgcctttaacaragagagaggatgagaaaaagtgta

SEQ ID NO: 102463 - DNA, 50 bp, homo sapien
ggtgggagcagatggatgcatatgartaaaccaaagtgcaatgaaaggtg

SEQ ID NO: 102464 - DNA, 50 bp, homo sapien
gaagctgtttcacttcctcatgatasaatggcatgccccacatatatgtg

SEQ ID NO: 102465 - DNA, 50 bp, homo sapien
tacaggaaattagaagcaataaaaarcacagtatatatgtgatgctagaa

SEQ ID NO: 102466 - DNA, 50 bp, homo sapien
ttatacagcaatagaaagtaatatgscatatcacataaagctctttgttt

SEQ ID NO: 102467 - DNA, 50 bp, homo sapien
gtgagatcaaagaaattaagagtccraacaattattttaacataatagta

SEQ ID NO: 102468 - DNA, 50 bp, homo sapien
agtgcagggttagtggaatatacagkaaattagaagcaataaaaagcaca

SEQ ID NO: 102469 - DNA, 50 bp, homo sapien
tgtagactgttcacatttgttatgaygattcatggtcatcattaaatctg

SEQ ID NO: 102470 - DNA, 50 bp, homo sapien
cctaatctgtggttataagtgagaaygttgtgtgccctttgccattactt

SEQ ID NO: 102471 - DNA, 50 bp, homo sapien
aaaccaatatgagagtttagaagatyaatatttttcatttttttcttatt

SEQ ID NO: 102472 - DNA, 50 bp, homo sapien
aattatttaacaaatattagatagakcatactctgtgccagatggtattc

SEQ ID NO: 102473 - DNA, 50 bp, homo sapien
agaaaacttctagagtaaggtgaaargacttgagcgataccagatgaaac

SEQ ID NO: 102474 - DNA, 50 bp, homo sapien
atgtgagtctgtgcctatcttgaaaygctcacatatttgcaggcaaaata

SEQ ID NO: 102475 - DNA, 50 bp, homo sapien
taaacttaaaaaaattgacttggaawagatcacataaccaatcaaaccaa

SEQ ID NO: 102476 - DNA, 50 bp, homo sapien
aaaatagtaacataaaagaaactctsactcaagaccatttactaggattg

SEQ ID NO: 102477 - DNA, 50 bp, homo sapien
atatgttttctgcaaatagattcccraacatgtcctcacatccttccagt

SEQ ID NO: 102478 - DNA, 50 bp, homo sapien
ctcactgcagatgagatgaaacaagytgtgcatggcaggacaggagctca

SEQ ID NO: 102479 - DNA, 50 bp, homo sapien
agactattcagtgctaccagtgcatygctaaggcttctaaaacagaatgc

SEQ ID NO: 102480 - DNA, 50 bp, homo sapien
gaatatcttcttaaaatatccatagkatttattgtggataactctaaaca

SEQ ID NO: 102481 - DNA, 50 bp, homo sapien
tttttattcacttacttgtctaatarcattttactgatattttccaaaag

SEQ ID NO: 102482 - DNA, 50 bp, homo sapien
ttatataatttaacaaatctcctaaygtaatgaattgaaataatgtattg

SEQ ID NO: 102483 - DNA, 50 bp, homo sapien
gactcttcattctatttcgcccttcrcaaagagttagctgccagctctgt

SEQ ID NO: 102484 - DNA, 50 bp, homo sapien
tgtttgcagcacagattaaggagtgsatctgattaatttcaaaattacac

SEQ ID NO: 102485 - DNA, 50 bp, homo sapien
taagatctctagagctaatgaatgaraatatacaatacttagcaaaggta

SEQ ID NO: 102486 - DNA, 50 bp, homo sapien
ttggaaaataaaatattggcccataragtgcaaaggcaaaaaagttactt

SEQ ID NO: 102487 - DNA, 50 bp, homo sapien
ggccaggtgggcaggccttgtagaayatgttgaagatttggtcttcatcc

SEQ ID NO: 102488 - DNA, 50 bp, homo sapien
ctagacagtacaaggacctttgaacrctttaattctactaatgcctctct

SEQ ID NO: 102489 - DNA, 50 bp, homo sapien
tattgaacagcatcaagtgattctayattgagaagtaaatgcatgataat

SEQ ID NO: 102490 - DNA, 50 bp, homo sapien
tattgaatccatttagtacaaacacrctcggaaaatataaatatggcttg

SEQ ID NO: 102491 - DNA, 50 bp, homo sapien
tgttccaattctgtgatataaatacyaccaacatagctaattctgagatg

SEQ ID NO: 102492 - DNA, 50 bp, homo sapien
gttccatttttggagagaagcagcartaaaagttatgaaacagagaagaa

SEQ ID NO: 102493 - DNA, 50 bp, homo sapien
gggtagaaatagttgttatagatacscagaaaactgaggcaatgaaaaac

SEQ ID NO: 102494 - DNA, 50 bp, homo sapien
tttatctgcacagaaaatgtttgcasccattaggaattcatagcaaaatt

SEQ ID NO: 102495 - DNA, 50 bp, homo sapien
aatcctcatacctttactctttataygatttgcaaaaacagttattaatc

SEQ ID NO: 102496 - DNA, 50 bp, homo sapien
tttggttactgctatttctgtagcamctagagtagtatgtggcatgtaaa

SEQ ID NO: 102497 - DNA, 50 bp, homo sapien
gaaatttaaagaaaaggatttctaartactctaaaagcaactgagacagc

SEQ ID NO: 102498 - DNA, 50 bp, homo sapien
tattagctttgttccttagaacttgmaaacatccgctgaggaagacacag

SEQ ID NO: 102499 - DNA, 50 bp, homo sapien
attaatttcatctcagaatcacatamactctttaaaataggagagacaga

SEQ ID NO: 102500 - DNA, 50 bp, homo sapien
gactagatccttcccagagccttccraggagcgcggcccctctgctggcc

SEQ ID NO: 102501 - DNA, 50 bp, homo sapien
gttctgctgtattaaacagtgaatartatcaggataacaatgttaattgg

SEQ ID NO: 102502 - DNA, 50 bp, homo sapien
ttgtgacttatcagtgcctagtacartaaaaagtatatctgtaatttata

SEQ ID NO: 102503 - DNA, 50 bp, homo sapien
agatataactgtgattaatgggtcayaaattggtaagccatgataataaa

SEQ ID NO: 102504 - DNA, 50 bp, homo sapien
acagggttctgtagctagttttcaaycaaacctgagtaaggcaccagtat

SEQ ID NO: 102505 - DNA, 50 bp, homo sapien
ccttccatatatttctttaaattacrctgtcaacgggacaaaccgcgtcc

SEQ ID NO: 102506 - DNA, 50 bp, homo sapien
tgccaacaatggtgtgacatgtttcyacattctaattcaaagtgtttttt

SEQ ID NO: 102507 - DNA, 50 bp, homo sapien
ccctgcccaatccacacttccagatragagaatcacacttttgggttatt

SEQ ID NO: 102508 - DNA, 50 bp, homo sapien
gcaactgtgggtagtttatttcttgrcaacctatctctaaccccagacat

SEQ ID NO: 102509 - DNA, 50 bp, homo sapien
aagaagaaaagataactctttaccayaatatcaagaagctatcgaaatac

SEQ ID NO: 102510 - DNA, 50 bp, homo sapien
ttacagaccctactttactcaaacayatttatggcatggtgagatatata

SEQ ID NO: 102511 - DNA, 50 bp, homo sapien
ctgtcctgacttaatggttctggtasacagtgtttcagctaactattcct

SEQ ID NO: 102512 - DNA, 50 bp, homo sapien
gagtaaggagtcaaaaacttcataartacataaaactgcttacagtccta

SEQ ID NO: 102513 - DNA, 50 bp, homo sapien
tatttggtggaaaatcaggagaccasaacctatttttgctgcttctgacc

SEQ ID NO: 102514 - DNA, 50 bp, homo sapien
tgaggacatagaaaaatggcagtatwacatctattttgcaatctctttgc

SEQ ID NO: 102515 - DNA, 50 bp, homo sapien
actgtaccctgggctattaaaaggtsaaacattcaacacattgaaataac

SEQ ID NO: 102516 - DNA, 50 bp, homo sapien
gtaaaatcacaaatatgcaaatggaygccaaagatttctttaaaaacaaa

SEQ ID NO: 102517 - DNA, 50 bp, homo sapien
gtgctgggccctgtgccagggcagargataccaataagaaaggggaaaac

SEQ ID NO: 102518 - DNA, 50 bp, homo sapien
ctgttagatgacaatacatgttattwaaaaaaagacaagaagtgtgtgtg

SEQ ID NO: 102519 - DNA, 50 bp, homo sapien
ttggttcaattttctcatggaaaatracatacatgctgctttaaatagcc

SEQ ID NO: 102520 - DNA, 50 bp, homo sapien
tggaatagtaattctttaaaatatartagggactagaaaatctttctata

SEQ ID NO: 102521 - DNA, 50 bp, homo sapien
tttgtgaatagtcagggtgcttgcayatgtatggatctgtatatttgtag

SEQ ID NO: 102522 - DNA, 50 bp, homo sapien
ttctagagtggtctgtgcagggttaygttgaagcttctgtcttggcttgt

SEQ ID NO: 102523 - DNA, 50 bp, homo sapien
gcaagactacttcttcatacaaagawacaaagcaaagaaccagaatatgt

SEQ ID NO: 102524 - DNA, 50 bp, homo sapien
catctggttttgacctcggagctacygtagttctgtgtttgactttctga

SEQ ID NO: 102525 - DNA, 50 bp, homo sapien
tttcatatttgtcaacaatttcacaygtatgatctcatttcagcctataa

SEQ ID NO: 102526 - DNA, 50 bp, homo sapien
tcaaccaggacttgccaaaaacagaytgagcccctaggagtaagagtgac

SEQ ID NO: 102527 - DNA, 50 bp, homo sapien
caagtatacacaaaaacagttggtgscaaataacttatatgatcacaaat

SEQ ID NO: 102528 - DNA, 50 bp, homo sapien
gtccctttttatccagaaaagttgamgcacatctttatgtgggggagaag

SEQ ID NO: 102529 - DNA, 50 bp, homo sapien
gagacctatctgaattaatggctaaraagatttgagtcataaaaaaacaa

SEQ ID NO: 102530 - DNA, 50 bp, homo sapien
atttcactccttttgttacatttacscgataggattctaaatcccttctc

SEQ ID NO: 102531 - DNA, 50 bp, homo sapien
gttgtgggacacttgcaaagagtaasaagccctggattcctgcccttcag

SEQ ID NO: 102532 - DNA, 50 bp, homo sapien
tggaatttcaaacatgataaatagayaggagtggcccttcttctgcaagg

SEQ ID NO: 102533 - DNA, 50 bp, homo sapien
ttttaattattaagtatttcttagcrcatgtataaattgataatggatgg

SEQ ID NO: 102534 - DNA, 50 bp, homo sapien
tgtgatgccgaaaaactgtttttacrtgaatgaaggcccatttctccagt

SEQ ID NO: 102535 - DNA, 32 bp, homo sapien
agttatggccaagaccygactgttttgagggc

SEQ ID NO: 102536 - DNA, 50 bp, homo sapien
taatcaagaatgtgaagctttggaarcgagtaagataagtaatatttgca

SEQ ID NO: 102537 - DNA, 50 bp, homo sapien
ctcccaatcttagcatcatctcctgrattcatagactctttccagcctat

SEQ ID NO: 102538 - DNA, 50 bp, homo sapien
cattcataagcccacaaaaaaaatckatgtgtcattctacaccttcactg

SEQ ID NO: 102539 - DNA, 50 bp, homo sapien
gtccatgattctctgatttggcaaaragaacttggtcactgcttttgctg

SEQ ID NO: 102540 - DNA, 50 bp, homo sapien
aaaatattttgagaactagaaaggarataaccattgtaaaagtgaaacta

SEQ ID NO: 102541 - DNA, 50 bp, homo sapien
ctggttcatctagtgcctagtgacaratgaaatagttcttatatgaggct

SEQ ID NO: 102542 - DNA, 50 bp, homo sapien
ttccatttattaaatgccagtttaayaggtcagaaaacttatgttcaaaa

SEQ ID NO: 102543 - DNA, 50 bp, homo sapien
attctgggcatttgtgacatattaaycaactaattgttaattaatgaatt

SEQ ID NO: 102544 - DNA, 50 bp, homo sapien
tggaaatggttcttctactcatatcraattatcagggaggatgtcagctg

SEQ ID NO: 102545 - DNA, 50 bp, homo sapien
aatttatgatgcaggataatgtcaarcactaaagattcattttatttcaa

SEQ ID NO: 102546 - DNA, 50 bp, homo sapien
aaggaatctgaaatatgggaacaaartaagaggcaatttaagatggtcta

SEQ ID NO: 102547 - DNA, 50 bp, homo sapien
aatactcactacgagaatacaatagmattagacatgtcaggaattttata

SEQ ID NO: 102548 - DNA, 50 bp, homo sapien
ggcacatagtaaaacatgaaaaatawtatagtcctatcactctcttgacc

SEQ ID NO: 102549 - DNA, 50 bp, homo sapien
ctcttggagacaggactgagctaaaygtgcaaagaaaataaggtagtagt

SEQ ID NO: 102550 - DNA, 50 bp, homo sapien
caagaaacattttacatacataacayagatgggcaatacaatttagttta

SEQ ID NO: 102551 - DNA, 50 bp, homo sapien
caggagattacttagatccaaaccawcctagttttcatttctcttggcat

SEQ ID NO: 102552 - DNA, 50 bp, homo sapien
tgaggcacgatattccatatataaaragccaagaatgactaaataagttt

SEQ ID NO: 102553 - DNA, 50 bp, homo sapien
aatctgaaatctaagcagacatttaraacaagatttttgaaggcatttcc

SEQ ID NO: 102554 - DNA, 50 bp, homo sapien
ctaatctatgaaatgggtaaacttayggaacttatggtataggttgatat

SEQ ID NO: 102555 - DNA, 50 bp, homo sapien
ggaaagcacttaaaaccttgcctaaygcaaggcaatccgctcaatcccag

SEQ ID NO: 102556 - DNA, 50 bp, homo sapien
agaaatggccacttactctgcattakcccatgtacctttttgaatagtct

SEQ ID NO: 102557 - DNA, 50 bp, homo sapien
gagatgataagttgctacagggaggyataatttaaagtcaatttaaactg

SEQ ID NO: 102558 - DNA, 50 bp, homo sapien
ctaaagcagctgtgaatttatgccamagaattaaataaacaaaaatacca

SEQ ID NO: 102559 - DNA, 50 bp, homo sapien
tatatatatatatattttaaattccwctgctctaaaatgcttccaaagag

SEQ ID NO: 102560 - DNA, 50 bp, homo sapien
atatgtagagggcaaaaaagggcacmaagaaaagagtagtcaatgcttcc

SEQ ID NO: 102561 - DNA, 50 bp, homo sapien
atattataaacctatgaatagtaccygattgtctacagatgttagaattt

SEQ ID NO: 102562 - DNA, 50 bp, homo sapien
tcttccctagtgctaccaggaagcaytgactactcttttcttggtgccct

SEQ ID NO: 102563 - DNA, 50 bp, homo sapien
cgatgcccttacagcaaacttaaaamtcttgtgcgccttttagccacccg

SEQ ID NO: 102564 - DNA, 50 bp, homo sapien
gttaaagagtctgggatttcaagaaytgtatttaagtgtattgccacacc

SEQ ID NO: 102565 - DNA, 50 bp, homo sapien
ttatcttccatagttttccaagggamctgagtagatagttctgtcattct

SEQ ID NO: 102566 - DNA, 50 bp, homo sapien
actcatctgactatggatatcatcaytcctagatactcctgctcatatga

SEQ ID NO: 102567 - DNA, 50 bp, homo sapien
aagcttctctgctagatcaggaatargtaaacataaatgcaatagccaga

SEQ ID NO: 102568 - DNA, 50 bp, homo sapien
ttaagttatgctggtagtttaacatkcacgtattttgctgcaatgtgcaa

SEQ ID NO: 102569 - DNA, 50 bp, homo sapien
ttctggacattcattatatactttarcaagaccagaaagttctatcttaa

SEQ ID NO: 102570 - DNA, 50 bp, homo sapien
tcccttggttaagggcaagagttaayaattacagtatgttaaactcatct

SEQ ID NO: 102571 - DNA, 50 bp, homo sapien
aatgcatattatatagatgaaagtamaatgtaaacaaatgaaaagcaata

SEQ ID NO: 102572 - DNA, 50 bp, homo sapien
tccagaaacagacccatggatataaragaatgtacttagtaattaagatg

SEQ ID NO: 102573 - DNA, 50 bp, homo sapien
taagcatattcccaaacacactttaraaacacagaatattttagaagcat

SEQ ID NO: 102574 - DNA, 50 bp, homo sapien
attaggacaagatcaaactccattaycttgcatagattactctctagaaa

SEQ ID NO: 102575 - DNA, 50 bp, homo sapien
agcaccttacgtattattcttgaccrattttcctcaactgcagtcatttt

SEQ ID NO: 102576 - DNA, 50 bp, homo sapien
aagtcaaagccaggtcaaataagaartctgcacagcttattctcttgctc

SEQ ID NO: 102577 - DNA, 50 bp, homo sapien
tgtgagataacatatgaaagtgtctrcctaagataggcttttttccaagt

SEQ ID NO: 102578 - DNA, 50 bp, homo sapien
tctacctaagataggcttttttccamgttagtttctgaaaagtattaacc

SEQ ID NO: 102579 - DNA, 50 bp, homo sapien
tcatcagcatcagaatcccagtttayagcctaagtacattgctgcccaag

SEQ ID NO: 102580 - DNA, 50 bp, homo sapien
tcagctgccagcataaaagcagtcayggaaagagccgacttgctgagtct

SEQ ID NO: 102581 - DNA, 50 bp, homo sapien
aaagcctccagattggtatgaaaatkattgagttattaaatttatgtatc

SEQ ID NO: 102582 - DNA, 50 bp, homo sapien
gacttacccacactgtctgagaaatwaagagctaggaagatggctccagt

SEQ ID NO: 102583 - DNA, 50 bp, homo sapien
agagacatgtttactcttgagaaacrctagagagagttgactggtagtag

SEQ ID NO: 102584 - DNA, 50 bp, homo sapien
tagctcctcttgtggaacactgataytactgcttttcaaacatacaataa

SEQ ID NO: 102585 - DNA, 50 bp, homo sapien
aagtcaaaagtaacagaaaatactaygtgaaatgattctaataagcaata

SEQ ID NO: 102586 - DNA, 50 bp, homo sapien
cccctcagcaaaaatggaaaagaaartacctcagcaatcttacagccaag

SEQ ID NO: 102587 - DNA, 50 bp, homo sapien
aaaccatttacttgttgttacttcayccacttgaatttctattgttagga

SEQ ID NO: 102588 - DNA, 50 bp, homo sapien
aggaagaatttgccatttgttgagcrttggcaataagtcagaagttgtgc

SEQ ID NO: 102589 - DNA, 50 bp, homo sapien
attactatattatgctagatacttcmcagattttttttcttttatcactc

SEQ ID NO: 102590 - DNA, 50 bp, homo sapien
gtctttgatgtcaggtatgggaataragatgactacccctctttcacttc

SEQ ID NO: 102591 - DNA, 50 bp, homo sapien
gggttcaagcaggtgggcagtagtcrtattaaaagtgtctgaagcctgaa

SEQ ID NO: 102592 - DNA, 50 bp, homo sapien
aagtcacactcttctgagaatacttsaaaatggcaatcaaacaacgctca

SEQ ID NO: 102593 - DNA, 50 bp, homo sapien
gcattgttttacaggaatattctcayatcttaggagatctttcacatctc

SEQ ID NO: 102594 - DNA, 50 bp, homo sapien
gggtagggaggaaacagaggataaayaggacagtgataaatagaaatcca

SEQ ID NO: 102595 - DNA, 50 bp, homo sapien
tgaacaaatcacactgggttttctcrattattcagggaatagggtgttat

SEQ ID NO: 102596 - DNA, 50 bp, homo sapien
gaaagaatacatgggcacctgtcaawttctcagtcagtagctcagaatca

SEQ ID NO: 102597 - DNA, 50 bp, homo sapien
atcagaggctatagctggctgtctamagatatgttgaatttaatcctcag

SEQ ID NO: 102598 - DNA, 50 bp, homo sapien
cagccagctatagcctctgatctaaytgatttttaacaagtgctgtaatc

SEQ ID NO: 102599 - DNA, 50 bp, homo sapien
ttgcaacacccaaatagaagttggasagacacgaaatcaagagttgaagt

SEQ ID NO: 102600 - DNA, 50 bp, homo sapien
atacagcctccttcggagaaccaccratgcacaggatggtgaaaaagact

SEQ ID NO: 102601 - DNA, 50 bp, homo sapien
aatgcactgcacccagatcttcacckgactggcttcctcttttcattcag

SEQ ID NO: 102602 - DNA, 50 bp, homo sapien
tagagaaatttataatcataacaagmcattgcatttgatcctttaaacca

SEQ ID NO: 102603 - DNA, 50 bp, homo sapien
attggggaaaaaatgcttccaatatytctagtacatgatattgtgtttta

SEQ ID NO: 102604 - DNA, 50 bp, homo sapien
atggggattttttcttcttacttcaytgagttgatataaaaataataaaa

SEQ ID NO: 102605 - DNA, 50 bp, homo sapien
atctaggctctattctgtcctattgratgtactgtttatccctttgccaa

SEQ ID NO: 102606 - DNA, 50 bp, homo sapien
gacctgttccaatgttaactctatarccacagtaaatttacaaacataat

SEQ ID NO: 102607 - DNA, 50 bp, homo sapien
agtttttaggtaatggcaatgcaatkattacatctcaattgtttgaaaaa

SEQ ID NO: 102608 - DNA, 50 bp, homo sapien
tggatttgaacactcgctaagcttcrcatacgtaaataaaacaatcttcc

SEQ ID NO: 102609 - DNA, 50 bp, homo sapien
ttctctaacaaaaaccaacagttaartaatagcagaaataaaaattttta

SEQ ID NO: 102610 - DNA, 50 bp, homo sapien
acaaaggactattaaatttgtctacrgcgtactacttggaacactgaccc

SEQ ID NO: 102611 - DNA, 50 bp, homo sapien
aatggattccagtttttaaaatgacrataaaccacatcatttaactaaat

SEQ ID NO: 102612 - DNA, 50 bp, homo sapien
tttgtttctcacttgactgtcaaatyacttacaatctgacttctccctac

SEQ ID NO: 102613 - DNA, 50 bp, homo sapien
ttaaaggcatcacaaggtattatagraagaggacaggatgatatgactct

SEQ ID NO: 102614 - DNA, 50 bp, homo sapien
tctgtgcatagactggtatgcagacracattcgaatttttgtgaatgaaa

SEQ ID NO: 102615 - DNA, 50 bp, homo sapien
cccttgatgctgggttctgggttaayaattcagtacatttatgccttcgt

SEQ ID NO: 102616 - DNA, 50 bp, homo sapien
aaaatatactctggattagaatcacygacgaaggcataaatgtactgaat

SEQ ID NO: 102617 - DNA, 50 bp, homo sapien
tttataaaaaaatataatctatcgcrataccctttttatataggggaaac

SEQ ID NO: 102618 - DNA, 50 bp, homo sapien
tgtatctttctctagtgcctacacaygccttttgagaaacacttgaataa

SEQ ID NO: 102619 - DNA, 50 bp, homo sapien
atacaggcgtgggtgttatacaacaragtcctagccttagtttttgaaaa

SEQ ID NO: 102620 - DNA, 50 bp, homo sapien
tgaggtttcaacaaatacaccagaaycaaaaaatgttacctttcaaatct

SEQ ID NO: 102621 - DNA, 50 bp, homo sapien
ctctgcatcccaaattctgaaaggaraataccagaaggtgctgctgtttt

SEQ ID NO: 102622 - DNA, 50 bp, homo sapien
catctgtgcagaggtaagggcttgamggatgtatgaagggcaaaggagaa

SEQ ID NO: 102623 - DNA, 50 bp, homo sapien
taaaaaccaaattcaacctcgagacsgaagtccatcattcatagtccaca

SEQ ID NO: 102624 - DNA, 50 bp, homo sapien
agtcatgtgattgttttccacagaakaaggaaaaaactgaagagggcaga

SEQ ID NO: 102625 - DNA, 50 bp, homo sapien
gcattatgaggtcaataaaagattgwaggtaagatatctggaaagtaatt

SEQ ID NO: 102626 - DNA, 50 bp, homo sapien
gagatcagaatagctacatcttctayctttctttatcctccctctgacaa

SEQ ID NO: 102627 - DNA, 50 bp, homo sapien
aattcagagccctgtaaggttgcaayagaagattgaaaaagcctttgaaa

SEQ ID NO: 102628 - DNA, 50 bp, homo sapien
aaatattaatcactgtgggtatgaaratatgggagcagtaacagcaatga

SEQ ID NO: 102629 - DNA, 50 bp, homo sapien
atgctctgacatgaaatttaaatgayctgcaaaaagttaatttgtctcag

SEQ ID NO: 102630 - DNA, 50 bp, homo sapien
caaatccaatcttttcccttgtttcragaatttgtaataggtcatggttt

SEQ ID NO: 102631 - DNA, 50 bp, homo sapien
gaggattgactgcaatcgtttgaaakgacagagctccacaacacattttc

SEQ ID NO: 102632 - DNA, 50 bp, homo sapien
aggacagagggtgcgcgtttggatayctttggcagaattttcaggttttc

SEQ ID NO: 102633 - DNA, 50 bp, homo sapien
tgtggctgcaaaaggaaactcaattygtgctcagcatgcgagtttaatgc

SEQ ID NO: 102634 - DNA, 50 bp, homo sapien
accaggagctttttctgacttcgtaygactaaaaagtcccaaagtgggca

SEQ ID NO: 102635 - DNA, 50 bp, homo sapien
cacacacagacatgcataattcccayagtagaataaacattttaaattat

SEQ ID NO: 102636 - DNA, 50 bp, homo sapien
atctcagtgtaatttccttagcttargaagatgcgtggtatgtgtctgtg

SEQ ID NO: 102637 - DNA, 50 bp, homo sapien
ccatcaagtatgcaaaatagtgagcracttgattcactgttttgcaccca

SEQ ID NO: 102638 - DNA, 50 bp, homo sapien
aacttaggtggtaagacagtttctaytacaaccctgctattgtcaggaaa

SEQ ID NO: 102639 - DNA, 50 bp, homo sapien
cattaaggttgctgattagaaaatamatagttcaggcaatatttctattt

SEQ ID NO: 102640 - DNA, 50 bp, homo sapien
cctttactgtccgccatcactagccyatatcactcctcactgccttctca

SEQ ID NO: 102641 - DNA, 50 bp, homo sapien
tacaacttctgttgaaaacaccctaycttggatcaccaaagtgtcccctt

SEQ ID NO: 102642 - DNA, 50 bp, homo sapien
ttgcagagctacattaaatagtccarccctgtatttcaaaaatggatggt

SEQ ID NO: 102643 - DNA, 50 bp, homo sapien
actcccagacccaccaatgaagtcartaccaatagtcatccgtgtacttg

SEQ ID NO: 102644 - DNA, 50 bp, homo sapien
gtagggaagatagcttggcttgaacmaactttctagtactccaccaagac

SEQ ID NO: 102645 - DNA, 50 bp, homo sapien
catacgttcagtggatacaatattayaaatagtcatacaacaattctgtt

SEQ ID NO: 102646 - DNA, 50 bp, homo sapien
ctttgtctctgcctagaaatctggarcataagatatataggtgaagaact

SEQ ID NO: 102647 - DNA, 50 bp, homo sapien
atgaggcataaaatagaaagaagaargtatagctggacttgtaggaagac

SEQ ID NO: 102648 - DNA, 50 bp, homo sapien
agaaaagtcggtttaaggagattcastcagattagacattatcatttaag

SEQ ID NO: 102649 - DNA, 50 bp, homo sapien
ccaaaatctataaacaggtaacagayatacagaaattttgcagtttcttt

SEQ ID NO: 102650 - DNA, 50 bp, homo sapien
gtatcaaaattgaccagaactgacakgaagttatttatagtctttattta

SEQ ID NO: 102651 - DNA, 50 bp, homo sapien
attgaacagatgatttgagataatayaagcaatctaatgattatgacaag

SEQ ID NO: 102652 - DNA, 50 bp, homo sapien
ttatacaattttatagatgagaacasggaagtacagaaaatcaaatagct

SEQ ID NO: 102653 - DNA, 50 bp, homo sapien
gactgattctagatatggaccagaawaagtatatgatgaggctaaatcat

SEQ ID NO: 102654 - DNA, 50 bp, homo sapien
acttcagaaaattcagaattacggtkttgttagaagagatgaaaatcaag

SEQ ID NO: 102655 - DNA, 50 bp, homo sapien
agttttactttttattggcaaaagcmattcacagaagagggtgatgtgct

SEQ ID NO: 102656 - DNA, 50 bp, homo sapien
gctttatcttaacatgtgtggggcamgattaaaggactcctaagcagata

SEQ ID NO: 102657 - DNA, 50 bp, homo sapien
ttgattttaactatctcatatttgtwaacagcatcatttccatggatagc

SEQ ID NO: 102658 - DNA, 50 bp, homo sapien
aaaagaaaagaaaaaggatgaataayaagaaagaaaaacagccttattgc

SEQ ID NO: 102659 - DNA, 50 bp, homo sapien
ttctaggttccaaaaagaagggtaaygccactacagcacctttgccatct

SEQ ID NO: 102660 - DNA, 50 bp, homo sapien
gtagacaagtaaacagagttgaattwaagatgtagtattcaaaaatgcat

SEQ ID NO: 102661 - DNA, 50 bp, homo sapien
tctagtttaattccccctctacacamatgatgaaagtgaggttcagaaat

SEQ ID NO: 102662 - DNA, 50 bp, homo sapien
gccttataaaatcaccatcatgttaraccaaatcagaggggaccgctttt

SEQ ID NO: 102663 - DNA, 50 bp, homo sapien
tccttccattatgcagattcatacarcattattttctttccctgagagat

SEQ ID NO: 102664 - DNA, 50 bp, homo sapien
ggagaagtgatgatggcaaagttctyaattatgttgataaataatccatc

SEQ ID NO: 102665 - DNA, 50 bp, homo sapien
cggatctgcttcctcagcaagtttgwactggcctgaactccattagcact

SEQ ID NO: 102666 - DNA, 50 bp, homo sapien
acttaatactgtgtcttctaaaaagycttctaagatttgtgttttcctcc

SEQ ID NO: 102667 - DNA, 50 bp, homo sapien
gatctgcagtataataatattcttcycatcttataacttcattttacttt

SEQ ID NO: 102668 - DNA, 50 bp, homo sapien
gcagaaattacataggtaaaggggaygcgtttgacaaatgggtgcgccca

SEQ ID NO: 102669 - DNA, 50 bp, homo sapien
acctagcaaggactctaggctctaarcaaataataagctgcccactttga

SEQ ID NO: 102670 - DNA, 50 bp, homo sapien
aaagaaagtcaaaattctaaaatatwagagtgcagttgtcattaagatgt

SEQ ID NO: 102671 - DNA, 50 bp, homo sapien
attaaaagaactatgtgagtacaaakcatgtatatacagcagtatctctg

SEQ ID NO: 102672 - DNA, 50 bp, homo sapien
aaaatgatcagaaagaatgacagtgsagaaatacttcttacatgaattgc

SEQ ID NO: 102673 - DNA, 50 bp, homo sapien
aaatatggcaaagacgtgtctttgartacatttaaggactctccacacag

SEQ ID NO: 102674 - DNA, 50 bp, homo sapien
aattttcatattaatgatgagctaasaaggcatcaatattttaaaacaaa

SEQ ID NO: 102675 - DNA, 50 bp, homo sapien
gtggtaatagtttaacatttagtaaytgattatataaaattatgttctca

SEQ ID NO: 102676 - DNA, 50 bp, homo sapien
tggagtttccacctgaaagagctaakagttacctcaaattcattctgttg

SEQ ID NO: 102677 - DNA, 50 bp, homo sapien
accaaaggctctttagatgtctctaygaaagaaaaatatgattagcacaa

SEQ ID NO: 102678 - DNA, 50 bp, homo sapien
acgcctgctcagagactaaagtgcaycttacaacaaccaggaatcatggc

SEQ ID NO: 102679 - DNA, 50 bp, homo sapien
ttggttatgaatacatggacttcagrcattgatcctatttaattatattt

SEQ ID NO: 102680 - DNA, 50 bp, homo sapien
aacaagagaactagaattagaagaarggcctaaagatgcgattgaactgc

SEQ ID NO: 102681 - DNA, 50 bp, homo sapien
taatggaattaagaaccatattatamactgtgattatagcatacactgaa

SEQ ID NO: 102682 - DNA, 50 bp, homo sapien
tctcgatatataatatgggtatcaaygacaaacatcagagacactgaaaa

SEQ ID NO: 102683 - DNA, 50 bp, homo sapien
ggctgtaggacacctagttaggagamtactgcaaaaataaatattaaaaa

SEQ ID NO: 102684 - DNA, 50 bp, homo sapien
gctctcacatacaagtctacctgagrattcaaatgatggagtaaaataca

SEQ ID NO: 102685 - DNA, 50 bp, homo sapien
caaaaatccacacatatggaagatartaagagttgtttcttcctctagtg

SEQ ID NO: 102686 - DNA, 50 bp, homo sapien
aaaacatatatcaattataaaatgamcaaatccttaaaaaataactcata

SEQ ID NO: 102687 - DNA, 50 bp, homo sapien
agacatttgagtaaactagtacaacraattcagtacaaacaactggagta

SEQ ID NO: 102688 - DNA, 50 bp, homo sapien
atctggagaaaagtggagaaatgagraatagccatgtaacaatgataatc

SEQ ID NO: 102689 - DNA, 50 bp, homo sapien
aaaggttctttttgagaagatgcaaytcattcaaaagtttatttaaataa

SEQ ID NO: 102690 - DNA, 50 bp, homo sapien
atgtttatcttattttcttgcattaygacattaacagagagaagaataat

SEQ ID NO: 102691 - DNA, 50 bp, homo sapien
tgatttataaaaattttaataaaaakcattggtattcctattattgaatt

SEQ ID NO: 102692 - DNA, 50 bp, homo sapien
aagttaaatatataacattaaaaatragttcacaaatatgcgtaatctgt

SEQ ID NO: 102693 - DNA, 50 bp, homo sapien
ctttagattgatgtgttaggaaagakaatctgccaatgtttttatttgat

SEQ ID NO: 102694 - DNA, 50 bp, homo sapien
agaaatacttgcctgtgatatgaacygcataaaatgaattgttttgatct

SEQ ID NO: 102695 - DNA, 50 bp, homo sapien
agaataattgcctcattaaccttacwatatcaactccacctcattgtgaa

SEQ ID NO: 102696 - DNA, 50 bp, homo sapien
tgaaattgattggaaagccaatagayagacttaaggttcagcaaaaagaa

SEQ ID NO: 102697 - DNA, 50 bp, homo sapien
aaccaatgccttctattaaaagcttraacaattcagaatcctgcaaaaca

SEQ ID NO: 102698 - DNA, 50 bp, homo sapien
gctgcctgttttcattcataagttgkagttaaacattgagtacctatgga

SEQ ID NO: 102699 - DNA, 50 bp, homo sapien
aaaccaaagcacactacacaaccaaygctatagatacttttacaggaaaa

SEQ ID NO: 102700 - DNA, 50 bp, homo sapien
cttgatattaggcagaactcttacayggacaaagaatagaaactaaattc

SEQ ID NO: 102701 - DNA, 50 bp, homo sapien
tggagctttaggaagcttaatagaakaatttgatagacacataagtggat

SEQ ID NO: 102702 - DNA, 50 bp, homo sapien
tgaattttatttttatcagaaaagamatgagttgtttttgttttactgtt

SEQ ID NO: 102703 - DNA, 50 bp, homo sapien
tagagatcattgtatttgaacatgartaatcttagaacattttaaaggaa

SEQ ID NO: 102704 - DNA, 50 bp, homo sapien
aatataagttctctattatgaattcwattaaaattttgaaaggcaagtac

SEQ ID NO: 102705 - DNA, 50 bp, homo sapien
gatataaaatgaacgttgaggatgargtagaatcaatgatgactcctgct

SEQ ID NO: 102706 - DNA, 50 bp, homo sapien
gcagagtgatgttactaattttttaygacttgtttatcctctatttcctt

SEQ ID NO: 102707 - DNA, 50 bp, homo sapien
gaagtacagctaattttgtgactatyagaattaacttaaatctgtttaaa

SEQ ID NO: 102708 - DNA, 50 bp, homo sapien
tgttgataacaaaaaaggacaatgckgatagttcttacttgatcttactt

SEQ ID NO: 102709 - DNA, 50 bp, homo sapien
cccagtgtttccatgtttatgtccaygtgagcttagtgtttagctcccaa

SEQ ID NO: 102710 - DNA, 50 bp, homo sapien
aatatagcctttacaatatccaaaakaatcttatcaaatcagtgtgtatt

SEQ ID NO: 102711 - DNA, 50 bp, homo sapien
attttgcaaagaaaaatggaatatayggtataatctctcgccttctctct

SEQ ID NO: 102712 - DNA, 50 bp, homo sapien
aagcatgtgatggataactgcagtamcttataatcaactattttgaaaat

SEQ ID NO: 102713 - DNA, 50 bp, homo sapien
aagtttttgttggttttataataaamtacatcaagagcttatagtgatac

SEQ ID NO: 102714 - DNA, 50 bp, homo sapien
aatgaaaagccaccctaaaagagtgmaataggctaaaaagtgatgttatt

SEQ ID NO: 102715 - DNA, 50 bp, homo sapien
taaaaagcagatacctgaaaagcaartaataggctacaaaacatgaggta

SEQ ID NO: 102716 - DNA, 50 bp, homo sapien
taaggttattaccaaacacaaacaaytcttatcctgacccctaagaaaaa

SEQ ID NO: 102717 - DNA, 50 bp, homo sapien
aagaagacgtagaaattatgaatagyccaaaaatcattaaagaaatttct

SEQ ID NO: 102718 - DNA, 50 bp, homo sapien
acttactgaaattaactcaagaagaygtagaaattatgaatagcccaaaa

SEQ ID NO: 102719 - DNA, 50 bp, homo sapien
ttatgttaaacttggttggatttgayttcttcttatgaggttatccttcc

SEQ ID NO: 102720 - DNA, 50 bp, homo sapien
aattttacttgttttgcacgtttacwatatctatttaaaattgactatat

SEQ ID NO: 102721 - DNA, 50 bp, homo sapien
cctaaattgtactgattacctgtctkggatttcttgacaattcctcttga

SEQ ID NO: 102722 - DNA, 50 bp, homo sapien
ttacttgaccaagagatcagtgtaasagcagtgcatattaccatattaat

SEQ ID NO: 102723 - DNA, 50 bp, homo sapien
attttatttgagttttatttatgacraaatgttactatccttaatatatg

SEQ ID NO: 102724 - DNA, 50 bp, homo sapien
aaaaggtttagtaactactcaatatraatttgcctgttactaaaatattt

SEQ ID NO: 102725 - DNA, 50 bp, homo sapien
acaggtctgtcttcaaagctaacagyatgtaaagatgtaaaaggcagagt

SEQ ID NO: 102726 - DNA, 50 bp, homo sapien
cttaagagacctactgaaattatgaraaatctctgtgtaatttctagaag

SEQ ID NO: 102727 - DNA, 50 bp, homo sapien
tgcagaaacttagaaaacagaaaaaygattagaatgccaccttctagaaa

SEQ ID NO: 102728 - DNA, 50 bp, homo sapien
tgtacaaatgtgccatttttagtacratagtatccagccttatcagattc

SEQ ID NO: 102729 - DNA, 50 bp, homo sapien
agactcagcgagcactttacataggraactttcattatgaggtgagttga

SEQ ID NO: 102730 - DNA, 50 bp, homo sapien
ctcctttcccctgcattgaggtagcyctttaaattacaagattttagaca

SEQ ID NO: 102731 - DNA, 50 bp, homo sapien
tctcagaacttctagtgctgaattayaatggaatatgaatttaaaatgtc

SEQ ID NO: 102732 - DNA, 50 bp, homo sapien
attgtcggtgactgatggatgttcckatttcacagttttagtaaagaaaa

SEQ ID NO: 102733 - DNA, 50 bp, homo sapien
tttttattttcagacactggttttgygggagcaggatttatatctgattc

SEQ ID NO: 102734 - DNA, 50 bp, homo sapien
tcgctttaatgaagtgtgtgctaccyggagtttttccttcactaacagag

SEQ ID NO: 102735 - DNA, 50 bp, homo sapien
attgtttcctgatgtttctgccacartagttttcagggtcatctacaatt

SEQ ID NO: 102736 - DNA, 50 bp, homo sapien
aataggaactactctgtagcatgtaygaagcatagcatattacatattag

SEQ ID NO: 102737 - DNA, 50 bp, homo sapien
ttgaaattattgatctagtcacaaamggtcaattctgtgaatacagaagt

SEQ ID NO: 102738 - DNA, 50 bp, homo sapien
ataataatatgccttctcatcagaamataagcttcaagagattgttcact

SEQ ID NO: 102739 - DNA, 50 bp, homo sapien
aaaaaaatagaaaaaaagttggacckcctaaagcctggtatagaaaaagt

SEQ ID NO: 102740 - DNA, 50 bp, homo sapien
ttaatatatcacatgtccatttatayacttttatggttagtaaattttac

SEQ ID NO: 102741 - DNA, 50 bp, homo sapien
tagttcaagtttattttgttgcatamgttgttgggctaattgtgaaacat

SEQ ID NO: 102742 - DNA, 50 bp, homo sapien
tttaccatgaattaaaatgaagaaargtagattagcctgaattcaggatg

SEQ ID NO: 102743 - DNA, 50 bp, homo sapien
tatgtagtacaggctgatgaaattayatttaatgattgtattttctatgc

SEQ ID NO: 102744 - DNA, 50 bp, homo sapien
ttcagttgaattagatagcttcttaygatccactgctaatacattttaaa

SEQ ID NO: 102745 - DNA, 50 bp, homo sapien
tattcttatgattcagatcttaactyagtgacgcctcttttcagaggact

SEQ ID NO: 102746 - DNA, 50 bp, homo sapien
aattctcaaatgccatagcttattarcacttttaaaagagatttatcttt

SEQ ID NO: 102747 - DNA, 50 bp, homo sapien
tgatgtcaaagcattgaatcataccraggaaaatggtagtgctgaggata

SEQ ID NO: 102748 - DNA, 50 bp, homo sapien
aatgatgtaaacaaaaagtaatacasagaagacctgtcaaatggtatttc

SEQ ID NO: 102749 - DNA, 50 bp, homo sapien
aatcaataaaaattagttcaaaaatragaaggttggattgaaggtgcaaa

SEQ ID NO: 102750 - DNA, 50 bp, homo sapien
catatgtggaaatagcactagcttaygagtttatagaagtttatattttt

SEQ ID NO: 102751 - DNA, 50 bp, homo sapien
caaaaactgacatgttcctggaagaygccaatggtactgctataattatt

SEQ ID NO: 102752 - DNA, 50 bp, homo sapien
gtgagtcatttcctttgaggaataaygctacatgtaagaaatgtgagaaa

SEQ ID NO: 102753 - DNA, 50 bp, homo sapien
actgactgtttcagtcaaggcacaaycagggaaagaaagtgttgcaatta

SEQ ID NO: 102754 - DNA, 50 bp, homo sapien
atattattgatgtcttctcccatatsactggttaataggcatgtttagct

SEQ ID NO: 102755 - DNA, 50 bp, homo sapien
tattctgacatactggctcttaaacmactcagctagtggcttaagttctc

SEQ ID NO: 102756 - DNA, 50 bp, homo sapien
ggcttcctagcactagcacttcttakatgcccaataaataatacattaat

SEQ ID NO: 102757 - DNA, 50 bp, homo sapien
aggaagactagtcacagaagtatcaraagaagttttgcgggccgtgcacg

SEQ ID NO: 102758 - DNA, 50 bp, homo sapien
ttatctttgattcctacatctagcayagtgcttaaaacatggttatactc

SEQ ID NO: 102759 - DNA, 50 bp, homo sapien
taatgattaaagaataacactgagamaagactaccagattttaaagatgt

SEQ ID NO: 102760 - DNA, 50 bp, homo sapien
tgcatttccagcacttgacctcacckattgctttataaaaagatctcatt

SEQ ID NO: 102761 - DNA, 50 bp, homo sapien
agacaagtataaaacaaataaacaamtacaagacataggaaactcttcat

SEQ ID NO: 102762 - DNA, 50 bp, homo sapien
ggtcctataccaattcatggctctamcaatctttctaagggtttgactcc

SEQ ID NO: 102763 - DNA, 50 bp, homo sapien
aaggtttatctttaatatctgctagyattatctggaatgctaaacagtac

SEQ ID NO: 102764 - DNA, 50 bp, homo sapien
gtattttcacagtccgtagattctargttttattatttcatttagagtgt

SEQ ID NO: 102765 - DNA, 50 bp, homo sapien
catagggttcttctgaacctgaaccrcaacaattctaggaggtctgcttg

SEQ ID NO: 102766 - DNA, 50 bp, homo sapien
accttcccagtaccatgactatagaytcctcaaccatctcttcctggccc

SEQ ID NO: 102767 - DNA, 50 bp, homo sapien
tagggacttgggtacattttactcaygttttcaagtacaggtctttccac

SEQ ID NO: 102768 - DNA, 50 bp, homo sapien
gccttgataatgagtacttctttgtraagccaaattaattttctcattgg

SEQ ID NO: 102769 - DNA, 50 bp, homo sapien
tataatgtaggctctttaaacctaawtcctgcattgaattgtgttggtag

SEQ ID NO: 102770 - DNA, 50 bp, homo sapien
ctattttagaggttaaatatggaccyagagaccacatcctgcagatcagc

SEQ ID NO: 102771 - DNA, 50 bp, homo sapien
aaacaatataataacataaaatctcmatgaaaaatgaaaataaatgggaa

SEQ ID NO: 102772 - DNA, 50 bp, homo sapien
agcaacacttttgttgtatccaaaargttttgacaggctgcgtcactatt

SEQ ID NO: 102773 - DNA, 50 bp, homo sapien
gatatataattcacatactgtaaaaytgaccattctaaagtcaacaattc

SEQ ID NO: 102774 - DNA, 50 bp, homo sapien
taataaagtgaactgggcttaatgcmagggtagcaagtttatctaaataa

SEQ ID NO: 102775 - DNA, 50 bp, homo sapien
ccttccagttctataattatagaaaygaatccacataggtattgagataa

SEQ ID NO: 102776 - DNA, 50 bp, homo sapien
acaggactgtaatgcagaggtttggytacacagatgatggagaagccaaa

SEQ ID NO: 102777 - DNA, 50 bp, homo sapien
aaatttgtttcagtatgttagaaccraagtgctaagttaatgtgtcagaa

SEQ ID NO: 102778 - DNA, 50 bp, homo sapien
tacatattaaaagatgatttaccacrcaagagaatatacccaaagcatta

SEQ ID NO: 102779 - DNA, 50 bp, homo sapien
ctaggctctgtttgtcagtatcagckcttaaaatgacaaccaaatcctgc

SEQ ID NO: 102780 - DNA, 50 bp, homo sapien
acagtttgctttcttaaactcagaayattacaccccttccacagtttagc

SEQ ID NO: 102781 - DNA, 50 bp, homo sapien
acatcattactcttagaaagccaacratcatagacagttttttctaacag

SEQ ID NO: 102782 - DNA, 50 bp, homo sapien
atccccatagttcctacaaacatatsatacttatacaggtcttgattaaa

SEQ ID NO: 102783 - DNA, 50 bp, homo sapien
ttgatcctgtggggccttgacaaagyattgattgttccttcaaccttcag

SEQ ID NO: 102784 - DNA, 50 bp, homo sapien
aagcaaatgatccttctaatactgayacattaaactgatacttaaaagat

SEQ ID NO: 102785 - DNA, 50 bp, homo sapien
tcctaggagtatggaatcaccataaytgaatatataaatctgaacagatc

SEQ ID NO: 102786 - DNA, 50 bp, homo sapien
cccacattgttcaaatgcaatttaasatgttacctaccaataaatattaa

SEQ ID NO: 102787 - DNA, 50 bp, homo sapien
cagaaaaaggtttctcattgtccagrccttcatgttttacaaccaaaaaa

SEQ ID NO: 102788 - DNA, 50 bp, homo sapien
tttttttctttcttttatttttgtcmatcctctaaagaattctcagaagc

SEQ ID NO: 102789 - DNA, 50 bp, homo sapien
attgtctgctttcagatatttatgargtttgagatatttataagaaaatt

SEQ ID NO: 102790 - DNA, 50 bp, homo sapien
taaaacaaccgtgaagtgatttcacraatgggtgtaatatgtttctgcca

SEQ ID NO: 102791 - DNA, 50 bp, homo sapien
tttttgaatctattagatcctaaaamggtttatatgtatcctcccataaa

SEQ ID NO: 102792 - DNA, 50 bp, homo sapien
ctaggacagaaataacgtaagtccaycataaagtaactcctagttaaagt

SEQ ID NO: 102793 - DNA, 50 bp, homo sapien
tcctttatctccttttctgttacaawctcttattacatagtctcctttat

SEQ ID NO: 102794 - DNA, 50 bp, homo sapien
tttcaaaagcatcagctgtgtaataygttcatggaggagcaaatgttcaa

SEQ ID NO: 102795 - DNA, 50 bp, homo sapien
aataaatggcaatgcaataataacargggactttgatattccactgacag

SEQ ID NO: 102796 - DNA, 50 bp, homo sapien
cagaatacttgtggttgttttgcaaytgttttttatacaacttaactgtt

SEQ ID NO: 102797 - DNA, 50 bp, homo sapien
ttgtgatcttttcctgttgaactaawccttttatcattatataatgtccc

SEQ ID NO: 102798 - DNA, 50 bp, homo sapien
cgacatggaatcatacttaaacgaaytgcctagagtacagtgcattttac

SEQ ID NO: 102799 - DNA, 50 bp, homo sapien
aaaattacagcaaattcttgacctcraaaccaagtctttgctagacatta

SEQ ID NO: 102800 - DNA, 50 bp, homo sapien
ataactgcaacaagaataaaagaccyacaatccaattaaaaatttttctc

SEQ ID NO: 102801 - DNA, 50 bp, homo sapien
tggtatgctatttctctgctttgaarttatttatccctctttgatgacag

SEQ ID NO: 102802 - DNA, 50 bp, homo sapien
taatcagtcataatatccacttcaaratggcggttaattttgatcttcta

SEQ ID NO: 102803 - DNA, 50 bp, homo sapien
gtactaaataaaaactgaagccataygttcagaagtgttcctgtatctga

SEQ ID NO: 102804 - DNA, 50 bp, homo sapien
gaaaaaggcacattttgctctcatcraaagctgtaagaatggatttcagt

SEQ ID NO: 102805 - DNA, 50 bp, homo sapien
acctctagcattagaccatatggaamtcaattaaacagagtattagtttg

SEQ ID NO: 102806 - DNA, 50 bp, homo sapien
gaatgtatattgtgttagtaggcatkacaacaacattaatatccccgcac

SEQ ID NO: 102807 - DNA, 50 bp, homo sapien
aataatttcaaatccatgtgcaactrtatctgcagaggaaaaaaaagcct

SEQ ID NO: 102808 - DNA, 50 bp, homo sapien
ctacaaattgttgttcgtgatatgartattgtttatcccaacaattcttg

SEQ ID NO: 102809 - DNA, 50 bp, homo sapien
ttttcaagttctctggcatttcttayaatagaatttgaactctatgaaca

SEQ ID NO: 102810 - DNA, 50 bp, homo sapien
tttgtaattttaggttatggtgtaaytgagtatgtaagcctaagaaatgt

SEQ ID NO: 102811 - DNA, 50 bp, homo sapien
taggcccacacaggacagcccagtarcatgatggagaacagaaatccttt

SEQ ID NO: 102812 - DNA, 50 bp, homo sapien
gctgtatggacaactcagaaagttcrcttgaatatctaattcaaactaca

SEQ ID NO: 102813 - DNA, 50 bp, homo sapien
caaccaatggccatagatatcaaaastgaatgtgtttagggaaggctgac

SEQ ID NO: 102814 - DNA, 50 bp, homo sapien
ttgactaaatggtcttagctgatacyaaattgaattcattcatgtgaact

SEQ ID NO: 102815 - DNA, 50 bp, homo sapien
aaactaatgcaataaatgatataacrcaccatataaccctccatgatgag

SEQ ID NO: 102816 - DNA, 50 bp, homo sapien
agcaacgatattcattaatactgaaygaaagaaggctaataaaccaaact

SEQ ID NO: 102817 - DNA, 50 bp, homo sapien
tgtatagacagagagagaatgaataygtgttaaattagtgttttttcaaa

SEQ ID NO: 102818 - DNA, 50 bp, homo sapien
caccatgacttgtcatttttcatgaygaactttgaggataagttaatttg

SEQ ID NO: 102819 - DNA, 50 bp, homo sapien
ccttcattcctcaaaccttttcttcmgacgtagaatgccagataccacca

SEQ ID NO: 102820 - DNA, 50 bp, homo sapien
caatatggtatattgaactctgatayaggatattttactatttaaatgaa

SEQ ID NO: 102821 - DNA, 50 bp, homo sapien
aattccatttgccaattttcagtgaygcttgatagatatatataagggta

SEQ ID NO: 102822 - DNA, 50 bp, homo sapien
tgtcaaggaggaaaaggacttgtaaycttgatgatatttattactcagtt

SEQ ID NO: 102823 - DNA, 50 bp, homo sapien
cacagctagtgacacaaaagatttaygatcctgttgtgctccaagcattt

SEQ ID NO: 102824 - DNA, 50 bp, homo sapien
cctgttcatttcagctatttgtttasattccacttgcatttcttcatcac

SEQ ID NO: 102825 - DNA, 50 bp, homo sapien
acataagtaactaacatgctttaaaygtatcataaaatctaaaacagtaa

SEQ ID NO: 102826 - DNA, 50 bp, homo sapien
aatacaatcatgggcaactttgatamaaatgcgttaacttaaatttcctc

SEQ ID NO: 102827 - DNA, 50 bp, homo sapien
tgtatttatagtatgaaattacacaraagtaaagcattagcagtctagta

SEQ ID NO: 102828 - DNA, 50 bp, homo sapien
cataaatatttgttgaattaatggaygattttaatattgatagtcaattg

SEQ ID NO: 102829 - DNA, 50 bp, homo sapien
taatatgaaatttatagagtatatartagccacatcataaatatttgttg

SEQ ID NO: 102830 - DNA, 50 bp, homo sapien
gaaaagacagactgggagaacttaarccttgatgagtgagagaaaatgtt

SEQ ID NO: 102831 - DNA, 50 bp, homo sapien
ctctaaagtaaatatctacatttaamctattatcttgagtatttttgtaa

SEQ ID NO: 102832 - DNA, 50 bp, homo sapien
attcttaaagagaactcgtatgatgratcagaaaaagaaagataggaaat

SEQ ID NO: 102833 - DNA, 50 bp, homo sapien
agagattttattgtatctcctcagamcaaatataaacaaaatctatgaaa

SEQ ID NO: 102834 - DNA, 50 bp, homo sapien
atgccctaaaatatattttgatataygtttacaagtcataaatatatgaa

SEQ ID NO: 102835 - DNA, 50 bp, homo sapien
ccaatatttaaaaaagtgagacttayatccaaataccttattgttactaa

SEQ ID NO: 102836 - DNA, 50 bp, homo sapien
tgcctagctgctaggtacctcaagaytaagatctctccttagtagttata

SEQ ID NO: 102837 - DNA, 50 bp, homo sapien
tcttatgatttgtagtatcatcaatraaacattctaatacatcagtgtag

SEQ ID NO: 102838 - DNA, 50 bp, homo sapien
gattgggtcctttcaggaaaacagaragcacattagatatttcaacagga

SEQ ID NO: 102839 - DNA, 50 bp, homo sapien
tcttctctacctcttttagctcttayatactcatttttttttttaattta

SEQ ID NO: 102840 - DNA, 50 bp, homo sapien
cttataataagaataatacactacarttgagcacatttgtcctcaccact

SEQ ID NO: 102841 - DNA, 50 bp, homo sapien
catttagattataagaatgatttcastccatggccatttaaagtggatcc

SEQ ID NO: 102842 - DNA, 50 bp, homo sapien
gctaatccagttaacacataaatgayatgaaagtgaaggccaggcatgct

SEQ ID NO: 102843 - DNA, 50 bp, homo sapien
atctttatagaaaggcacattaaacraaactgtcaattatgtgctaaagg

SEQ ID NO: 102844 - DNA, 50 bp, homo sapien
gttcacactaagcaaaggccaggaasactaatcataagaagacagcctag

SEQ ID NO: 102845 - DNA, 50 bp, homo sapien
aaatcaaacaacataaataaattcayaggcaatccagacactggagttaa

SEQ ID NO: 102846 - DNA, 50 bp, homo sapien
tgaagagagaagagtaagggactaarggtaccaacatatgctaagaaatt

SEQ ID NO: 102847 - DNA, 50 bp, homo sapien
agtggaagacacctaaagtccttacygggagcagatactagtaccatact

SEQ ID NO: 102848 - DNA, 50 bp, homo sapien
agaagcatttatttttgaccacttayagattgaattcatgcaccaaaaaa

SEQ ID NO: 102849 - DNA, 50 bp, homo sapien
ataaactacatgagaaaacactggamaataaatctgggtattggttactg

SEQ ID NO: 102850 - DNA, 50 bp, homo sapien
gatttccttaatataatcaaattacragactctgagattagcaataaaaa

SEQ ID NO: 102851 - DNA, 50 bp, homo sapien
tgttagataacactatacatggtacyatttcggctaaaaacacactaagt

SEQ ID NO: 102852 - DNA, 50 bp, homo sapien
tgcttcctttatgccattgtaaagargtagaatttaagtcaagaagggct

SEQ ID NO: 102853 - DNA, 50 bp, homo sapien
aattaaaatctatgtagatctacaaygttaactaagcgaatgtatattta

SEQ ID NO: 102854 - DNA, 50 bp, homo sapien
gaaaaaagaaaaaatcattacatgasctgaacatttattattaagactag

SEQ ID NO: 102855 - DNA, 50 bp, homo sapien
ggctggcacaggcaatgacacagacragtgagaatctgattataatgtat

SEQ ID NO: 102856 - DNA, 50 bp, homo sapien
tgattgataggagagacaaaaatcayggttccatcagctgcatttctagt

SEQ ID NO: 102857 - DNA, 50 bp, homo sapien
tgcctcctgtaaagtttttccggaartcaagccttctgtagtcagccagc

SEQ ID NO: 102858 - DNA, 50 bp, homo sapien
aagtggtcttctataattttcagtcraagagttttaaactacaacagtgc

SEQ ID NO: 102859 - DNA, 50 bp, homo sapien
gattacagcctaacactgcactaacmatggaaatcttatgcttaattcat

SEQ ID NO: 102860 - DNA, 50 bp, homo sapien
aatctagaccagcctatttctgagcractagctacttgcctatattttgg

SEQ ID NO: 102861 - DNA, 50 bp, homo sapien
ttatgtatcaaacacacaggtaagcraccacccatctctgtatttaacac

SEQ ID NO: 102862 - DNA, 50 bp, homo sapien
atagtactgtttaaagcaaatagtcrctacaatttaaacagtcttagact

SEQ ID NO: 102863 - DNA, 50 bp, homo sapien
agagcattttagacctcagaaaaaawtgttccctctgagagacatatgcc

SEQ ID NO: 102864 - DNA, 50 bp, homo sapien
aagagaaaccccgtcatttatcctcygaaatgttttatattttaggctgg

SEQ ID NO: 102865 - DNA, 50 bp, homo sapien
tgaaatgtgaaagtcttcaatcagaygtggtgacgataattatttctttt

SEQ ID NO: 102866 - DNA, 50 bp, homo sapien
acagtcgaaggtttgtagcactcaaktaaatactgaatcaaagcaatggt

SEQ ID NO: 102867 - DNA, 50 bp, homo sapien
atggaggagtaccaattatttatccmagattttctgaatatattttatct

SEQ ID NO: 102868 - DNA, 50 bp, homo sapien
agaacaaggccactaaatcaataaakagtagaaagatgttacaagaaata

SEQ ID NO: 102869 - DNA, 50 bp, homo sapien
cacttatgtgttggatactgtgctaratcttagggctaaaggtagaggac

SEQ ID NO: 102870 - DNA, 50 bp, homo sapien
tggcagttcccagccaggtgttcacrgtaggtcaccatggcttgaaaata

SEQ ID NO: 102871 - DNA, 50 bp, homo sapien
ctttttcaaactcattttctgatacracaatgaatttggctacagcaaca

SEQ ID NO: 102872 - DNA, 50 bp, homo sapien
cagcatttctctccagcaatgtcctraaagtatcttcctttgctctctgc

SEQ ID NO: 102873 - DNA, 50 bp, homo sapien
tattatttgatccatacacaaaaaartgagaataacatgttatattattt

SEQ ID NO: 102874 - DNA, 50 bp, homo sapien
aagcagacagcagacaaaagatgaamgatcaaacactagaggaaagctag

SEQ ID NO: 102875 - DNA, 50 bp, homo sapien
tccccagtgtgggtaggcctcattcrataagtttaagatttcaatacaac

SEQ ID NO: 102876 - DNA, 50 bp, homo sapien
tttagtagagagaacagaataaataracactcagaacctaaaaacagcat

SEQ ID NO: 102877 - DNA, 50 bp, homo sapien
tggataatcgagtaatatggtttagyaatggtaataatgtctatagcatg

SEQ ID NO: 102878 - DNA, 50 bp, homo sapien
caaatccagtgaggctgagtgaacastgatttttatcaatgcattctatg

SEQ ID NO: 102879 - DNA, 50 bp, homo sapien
aactttactaatacgttagaatcacrcagtcaggaatccagacaaaatag

SEQ ID NO: 102880 - DNA, 50 bp, homo sapien
cttgacaggcagaatggaggtttaaytaaataacactttcacaaccagac

SEQ ID NO: 102881 - DNA, 50 bp, homo sapien
tggcttctaggaagagtataaagttycttcttctcccttctgttattcat

SEQ ID NO: 102882 - DNA, 50 bp, homo sapien
agttacataaaacatcaacaattagratatttgaaactttataataacag

SEQ ID NO: 102883 - DNA, 50 bp, homo sapien
cattttaaaattgttaatttatctcmaaataagcatttgaagaaaataac

SEQ ID NO: 102884 - DNA, 50 bp, homo sapien
caacaatgtgttacatttgacaaaamgtgtttagagtaagaaagactaac

SEQ ID NO: 102885 - DNA, 50 bp, homo sapien
tcaccctgcgatgcccagtcaattcmatgaatgaagtcacaggtggtgat

SEQ ID NO: 102886 - DNA, 50 bp, homo sapien
ccacagtgctcacatggaaactttcrctattctaaccatactcaaagcct

SEQ ID NO: 102887 - DNA, 50 bp, homo sapien
acttctccaaaatgataaagcaccamctaaatttcattaaaagaactgat

SEQ ID NO: 102888 - DNA, 50 bp, homo sapien
tagagacattatgtgtcccaatacartctggtttaaagaatttaggtaat

SEQ ID NO: 102889 - DNA, 50 bp, homo sapien
ggaaactaacaaatgtacagaacggraaagtgtgcatattttattataat

SEQ ID NO: 102890 - DNA, 50 bp, homo sapien
acctgatgtgtggctataaattaaartacatccttgagaaattttagagc

SEQ ID NO: 102891 - DNA, 50 bp, homo sapien
ctagtattttgataatgtaaaggtcyagtattttcagtattttcagtgtg

SEQ ID NO: 102892 - DNA, 50 bp, homo sapien
attttgataatgactaatgcagaagrattgaccctaccagatggtgaaac

SEQ ID NO: 102893 - DNA, 50 bp, homo sapien
ttcatccatatacatctacctttgaycttcttgatactggattttccatt

SEQ ID NO: 102894 - DNA, 50 bp, homo sapien
ttagtcagtttgctgcagtattcggsattagtccaggggaatttaagtca

SEQ ID NO: 102895 - DNA, 50 bp, homo sapien
ggtgaaaggtttaggagtggacttayagcgcaatcgacttaatgagacaa

SEQ ID NO: 102896 - DNA, 50 bp, homo sapien
ctagatgaagcattcagtagaatcartcctgtcaaaagctgatcaaatga

SEQ ID NO: 102897 - DNA, 50 bp, homo sapien
tgatatgagccacttaatcttaaccwacttaaatatatcagtataaaatg

SEQ ID NO: 102898 - DNA, 50 bp, homo sapien
tgtgaaaagaagtagagatcaattayacatttgaaacctgaattcttaaa

SEQ ID NO: 102899 - DNA, 50 bp, homo sapien
atttccaagaacgggcattgatacasgttgctagaaaataataggaagga

SEQ ID NO: 102900 - DNA, 50 bp, homo sapien
ctgacaattcagtattagtagatgcsaggcctgctacccttattcttgct

SEQ ID NO: 102901 - DNA, 50 bp, homo sapien
aagtacgcccttatttattttccacrtaaatccatcaaactcttacagtt

SEQ ID NO: 102902 - DNA, 50 bp, homo sapien
atgtttgatacatagcaggtactaaytattgaaagaaaaaaattaatgat

SEQ ID NO: 102903 - DNA, 50 bp, homo sapien
agagcgtcttagacaatgttacaatragagatgaaaagaccagtgaaatt

SEQ ID NO: 102904 - DNA, 50 bp, homo sapien
aaaaatataaacttgataggagatayattaaggttagataaatgtgctca

SEQ ID NO: 102905 - DNA, 50 bp, homo sapien
acaatgcatgtcatctagtacatgckcaatacattttatgccaaattttt

SEQ ID NO: 102906 - DNA, 50 bp, homo sapien
gagaagataattctcagtgaataggycaggtaggaaggagcccgttaaca

SEQ ID NO: 102907 - DNA, 50 bp, homo sapien
gtgtactcttcttagctaagccccartcatatccacaagaagcttctgaa

SEQ ID NO: 102908 - DNA, 50 bp, homo sapien
gaatgtatgcaaattctgagccataygctttaacagggaaaatgcctgcg

SEQ ID NO: 102909 - DNA, 50 bp, homo sapien
ttaatgaaacgattcaatgagcaaamtaaatactaggcagaaagcttccc

SEQ ID NO: 102910 - DNA, 50 bp, homo sapien
aggtgaagcatactgttgataaaaawttactactaaattccggtgctatt

SEQ ID NO: 102911 - DNA, 50 bp, homo sapien
aaacacaaacacaaatagatccaaaytgaggaagtctaaattctattcag

SEQ ID NO: 102912 - DNA, 50 bp, homo sapien
tactacaacatttgagagtacataasaaattttatccagctttgagtgga

SEQ ID NO: 102913 - DNA, 50 bp, homo sapien
gattattgataagtggaaataactayggtgtaggatattgaaatttaatt

SEQ ID NO: 102914 - DNA, 50 bp, homo sapien
tggaaattaaaggtcataataatgtraaatcgaattcattaaaaagttaa

SEQ ID NO: 102915 - DNA, 50 bp, homo sapien
caataattggaaaaatttagttgtayctgtctcttaagcttgaggttgat

SEQ ID NO: 102916 - DNA, 50 bp, homo sapien
aaaaattaccctaatgccaaaagtaracacaaacattacaagaaaggaaa

SEQ ID NO: 102917 - DNA, 50 bp, homo sapien
aagatggctcagttgatgcctgagakcatgtttgtaacataacagaaata

SEQ ID NO: 102918 - DNA, 50 bp, homo sapien
gaaatagcttcagattattattaacrctggactctaaaaaaaactcaata

SEQ ID NO: 102919 - DNA, 50 bp, homo sapien
aaatgtcctttagtaggtatgaagaygtgatctgcttcttcagacactta

SEQ ID NO: 102920 - DNA, 50 bp, homo sapien
tccatcagtgcaatctactggccaaygacaaggtggttaaaatgtccttt

SEQ ID NO: 102921 - DNA, 50 bp, homo sapien
taggaagatgaaaataagtaaaaacsacacattttcagatagtcaagcta

SEQ ID NO: 102922 - DNA, 50 bp, homo sapien
ctacatcaatgacaactagcagaaayataagtcaatgtaacaagttgtac

SEQ ID NO: 102923 - DNA, 50 bp, homo sapien
aagggacacttgaaaatatgatatasaacaagtgtggacctatccaaaag

SEQ ID NO: 102924 - DNA, 50 bp, homo sapien
aaataaagattttctgactgccatamaattagtttctattataaaagaga

SEQ ID NO: 102925 - DNA, 50 bp, homo sapien
tagcactatatcacaggtatttctaygacacaatagtattgggacccctt

SEQ ID NO: 102926 - DNA, 50 bp, homo sapien
tagaatgtgcaaactagcatgtaaakgttataaatgcatcagtctgtgga

SEQ ID NO: 102927 - DNA, 50 bp, homo sapien
aactgaaggaatggactctgtattaratatttccaaagagttcctgagac

SEQ ID NO: 102928 - DNA, 50 bp, homo sapien
ctggaaaatttatttagctgtcccargataaccattcgtaggtgtaattt

SEQ ID NO: 102929 - DNA, 50 bp, homo sapien
tagctacacaggtattgtgatcttawgagaatatgccaaaactcttttct

SEQ ID NO: 102930 - DNA, 50 bp, homo sapien
gcaagtggttcagaggttgaagttayaacaaagtcaacctttctggaatt

SEQ ID NO: 102931 - DNA, 50 bp, homo sapien
atggcttaaaatttattttcagacargcccatacttagattaaatcacag

SEQ ID NO: 102932 - DNA, 50 bp, homo sapien
attacattctataaattccaagaaaygattgaagtgttttgttcaggaaa

SEQ ID NO: 102933 - DNA, 50 bp, homo sapien
ctatgaatttggaaggtgctatgaawgtaatagtgtgttgaggctgctgt

SEQ ID NO: 102934 - DNA, 50 bp, homo sapien
acatacttaacactatggcccaaaayataccctttgataggctaaattaa

SEQ ID NO: 102935 - DNA, 50 bp, homo sapien
tttgatcaacaaacatgtcaatatcrgaagtgaaatttaaaaaaaaacat

SEQ ID NO: 102936 - DNA, 50 bp, homo sapien
aaaccatttttgttaattaaaactcyagtacctagtacaatgaactagct

SEQ ID NO: 102937 - DNA, 50 bp, homo sapien
tctcaagtattttcaattcatgcttsgttgaatccacagatgcggaaccc

SEQ ID NO: 102938 - DNA, 50 bp, homo sapien
tgcagcatttgctaattactacaaayggagagaatgtattcttttttgta

SEQ ID NO: 102939 - DNA, 50 bp, homo sapien
gcacctagcactctggtcacagaacrctactttctcaaacacgacatgct

SEQ ID NO: 102940 - DNA, 50 bp, homo sapien
gaacactactttctcaaacacgacakgctttcttccacctttctacctga

SEQ ID NO: 102941 - DNA, 50 bp, homo sapien
acctggaagtctctgggatatgcaarttacaaataaagaaactgcagcta

SEQ ID NO: 102942 - DNA, 50 bp, homo sapien
ggactccttcatatcacatctaagakaacatattgtagcacatcaggtga

SEQ ID NO: 102943 - DNA, 50 bp, homo sapien
aaaattgactataatttgaaattgcwagttctacaggactgagtcaccta

SEQ ID NO: 102944 - DNA, 50 bp, homo sapien
gttattgacatacatgctattctcarcccaatcatcttgctcagataatt

SEQ ID NO: 102945 - DNA, 50 bp, homo sapien
gaggtcctgatgtgggcttctcatartaggattagtgaccttataaaatg

SEQ ID NO: 102946 - DNA, 50 bp, homo sapien
tttatttcagaccatagaaacacaayctcaatagtttttgccaaacaatg

SEQ ID NO: 102947 - DNA, 50 bp, homo sapien
agaatgaaaataatttaacaacaaartgtgaagatgttgaaatacatcat

SEQ ID NO: 102948 - DNA, 50 bp, homo sapien
tgacctcctaatgtcaactctatgaygagatattcacatgctctcatcat

SEQ ID NO: 102949 - DNA, 50 bp, homo sapien
tctagtcattaatctcctacaaagcygacttttaacagttctcattagat

SEQ ID NO: 102950 - DNA, 50 bp, homo sapien
cacaatcaacaatgaattacacttayataaacactttcttcaagtctcca

SEQ ID NO: 102951 - DNA, 50 bp, homo sapien
catctctagaaatggaacttaatgaraaacttctaagcacaagctagcag

SEQ ID NO: 102952 - DNA, 50 bp, homo sapien
gtagtctgggagggagaaatgtctayaatatgcatgcgtgcatcaactga

SEQ ID NO: 102953 - DNA, 50 bp, homo sapien
tgggaaagaagaaaaagatggcggartaaagataactaactttttcattc

SEQ ID NO: 102954 - DNA, 50 bp, homo sapien
gtaactttcatcatcagaggtatccrctgctttgtaaacttaaattaaac

SEQ ID NO: 102955 - DNA, 50 bp, homo sapien
ttttgaagaaaaagtaaattaaggasagtagaattcagattatttaaatg

SEQ ID NO: 102956 - DNA, 50 bp, homo sapien
tgtcatcacatagatgcttgtaaaaycagccgaatatcaggaataaacta

SEQ ID NO: 102957 - DNA, 50 bp, homo sapien
caagtgtttaccctatgtggaataayatttgcataaataatacagggtga

SEQ ID NO: 102958 - DNA, 50 bp, homo sapien
gcaaaactaatttacagtttgaagamaatcaacgaactgctgtgaagcaa

SEQ ID NO: 102959 - DNA, 50 bp, homo sapien
gcactgaatttgggcctaggcttacygaatttgattgtaccaactcttac

SEQ ID NO: 102960 - DNA, 50 bp, homo sapien
atcacgaacgaagcaaacttcagaaytgattaggtgaccttatatgtgta

SEQ ID NO: 102961 - DNA, 50 bp, homo sapien
ccaaccataacatctcaatacaccarcatttattaagctcacaagtccaa

SEQ ID NO: 102962 - DNA, 50 bp, homo sapien
ctagacaattgtataaacttgaaagmaccaagtagctattacatcttcca

SEQ ID NO: 102963 - DNA, 50 bp, homo sapien
gtatatatggtataatgaatgtaaayatagacaattgttaaaaatttaat

SEQ ID NO: 102964 - DNA, 50 bp, homo sapien
aaaatgtacaagttgatcattttcaygtgcttaagttctactgtaaaact

SEQ ID NO: 102965 - DNA, 50 bp, homo sapien
aatttcacttttattcatagtgtgayagagttggctattagattaaatga

SEQ ID NO: 102966 - DNA, 50 bp, homo sapien
ggaaataaactaattccaaacatcaraaatcacaataaatggtaatactt

SEQ ID NO: 102967 - DNA, 50 bp, homo sapien
agaaagtaaccaaaaatggaggaaakaataatattgatgattataatgca

SEQ ID NO: 102968 - DNA, 50 bp, homo sapien
gttatgtaggaatataacatgaatamtatggtgagttgtcaagcatgaag

SEQ ID NO: 102969 - DNA, 50 bp, homo sapien
ttataggacccaaaagtggcttagcrcccttaattgcctgccttagagca

SEQ ID NO: 102970 - DNA, 50 bp, homo sapien
ccacattttgtaccttactaaaactsagagttgtcttatctggaaagcca

SEQ ID NO: 102971 - DNA, 50 bp, homo sapien
tttaatgcacacatttaactaaaaaytctcttccgagaggatttataata

SEQ ID NO: 102972 - DNA, 50 bp, homo sapien
cttgctgattcctgcataaagtttarcatactcttgaaatttcatttgtc

SEQ ID NO: 102973 - DNA, 50 bp, homo sapien
tctcaactgatagacaactacatgaytatattatggccattcaagactca

SEQ ID NO: 102974 - DNA, 50 bp, homo sapien
attttgtctggtgaagtggaacaacygtctgaataatgttggactatcat

SEQ ID NO: 102975 - DNA, 50 bp, homo sapien
tggcattttttgttccatagaatgtraaactaacgtcagaataagaattc

SEQ ID NO: 102976 - DNA, 50 bp, homo sapien
ggccactttcatttggaatacaataraatgcttgcacttgagctacatat

SEQ ID NO: 102977 - DNA, 50 bp, homo sapien
tttgtattctgctaatttcaaaagayatgtagctcaagtgcaagcattct

SEQ ID NO: 102978 - DNA, 50 bp, homo sapien
ggctcacttctctgaaaaaataataygagccagaaggcaatggtatgagg

SEQ ID NO: 102979 - DNA, 50 bp, homo sapien
tgtcagccagattcctaaatgtactwagacaataatctcaatagaaatta

SEQ ID NO: 102980 - DNA, 50 bp, homo sapien
ctacgatgtgccaagtcctacatgaraggccataaagaataagttggaaa

SEQ ID NO: 102981 - DNA, 50 bp, homo sapien
tcatggtgaaattttaatagaaacamcttagagtaaagatcttgcagctc

SEQ ID NO: 102982 - DNA, 50 bp, homo sapien
gcttcaaggggactttgttagcataygtgccttgctgaaggaatcacggt

SEQ ID NO: 102983 - DNA, 50 bp, homo sapien
gctgacttttcatccagctggtggartattcactgcctccccaaattcta

SEQ ID NO: 102984 - DNA, 50 bp, homo sapien
ataatatacaatgtgtgttttcagartccaccagcatagaggaaacaatc

SEQ ID NO: 102985 - DNA, 50 bp, homo sapien
tcctctggatgaatcaaggccagaamgaaggagttatatctgaagcaatc

SEQ ID NO: 102986 - DNA, 50 bp, homo sapien
aagtgttttctcataaaactcactcraaagaataacgtctgttaggaaaa

SEQ ID NO: 102987 - DNA, 50 bp, homo sapien
tgttttaccaaaggaacaagacagargatgaatgccaaaactattaatgc

SEQ ID NO: 102988 - DNA, 50 bp, homo sapien
gagtctgatgtattgaacacaattgratcttattctgccatatttgtttt

SEQ ID NO: 102989 - DNA, 50 bp, homo sapien
tcctctagagacttgcattggagggratagcatgaatgtaaatcttttat

SEQ ID NO: 102990 - DNA, 50 bp, homo sapien
gagaaatatgaccagtaaatccattkaaaaatcgtgaattaaaaacaaat

SEQ ID NO: 102991 - DNA, 50 bp, homo sapien
tctagtttcccttgttgtgattctayggttatcaaacaggtcttagtgac

SEQ ID NO: 102992 - DNA, 50 bp, homo sapien
gacctgttctaagaattgctgttaasgcacaacctaagattgatatatca

SEQ ID NO: 102993 - DNA, 50 bp, homo sapien
attttttttttttttggagattcagrcgagtaattatatagagacccttc

SEQ ID NO: 102994 - DNA, 50 bp, homo sapien
acataaatcatctgaggagtaatgamacaactgcagcccagcagaaactt

SEQ ID NO: 102995 - DNA, 50 bp, homo sapien
aaagccatgagctgtatgaaggtccraaggaggtaattttccttagtagt

SEQ ID NO: 102996 - DNA, 50 bp, homo sapien
agaaaggaggggctttgtcattcaamcttcatacatggaaattaatttta

SEQ ID NO: 102997 - DNA, 50 bp, homo sapien
tgtgtacgtttggaaaatgagctgaktaaaatggtggctattgacattgg

SEQ ID NO: 102998 - DNA, 50 bp, homo sapien
gtcttgacgagtaagtaaaaagtcaytaagacctgtttgataaccgtaga

SEQ ID NO: 102999 - DNA, 50 bp, homo sapien
gataagtcatgttcagagtggtaaargagtagattttaggtactcttgcc

SEQ ID NO: 103000 - DNA, 50 bp, homo sapien
tgctattaatctgtatatttgtgtcragccaagattcttaggtagtactg

SEQ ID NO: 103001 - DNA, 50 bp, homo sapien
accacactaaattcaacaataatgtsaatggaagaggagttagagtggtt

SEQ ID NO: 103002 - DNA, 50 bp, homo sapien
ctgagacacaaaaataaatcaatgaraacttgaatctgcagtttttcctc

SEQ ID NO: 103003 - DNA, 50 bp, homo sapien
tacaatctgtgtaacatttgcaagaygagaaatgaaccttgcaattaaaa

SEQ ID NO: 103004 - DNA, 50 bp, homo sapien
agttattcattctacttggagacacsagcagaggctactacagcttacaa

SEQ ID NO: 103005 - DNA, 50 bp, homo sapien
ggaccaggatgtgattgccaattctytcccctgaaaccctcttctcatgg

SEQ ID NO: 103006 - DNA, 50 bp, homo sapien
cttgatttgaacctttgaattaataygagttactgctatttttggttaat

SEQ ID NO: 103007 - DNA, 50 bp, homo sapien
tttatattttcttttccactaaagaygttaagtcagaaaataatatctag

SEQ ID NO: 103008 - DNA, 50 bp, homo sapien
gtttccaacaagaaatctgctgttayctttattttgattcctagttgtgt

SEQ ID NO: 103009 - DNA, 50 bp, homo sapien
cttcgtttaaaaaagcagtttgaccrtaatgtgccctggtataattttct

SEQ ID NO: 103010 - DNA, 50 bp, homo sapien
gagcatgatcctactatgaaataaastgtcagtcagagaacaattgttat

SEQ ID NO: 103011 - DNA, 50 bp, homo sapien
aactgcagctgagtcctactggaaaycctctgaggaagcctgtagaatgt

SEQ ID NO: 103012 - DNA, 50 bp, homo sapien
atactaaattaatgcatacacttacrctgaagagtggcctctccgcacaa

SEQ ID NO: 103013 - DNA, 50 bp, homo sapien
ggtattatgacttctgcttttactcycaaaaaccttgctttctacaaaga

SEQ ID NO: 103014 - DNA, 50 bp, homo sapien
tgagcagggatttcattgtaggaagyggaagtattttaggaagatatctg

SEQ ID NO: 103015 - DNA, 50 bp, homo sapien
atcactggggtacagcactattttayctaccaaatgaagattagaaataa

SEQ ID NO: 103016 - DNA, 50 bp, homo sapien
gctccacacataaagaaccatgagayaatttcctcctaaataatgctaag

SEQ ID NO: 103017 - DNA, 50 bp, homo sapien
ttttaaaaaatcattagttatactcyagcatagttattttgtctattttg

SEQ ID NO: 103018 - DNA, 50 bp, homo sapien
tttaaaaaaacatagagtttataaartatgttcgacacaattacattgcc

SEQ ID NO: 103019 - DNA, 50 bp, homo sapien
gacaatgtacatggtattctttaacracacatgaatacatttcttacccc

SEQ ID NO: 103020 - DNA, 50 bp, homo sapien
acctgtaagcttcatctggtaatgayaggcaatgtaattgtgtcgaacat

SEQ ID NO: 103021 - DNA, 50 bp, homo sapien
tagggtctggtcatttccagcaggcrcaattatttttatgtgttcagttt

SEQ ID NO: 103022 - DNA, 50 bp, homo sapien
tttaactaggacatctgaaaatatakgtatggcaggtgattataaaattg

SEQ ID NO: 103023 - DNA, 50 bp, homo sapien
cttgtaaattatactgtggagttcaygcccttcaagctgcacccttgtac

SEQ ID NO: 103024 - DNA, 50 bp, homo sapien
aacaatctaatgccacaggtgaaaaytatctctatctttcagattaggaa

SEQ ID NO: 103025 - DNA, 50 bp, homo sapien
gtgccctatattgaggaaattgaacragtacatgtgaggcagaaatagct

SEQ ID NO: 103026 - DNA, 50 bp, homo sapien
tttaacgtactctcaataattcccargatgtttcagaaaggttggcgaac

SEQ ID NO: 103027 - DNA, 50 bp, homo sapien
tagtttcacagaatttgtggatttaygtcattattttcccagaaatcata

SEQ ID NO: 103028 - DNA, 50 bp, homo sapien
gactcataatcattacaatatagcaytgaaacatacagctagaacataat

SEQ ID NO: 103029 - DNA, 50 bp, homo sapien
acaaaaacctgtcaatactactactytgaatttgagaattttgaggaatt

SEQ ID NO: 103030 - DNA, 50 bp, homo sapien
ataaccaagcaaacacacagatccaygattttatttgatgaagtaatata

SEQ ID NO: 103031 - DNA, 50 bp, homo sapien
tctgtttacagcacagtctcttgtayattttaaacccactgttgagacat

SEQ ID NO: 103032 - DNA, 50 bp, homo sapien
atgggaaaagtgaagattccattaaygtctaatcagtagaaatttgtgca

SEQ ID NO: 103033 - DNA, 50 bp, homo sapien
ttctgcctcatgcgaatacaagtgaygatcttaatagatgagagagaata

SEQ ID NO: 103034 - DNA, 50 bp, homo sapien
ttcatatgaatattcatacagacaamcttctatacattataacattgaag

SEQ ID NO: 103035 - DNA, 50 bp, homo sapien
ggaactttttcatgcatataaggagwtggtagtcattttcataagtatca

SEQ ID NO: 103036 - DNA, 50 bp, homo sapien
gatctttcagatatggcagtctgggycactccacaaggttagcattctag

SEQ ID NO: 103037 - DNA, 50 bp, homo sapien
ttcaatgtttatgtgcactttgccasagttagggaaaatagcctcaagtc

SEQ ID NO: 103038 - DNA, 50 bp, homo sapien
atttccaactggaaacaaattcttasgctactaggtctctagagattatc

SEQ ID NO: 103039 - DNA, 50 bp, homo sapien
agggttatatgctagacatagtgagratatgaggcccaagaaacctagaa

SEQ ID NO: 103040 - DNA, 50 bp, homo sapien
tcatcccatttctgtcattaactaarggatcagactaccgatcagggatt

SEQ ID NO: 103041 - DNA, 50 bp, homo sapien
catgccacttagatcttctttgagakaccctgctgcagcgagcatagtta

SEQ ID NO: 103042 - DNA, 50 bp, homo sapien
gtttgagtgtattactaggagattargcctttttcaatttcttgtaatcc

SEQ ID NO: 103043 - DNA, 50 bp, homo sapien
tcccagcccaggaaatgaccttaaamtactgcttctaatcatgtgctcaa

SEQ ID NO: 103044 - DNA, 50 bp, homo sapien
aagagagatgagaactatggtttagsagtcagaagttagtatcaagttta

SEQ ID NO: 103045 - DNA, 50 bp, homo sapien
ctattactgtgtatagatagaaagartcaacaaacaaacaaataaacttg

SEQ ID NO: 103046 - DNA, 50 bp, homo sapien
acagaaatttatcttccttggagtcraagaaggaattgctctttaaacac

SEQ ID NO: 103047 - DNA, 50 bp, homo sapien
acttaaatctttcaggctcccttggyataggccacaacatttccttcctc

SEQ ID NO: 103048 - DNA, 50 bp, homo sapien
tcctagggatgcaaggatggcttaamgtatgcaaatcaaccaatgtaata

SEQ ID NO: 103049 - DNA, 50 bp, homo sapien
aaaaaatgggtcctaaatgatcaaakaaatggatgattgaataaacaaat

SEQ ID NO: 103050 - DNA, 50 bp, homo sapien
atttgtgtctctcgatatcttaccaygataaatcaaatccatcgctaatc

SEQ ID NO: 103051 - DNA, 50 bp, homo sapien
aacaattgttccaattctaaacccaytgacataggccgtcaagaaaaaat

SEQ ID NO: 103052 - DNA, 50 bp, homo sapien
gggacccgttgctaaaggggtgtgaratttctctgtgcggtaataaaatg

SEQ ID NO: 103053 - DNA, 50 bp, homo sapien
cttcattgcctaaggaataaagtccmaattgttcgtttgggcattcaggg

SEQ ID NO: 103054 - DNA, 50 bp, homo sapien
ccttggtttccaaatctctaaaatayggataatgctactttcatgggatt

SEQ ID NO: 103055 - DNA, 50 bp, homo sapien
acgttgggatcctattaaaacacggycaagtcgatttgtagatttggaat

SEQ ID NO: 103056 - DNA, 50 bp, homo sapien
gactactctacattctctgaaaacayacaagtaaataaatacctctatta

SEQ ID NO: 103057 - DNA, 50 bp, homo sapien
agatgcaaaggattagtgtgagttartaaatgaagtccagtgtctatttg

SEQ ID NO: 103058 - DNA, 50 bp, homo sapien
aaagattgtaagagatgaagtcatgraagtaaccagtggaacaaaatagg

SEQ ID NO: 103059 - DNA, 50 bp, homo sapien
ttttcaatagcaagggcatatagtcraagaattttaaaatttaatttata

SEQ ID NO: 103060 - DNA, 50 bp, homo sapien
gttattatgtggcattattattaaaygtgtgtgtattcatatatgtatta

SEQ ID NO: 103061 - DNA, 50 bp, homo sapien
cagagatcctggcctgtagtcggaartctggtagggaacaatttggacaa

SEQ ID NO: 103062 - DNA, 50 bp, homo sapien
tggtttaaactgctgtttggctcaaratagacatgtatcctggagttgtt

SEQ ID NO: 103063 - DNA, 50 bp, homo sapien
ctataaagaaccattaataacaaaayacacatgactttaggaatttgaaa

SEQ ID NO: 103064 - DNA, 50 bp, homo sapien
ttttccagaaaacttgtctacactcrcatctccactttctgaaccctcat

SEQ ID NO: 103065 - DNA, 50 bp, homo sapien
ccagaagatttcctctcatgggttcyaggaaaaaggtctcttccccataa

SEQ ID NO: 103066 - DNA, 50 bp, homo sapien
gggcaaaaattgctttgcaacatcaygacaaacactacagctacagctaa

SEQ ID NO: 103067 - DNA, 50 bp, homo sapien
agcttacaaaacattttcttaaatcraacacttattaatcttccagatat

SEQ ID NO: 103068 - DNA, 50 bp, homo sapien
gtaatttcctaatcccactaacaatmattagaattgcataaggctgtctt

SEQ ID NO: 103069 - DNA, 50 bp, homo sapien
tttggtaaccaccattgtcaaaggtrgtatgagctctgctctatgagttt

SEQ ID NO: 103070 - DNA, 50 bp, homo sapien
acattattgcatgtcaaatccatatyacaattacttcatttgtcccaaaa

SEQ ID NO: 103071 - DNA, 50 bp, homo sapien
tagcttaatcatttcatattgtattwaaaaagctaataccactttgtacc

SEQ ID NO: 103072 - DNA, 50 bp, homo sapien
ttttaaattgtatattgacaaattakagttgtatatttttatggggtaca

SEQ ID NO: 103073 - DNA, 50 bp, homo sapien
tagactgctagattatggatcttgargctcatgccatagttatgccactc

SEQ ID NO: 103074 - DNA, 50 bp, homo sapien
atattttgatgaagtaaaatgcaacratttcttatataaagttagaaagc

SEQ ID NO: 103075 - DNA, 50 bp, homo sapien
aatattgaaaatccacataaagtagrtaaatgttcctaaataataaagtg

SEQ ID NO: 103076 - DNA, 50 bp, homo sapien
ctcagtttattccaataagcttgtamaaatatttcttaggtgtttatgtc

SEQ ID NO: 103077 - DNA, 50 bp, homo sapien
gctgatgacctttaaaccaatgacaytgaccttgtttcaagcactagtct

SEQ ID NO: 103078 - DNA, 50 bp, homo sapien
atgcttcttggaaattaagagaaccraataagtgagaaacactcagtgag

SEQ ID NO: 103079 - DNA, 50 bp, homo sapien
tcttagctaaaaatagaatagcaatwaaacctacttctttgggtttctgt

SEQ ID NO: 103080 - DNA, 50 bp, homo sapien
agtgacatttagtacatttcagatamgactcctaaaaccaaagcttttct

SEQ ID NO: 103081 - DNA, 50 bp, homo sapien
gagaaagtgctgagctctgccagatratgctctaagaaatcaatattcta

SEQ ID NO: 103082 - DNA, 50 bp, homo sapien
aaacttgttttaaatcatacagaaawtaagtaggaaaatcgtcatttgaa

SEQ ID NO: 103083 - DNA, 50 bp, homo sapien
attttctgtgtagtatctttcactcratgttaggtttatatgatcacacc

SEQ ID NO: 103084 - DNA, 50 bp, homo sapien
agctgaattttagaggagaggaaacrgaattaattagttagatagtaagt

SEQ ID NO: 103085 - DNA, 50 bp, homo sapien
caagtcctacgctggtatagactaawttaacttatgactgaattaaaatg

SEQ ID NO: 103086 - DNA, 50 bp, homo sapien
gctttcattttctccattatatttcycattatctgatgactgaataggtt

SEQ ID NO: 103087 - DNA, 50 bp, homo sapien
gatttcatacttgaaacttagctgamgaattccccactcatttaatcact

SEQ ID NO: 103088 - DNA, 50 bp, homo sapien
aatggagaaaatgaaagctagaaaaygtatttcaatactaagcagtgcaa

SEQ ID NO: 103089 - DNA, 50 bp, homo sapien
acctgaggcatttgcagttttcaacrgtagtggcttgtcctcttctggct

SEQ ID NO: 103090 - DNA, 50 bp, homo sapien
aaatgaaaatggaagcacaatgtaayaaaatctctgcaatgcagcaaagg

SEQ ID NO: 103091 - DNA, 50 bp, homo sapien
atctttcattggttttggagactaayggtagataacagttttataaatga

SEQ ID NO: 103092 - DNA, 50 bp, homo sapien
gggatgccctcagctagtgttcaaastaatacaattgccatgaaaatact

SEQ ID NO: 103093 - DNA, 50 bp, homo sapien
attctataatccagtatggtggttamgtataggtatttttatccctaagg

SEQ ID NO: 103094 - DNA, 50 bp, homo sapien
ttctgggtcataaatccaagttttaygagatgacaaaattagaagtccaa

SEQ ID NO: 103095 - DNA, 50 bp, homo sapien
atgtggtatcctgaaattatcaaaayacaatgatcagcttttgtaactga

SEQ ID NO: 103096 - DNA, 50 bp, homo sapien
ataatctgaggtgtacacacaggatrgacagttatatcttccttaccatt

SEQ ID NO: 103097 - DNA, 50 bp, homo sapien
atatccctcagttgttttctatacartacacttttttagcctttcttatg

SEQ ID NO: 103098 - DNA, 50 bp, homo sapien
gctaatactgatgaccagactaggaragttcagcatgagttatttaggct

SEQ ID NO: 103099 - DNA, 50 bp, homo sapien
gtgggaatatgttctgatttaataaytgacttgaaaatacaccttaggaa

SEQ ID NO: 103100 - DNA, 50 bp, homo sapien
attaaaatgtagttaccgggaatcayctaaccatgaccaaaaaaaaaaaa

SEQ ID NO: 103101 - DNA, 50 bp, homo sapien
tgaaacatgttcaataatgttggaawaaaaagagaggagagtacatctta

SEQ ID NO: 103102 - DNA, 50 bp, homo sapien
aaattgagttgctattgtgttaggartacctttagcactatgattcagcc

SEQ ID NO: 103103 - DNA, 50 bp, homo sapien
agacattttataactcattgtcttasagaattttgctgttcaaaaagcag

SEQ ID NO: 103104 - DNA, 50 bp, homo sapien
ctgtgtttgtttcctgctaactttcraatgtctggactgattttgatcaa

SEQ ID NO: 103105 - DNA, 50 bp, homo sapien
caggaagaggacctttggtcagtaasaaacctctcagggccaagtggcag

SEQ ID NO: 103106 - DNA, 50 bp, homo sapien
tctgtttcattggtctatgtgtttaygtttatgaaagtagtatgctgttt

SEQ ID NO: 103107 - DNA, 50 bp, homo sapien
caaagagaaccaggtagaagatataygaccttgggctttgaaagtgaaat

SEQ ID NO: 103108 - DNA, 50 bp, homo sapien
cccagaacatacatttgtaaaactaygctataaaagtaatagaattcaac

SEQ ID NO: 103109 - DNA, 50 bp, homo sapien
aaattctaaaaccttatctccggaawtggatgttttctttactaaagtct

SEQ ID NO: 103110 - DNA, 50 bp, homo sapien
aagttccaacacagctttctacaagkatttgagatttgacatccatctta

SEQ ID NO: 103111 - DNA, 50 bp, homo sapien
ttttattaattgtataattgtgaaayagtcatcatgctaagtaagctgat

SEQ ID NO: 103112 - DNA, 50 bp, homo sapien
agggaaaccagaagactggcatgcckaaagaacagtaaaagttttttttt

SEQ ID NO: 103113 - DNA, 50 bp, homo sapien
aggaggtgagaaataatgtattttayaactggcaggattaatatgataat

SEQ ID NO: 103114 - DNA, 50 bp, homo sapien
gcttaaaaatggtcaggtcatataayaacaatttcatgtaatacaacttg

SEQ ID NO: 103115 - DNA, 50 bp, homo sapien
taggaaataatgcagcatccctgaartcctatgcagagtctggtgtgtga

SEQ ID NO: 103116 - DNA, 50 bp, homo sapien
tgagaggacatggagctgattgacamcttctatgcataattctatgccta

SEQ ID NO: 103117 - DNA, 50 bp, homo sapien
tgtaagaggaaccaagtggagaaggyatataggaaagaagatcttttcta

SEQ ID NO: 103118 - DNA, 50 bp, homo sapien
acatgtaaatattgaaactcttaaaytgagttatctgtaaaaaagacgaa

SEQ ID NO: 103119 - DNA, 50 bp, homo sapien
ctgtctttattattcaaccttcccaygctatttgatcttcttaattattc

SEQ ID NO: 103120 - DNA, 50 bp, homo sapien
ttaactgaagttcatacttaatttgygtttctttaatttttacctaatat

SEQ ID NO: 103121 - DNA, 50 bp, homo sapien
ttctctgcttctgaaatgcctattakatagttgtggagcttctcaattaa

SEQ ID NO: 103122 - DNA, 50 bp, homo sapien
ggcttaaaatgaagaaatgagctcgmactatttggtacagtgggcacaga

SEQ ID NO: 103123 - DNA, 50 bp, homo sapien
atagatatctagaagtgtgcaagackaatttaaagccaacttttgaagta

SEQ ID NO: 103124 - DNA, 50 bp, homo sapien
ctgatagaagatatccaaagttgaaytgtataaattgtcattaactttag

SEQ ID NO: 103125 - DNA, 50 bp, homo sapien
atatagatgtcaaaattgtagtgaaygtaaagtgcttagcagtaaaagtc

SEQ ID NO: 103126 - DNA, 50 bp, homo sapien
ggaagtgattatatcttattttctcyactatgcccaagacaatgttgagt

SEQ ID NO: 103127 - DNA, 50 bp, homo sapien
taaagtataccttcataaaagataawtacacgataaataagttacttgta

SEQ ID NO: 103128 - DNA, 50 bp, homo sapien
aaaattttatgctgttgcaggataastataattttagcatcctacctatc

SEQ ID NO: 103129 - DNA, 50 bp, homo sapien
atagacatgcttttctgaagaatgckttgggccagtgttctagaacctct

SEQ ID NO: 103130 - DNA, 50 bp, homo sapien
tgaagccagctctgcctctataccaytactatttgccagaaatttagctg

SEQ ID NO: 103131 - DNA, 50 bp, homo sapien
attaaaccagcaacagattaaaaacratacacatttccaacaaaagaata

SEQ ID NO: 103132 - DNA, 50 bp, homo sapien
taagaaaagcactatggaagagagcygttttctacctacttttgtccttc

SEQ ID NO: 103133 - DNA, 50 bp, homo sapien
tatgaaagtactttgtaaattaaaasgtaatattaagcccatacccatca

SEQ ID NO: 103134 - DNA, 50 bp, homo sapien
ttctagaaacagatttcatggactayggaaatttaactcttgatcactat

SEQ ID NO: 103135 - DNA, 50 bp, homo sapien
aattccttcatacgttgaccagtgasctgtctatgcacagggaagtttcc

SEQ ID NO: 103136 - DNA, 50 bp, homo sapien
tagaacagagcctcctgatacagtaycttatgcaatcatgctgtcttcaa

SEQ ID NO: 103137 - DNA, 50 bp, homo sapien
aaagtttaattaaaagaaaataacaytgaatgataaaaaagaagaaagaa

SEQ ID NO: 103138 - DNA, 50 bp, homo sapien
gctgctgcataaacacaaatctgaaktggaatcttagcactgctatacaa

SEQ ID NO: 103139 - DNA, 50 bp, homo sapien
tcactgacttgcctcatccaataaartgttttgtttctgagacaattggg

SEQ ID NO: 103140 - DNA, 50 bp, homo sapien
tagggacaatctacctctcttaatgragaaaatgagaaatattatctata

SEQ ID NO: 103141 - DNA, 50 bp, homo sapien
gtttgtttgttatcctgccatgaacratagcttgatccaagtagacgtga

SEQ ID NO: 103142 - DNA, 50 bp, homo sapien
tgactacccacaatcttcttgaaatmatttatggatctggggaaatagat

SEQ ID NO: 103143 - DNA, 50 bp, homo sapien
tgtttcagcaaccataggaaacaaaytcaatgcctcatcatacatccatg

SEQ ID NO: 103144 - DNA, 50 bp, homo sapien
ggggataccacagaaataagataaaytgtggtatgagataggtggggaat

SEQ ID NO: 103145 - DNA, 50 bp, homo sapien
ttttacatggagttgaagggattctyaaaaaaataagtccagctatagaa

SEQ ID NO: 103146 - DNA, 50 bp, homo sapien
attattcccctgtattattcaactayggctaattcaaacttcaaaagaat

SEQ ID NO: 103147 - DNA, 50 bp, homo sapien
caattcctagtaacaggattatctcrtgattaaattattgctacctcttt

SEQ ID NO: 103148 - DNA, 50 bp, homo sapien
gctctccatattccccatggagttayggtctctgtattttcaggtctctc

SEQ ID NO: 103149 - DNA, 50 bp, homo sapien
ttctgttatatttccttcacagatgycagattacttacagctttgtgaaa

SEQ ID NO: 103150 - DNA, 50 bp, homo sapien
tgatcttgtgatagtagttgcaatartattaatagaacaaaagattcctg

SEQ ID NO: 103151 - DNA, 50 bp, homo sapien
aagtcattttgccagcaagcaattayagtaagcccagtgaatgccccaaa

SEQ ID NO: 103152 - DNA, 50 bp, homo sapien
ggtcatggcctaattgagagagataygtacttcctgagtgtgaaggaatc

SEQ ID NO: 103153 - DNA, 50 bp, homo sapien
atatttacattgtgggtatgttcaayattttttgtatcctttattctcct

SEQ ID NO: 103154 - DNA, 50 bp, homo sapien
caataatataattaaaagttggttayatggtaaagatgaaaattatttct

SEQ ID NO: 103155 - DNA, 50 bp, homo sapien
cagctttccttccttgctactatctmaatatgacttgacttcagaagctg

SEQ ID NO: 103156 - DNA, 50 bp, homo sapien
agactcgagttttgtatgtggtttargactatatattttaagaaattata

SEQ ID NO: 103157 - DNA, 50 bp, homo sapien
tgagcctacttttagatattttatcrcaagagagtaaacaacttgattat

SEQ ID NO: 103158 - DNA, 50 bp, homo sapien
ctccaagttctgattggccttataamcttaagtataaagaaacaaggtat

SEQ ID NO: 103159 - DNA, 50 bp, homo sapien
tcttattgcttgcttcattttacttmtgtaaggaattgtaattatttata

SEQ ID NO: 103160 - DNA, 50 bp, homo sapien
caccgaagaatatcagataataagasaacctaatagaaaccattaagtta

SEQ ID NO: 103161 - DNA, 50 bp, homo sapien
aaaaccatagttctgagtaattcctracaggtaggcagctctaattgatg

SEQ ID NO: 103162 - DNA, 50 bp, homo sapien
gcaagattgaagtgaagcaatatgaygattcaccacaccattcctagctt

SEQ ID NO: 103163 - DNA, 50 bp, homo sapien
tcttgaatttactagctctcagtgaycttgaaagtagtagctttcctagt

SEQ ID NO: 103164 - DNA, 50 bp, homo sapien
gccatgaatattcaggaaatgtataygcccgcttagctccaatttctttg

SEQ ID NO: 103165 - DNA, 50 bp, homo sapien
gtagccctaatgtaaccaagtggatmaaagacatggaggcaatgggatgg

SEQ ID NO: 103166 - DNA, 50 bp, homo sapien
acaaagtagaataggcaaatgaaatraacatccaaagtattgtctggctg

SEQ ID NO: 103167 - DNA, 50 bp, homo sapien
tgctgggattggatagaagtgctaamactaaataattgcctttttgtaaa

SEQ ID NO: 103168 - DNA, 50 bp, homo sapien
ccccacagcttgtcttaagaacaacrgtgtaaccattagtgaaaaatcct

SEQ ID NO: 103169 - DNA, 50 bp, homo sapien
ttgagaattctgctgttgtcttcatraatttctggggttagtaatgcctc

SEQ ID NO: 103170 - DNA, 50 bp, homo sapien
agacaacagcagaattctcaagaatsaccatgcacgttgtaaagaaaagc

SEQ ID NO: 103171 - DNA, 50 bp, homo sapien
aagagtcttggcatgtcttgagttaygttgttgtacagcattggaatgtg

SEQ ID NO: 103172 - DNA, 50 bp, homo sapien
tcaagagaaatttgtcacaactaaamgggagaacagaaatcaatatctgg

SEQ ID NO: 103173 - DNA, 50 bp, homo sapien
acagataatagttgcaaggactagasagaactcagccaaatgcagctaac

SEQ ID NO: 103174 - DNA, 50 bp, homo sapien
acaagcattcttggaaaaagagtgcrcacacagtcaaagagccagagagg

SEQ ID NO: 103175 - DNA, 50 bp, homo sapien
attaatatgacatactgaaagtcatraacattcttggtgatgtcataatt

SEQ ID NO: 103176 - DNA, 50 bp, homo sapien
gtagttacaatcttttagagcataarcatcttaggacatactttaatgcc

SEQ ID NO: 103177 - DNA, 50 bp, homo sapien
tttgctaaagggctctaattaagaaygatgccatagtatatcttttgagt

SEQ ID NO: 103178 - DNA, 50 bp, homo sapien
taacgcagcactcccattgttttgaygccactgtataataggtacgttat

SEQ ID NO: 103179 - DNA, 50 bp, homo sapien
atcacaaattatctttgggttctaaygagatgatcttaaagtcctcaata

SEQ ID NO: 103180 - DNA, 50 bp, homo sapien
aaactggtcaagctttataaagtcaygttctttcaactgtactccaactc

SEQ ID NO: 103181 - DNA, 50 bp, homo sapien
ctaagattaatgcaagacatacaaamtgtaagaagtaattgtatttatta

SEQ ID NO: 103182 - DNA, 50 bp, homo sapien
ctagtgttatttaatatttcccaatkattcctgtggaaagaccagggtgt

SEQ ID NO: 103183 - DNA, 50 bp, homo sapien
aaatatctagagagggaaaagctgamattactggaacacaatagacccat

SEQ ID NO: 103184 - DNA, 50 bp, homo sapien
atggtactggaggctgttattttaartggaagaacttggaaacaaaaaga

SEQ ID NO: 103185 - DNA, 50 bp, homo sapien
aaagggaaaaggtgatgattcatgastaaaggattgaacatactgaattc

SEQ ID NO: 103186 - DNA, 50 bp, homo sapien
ttcatacagatgactttcctttatcratgtagtacccttcaagacctgtc

SEQ ID NO: 103187 - DNA, 50 bp, homo sapien
ttaataagccacggaaggccatgaayatttatgaaaggagaaacaaacac

SEQ ID NO: 103188 - DNA, 50 bp, homo sapien
tgttgagaacattgcttgctgctaargaattaagctatttatgagttaaa

SEQ ID NO: 103189 - DNA, 50 bp, homo sapien
tctgggctttcattcatagtaaaaamtcattaagactgcatttatggcag

SEQ ID NO: 103190 - DNA, 50 bp, homo sapien
atttgcatctgaaggcatagtagaamcaataagatgtagaaaagaaagac

SEQ ID NO: 103191 - DNA, 50 bp, homo sapien
agtcttgtaaacgtaagcccctgacrgtatacatgagttaaggatagaat

SEQ ID NO: 103192 - DNA, 50 bp, homo sapien
ctgctgcctgaattaagtaatgagcrgaaaatactcagcacagtgttaac

SEQ ID NO: 103193 - DNA, 50 bp, homo sapien
agacaactctgaagggctatctatakgagaatggctgtgccatggcatcc

SEQ ID NO: 103194 - DNA, 50 bp, homo sapien
actgttcaatgcatatagatatagaratccagtcgtacaagatgaaaagt

SEQ ID NO: 103195 - DNA, 50 bp, homo sapien
acagactaaattctgccacatatacygccatttgtaagcccaactcttat

SEQ ID NO: 103196 - DNA, 50 bp, homo sapien
agagacagttaattttcctaataggkaatgctttatacacatgaagggta

SEQ ID NO: 103197 - DNA, 50 bp, homo sapien
ttgattatgtttagtaggccacttaygctgagtctgaagtttataggaaa

SEQ ID NO: 103198 - DNA, 50 bp, homo sapien
tgcagatgctatctcttctttgtagwtgggagaccctaagaaggttataa

SEQ ID NO: 103199 - DNA, 50 bp, homo sapien
agaatggaatttctattgttttatgmcaccgagtttgtggtagtttgtta

SEQ ID NO: 103200 - DNA, 50 bp, homo sapien
attatacatccttggttgaatcacartaaaggtattgacctggagaaaaa

SEQ ID NO: 103201 - DNA, 50 bp, homo sapien
tttgtgttcatatgaagtcttcacamggttaacttagacttcacaaagtt

SEQ ID NO: 103202 - DNA, 50 bp, homo sapien
attgttgttattttgtgttaaagtaygaagatcttaatgttaagacaata

SEQ ID NO: 103203 - DNA, 50 bp, homo sapien
taaacaaagaggggaatacattttarggatacggtgatgtctcatagaac

SEQ ID NO: 103204 - DNA, 50 bp, homo sapien
tcagtatctattgcttgcaattaacraaccctaattagtgttccaggata

SEQ ID NO: 103205 - DNA, 50 bp, homo sapien
tattttatcatctgagaattggagaygtgactttcagctctgacattctg

SEQ ID NO: 103206 - DNA, 50 bp, homo sapien
tcaaggttgtggcaggatgctattgkctttccctcgctagcaaaacctcc

SEQ ID NO: 103207 - DNA, 50 bp, homo sapien
cttggtctagtgggctcaaaatagakagcagtggccaggctgttagtgtt

SEQ ID NO: 103208 - DNA, 50 bp, homo sapien
gtgcaattctagtaaaagttctgacrcattttcttttttgtttgcttgtc

SEQ ID NO: 103209 - DNA, 50 bp, homo sapien
actacagtctctttctgcggtaatarcaagtctattctacataaaattct

SEQ ID NO: 103210 - DNA, 50 bp, homo sapien
tgatactgtttggaaattgcttataygccgtgattcaaggggtgctagaa

SEQ ID NO: 103211 - DNA, 50 bp, homo sapien
ttgacctatacctgatagtaccaaarttatgtagtctaaaggttgtgatt

SEQ ID NO: 103212 - DNA, 50 bp, homo sapien
tctaaaggttgtgatttgtagtatcyagtcaatgcagactgaaataaaac

SEQ ID NO: 103213 - DNA, 50 bp, homo sapien
gaggagagacaaactcatggggccartccactatcttaaatcagaaacac

SEQ ID NO: 103214 - DNA, 50 bp, homo sapien
aatgtcaatagtgctgagcttgagamacctctgtgtatgctaatcaagtt

SEQ ID NO: 103215 - DNA, 50 bp, homo sapien
atctcaaagaactcccaacattaagkaatatacaaaggagactaaggaac

SEQ ID NO: 103216 - DNA, 50 bp, homo sapien
ttgtaacttcctaggaacttgttaawttgttgtgattaaaatgctgatag

SEQ ID NO: 103217 - DNA, 50 bp, homo sapien
atagaagtcacactcagaatggttcraggttagttattgccttactcttt

SEQ ID NO: 103218 - DNA, 50 bp, homo sapien
tttagctaaagggaggacccatttayatttgaagctaagaacatttccca

SEQ ID NO: 103219 - DNA, 50 bp, homo sapien
tttatttttatatgtcattgcaatamtacaagagctgtgaagagtttatt

SEQ ID NO: 103220 - DNA, 50 bp, homo sapien
atggtggtatgaatgtatttatgtcwcaaaattatgtttctgagctttgg

SEQ ID NO: 103221 - DNA, 50 bp, homo sapien
gccaatacagttttgaatgaagatayggctttttgtggaagaaggaattg

SEQ ID NO: 103222 - DNA, 50 bp, homo sapien
catataataaggtactgttccaacaygtatgccaatatcctaggttagtg

SEQ ID NO: 103223 - DNA, 50 bp, homo sapien
agtgaatcaagaaagacaaaaacacragatcctgaaagctgagaatccaa

SEQ ID NO: 103224 - DNA, 50 bp, homo sapien
aatgtagaaacacataattaaataayctacctatgaagagaaaaatagta

SEQ ID NO: 103225 - DNA, 50 bp, homo sapien
attttaatattttactgtcaaagagmacccttgtgatcacagatttaagg

SEQ ID NO: 103226 - DNA, 50 bp, homo sapien
ttctacctctctgggtcctctatgasaattggaaataaaaacaaaagtca

SEQ ID NO: 103227 - DNA, 50 bp, homo sapien
gagacacattaatgacatctttctargtagactgtccatgacttctgtag

SEQ ID NO: 103228 - DNA, 50 bp, homo sapien
tttgttttttccagtaaaaataagaygagagattggctgtggagaatatt

SEQ ID NO: 103229 - DNA, 50 bp, homo sapien
ttattccatgtctggatttctcttasctttctgttttaagaagaaaattc

SEQ ID NO: 103230 - DNA, 50 bp, homo sapien
gaatatggtttgcaaatcccaattcsatgtttgtgcattccctaagttgt

SEQ ID NO: 103231 - DNA, 50 bp, homo sapien
agatagcggaagaagggatttggtaygtattgctaggttctcgagatagc

SEQ ID NO: 103232 - DNA, 50 bp, homo sapien
gatttggacataaatgttcatataakctttatctgtaatagccaaaatat

SEQ ID NO: 103233 - DNA, 50 bp, homo sapien
gtccttccatttgcactctcttcaastaccaacccccgccctcacactca

SEQ ID NO: 103234 - DNA, 50 bp, homo sapien
ccaccccacctaaaataggatttgartgtaagcattaataaggtcggata

SEQ ID NO: 103235 - DNA, 50 bp, homo sapien
tttacatgttttacagaggtcgagargatagaaaattgaggcaagatcat

SEQ ID NO: 103236 - DNA, 50 bp, homo sapien
aacagtggtacctaatgactccctargcctcaaattatattaaaagacaa

SEQ ID NO: 103237 - DNA, 50 bp, homo sapien
gtcctttctctcataacaatagcaaygactttattcgcaaggacaccaat

SEQ ID NO: 103238 - DNA, 50 bp, homo sapien
caatgttattgctccccggtcctacwactttatgatgccaaagcgtatca

SEQ ID NO: 103239 - DNA, 50 bp, homo sapien
aaaaaattaagtaatttgtagttgckatactgggacaggtggtttacctg

SEQ ID NO: 103240 - DNA, 50 bp, homo sapien
ttttgatgtttataatacatgaaaargtttttagttataacaaccttcgt

SEQ ID NO: 103241 - DNA, 50 bp, homo sapien
gagatttctaaagttctcagtgataygatcttttctttctttatcttact

SEQ ID NO: 103242 - DNA, 50 bp, homo sapien
aaaacaacattgaatagtagacatcycttctcttaaagtcctctagtgcc

SEQ ID NO: 103243 - DNA, 50 bp, homo sapien
ccctatgccactctgtaacaactacrcaattgaagctacctccttataag

SEQ ID NO: 103244 - DNA, 50 bp, homo sapien
tttgctttttttgtaaataacacaartgccattatggtagtttgataaaa

SEQ ID NO: 103245 - DNA, 50 bp, homo sapien
taagtaaaaaacatttcaaccacatwatgattatgatacaaataatgtgt

SEQ ID NO: 103246 - DNA, 50 bp, homo sapien
tgtgcaatattctaggattcagggayataacagtgaacaaaaacatattt

SEQ ID NO: 103247 - DNA, 50 bp, homo sapien
aattgctgaaaatcaatgatagaacrtcatccttccattggctgaattac

SEQ ID NO: 103248 - DNA, 50 bp, homo sapien
ttcccatgtgcctcttttccttctcrcagatttatcttttgcttcactca

SEQ ID NO: 103249 - DNA, 50 bp, homo sapien
atccaatatgaccagtgacaccaaaratacacatgcacggaacaaagacc

SEQ ID NO: 103250 - DNA, 50 bp, homo sapien
ctcatcagcatctccatctaccatcrctgagtctttttcattctaattaa

SEQ ID NO: 103251 - DNA, 50 bp, homo sapien
tataattaaagtggcatttactacaytggacatttttcatactgattaga

SEQ ID NO: 103252 - DNA, 50 bp, homo sapien
gctaaagacaatgatccaaaaagcaratgatggaggaacatataaagaca

SEQ ID NO: 103253 - DNA, 50 bp, homo sapien
catcacacagcaggaaagtcagagamctcaagaaaagcaaaactgacagt

SEQ ID NO: 103254 - DNA, 50 bp, homo sapien
aaaaagaagcagcactataaaacaawttgacattagacaatctagcagaa

SEQ ID NO: 103255 - DNA, 50 bp, homo sapien
tctactctcaattatataaacttcartatctcacaaaaatctagatccat

SEQ ID NO: 103256 - DNA, 50 bp, homo sapien
gagtgtgcaaaatgattttgataaamgtatgttgatctggggacctgtaa

SEQ ID NO: 103257 - DNA, 50 bp, homo sapien
agaagaaacaaaagagcctgtgaacragataaggaagatgcctttagagc

SEQ ID NO: 103258 - DNA, 50 bp, homo sapien
gctttctttgtaatttcagcataaaytgtcctaatctgactaatatttct

SEQ ID NO: 103259 - DNA, 50 bp, homo sapien
ctgaaatcatcttgatggtgactaargtgccctgttgagtatgttgcagg

SEQ ID NO: 103260 - DNA, 50 bp, homo sapien
ttaagtaattttaggaatctttgagraactccttctacctcaaatttaaa

SEQ ID NO: 103261 - DNA, 50 bp, homo sapien
ctgtttccctagtgtgtgttatttcsatcatttttctccttttagcaatt

SEQ ID NO: 103262 - DNA, 50 bp, homo sapien
tttttccaactaccttgaatataaasagaactcaagaaaatcagaaattt

SEQ ID NO: 103263 - DNA, 50 bp, homo sapien
tctaccttcatctttaaaactaaatmacttgacagccttttaatttacac

SEQ ID NO: 103264 - DNA, 50 bp, homo sapien
agctaaaggtgcaactcttgacctaytaaatgacaacaaataccatacgg

SEQ ID NO: 103265 - DNA, 50 bp, homo sapien
gagttaaatgtcagaaatcagtaacmaagcctatatgttccatgccatct

SEQ ID NO: 103266 - DNA, 50 bp, homo sapien
acacatatgaacagacaaagataaaygtcactgtaatctggtttgaagat

SEQ ID NO: 103267 - DNA, 50 bp, homo sapien
atttatccctcacccagcttcaaaaktatgaactcctattcaatcttgct

SEQ ID NO: 103268 - DNA, 50 bp, homo sapien
agcaatggaggccaggctaggcatarcaatgatatataaaataggaatct

SEQ ID NO: 103269 - DNA, 50 bp, homo sapien
gcacagcaatatgacactcgatgacygaattattaattcagaccaaataa

SEQ ID NO: 103270 - DNA, 50 bp, homo sapien
tttaattgaacggatgttaggatgargttcaaggaccgacaacaaataca

SEQ ID NO: 103271 - DNA, 50 bp, homo sapien
catcaacttttcctgttattataccratagtttcattctcctggatttct

SEQ ID NO: 103272 - DNA, 50 bp, homo sapien
tgtgtacatttatgtaattgtgacayataaataaagaaaagtagatgggt

SEQ ID NO: 103273 - DNA, 50 bp, homo sapien
attgaatttgaaattagaagtttacwtttcatattggaccagattgagtt

SEQ ID NO: 103274 - DNA, 50 bp, homo sapien
gctttttaaactatggttacagctcyataagggtgatgagtgaggagggc

SEQ ID NO: 103275 - DNA, 50 bp, homo sapien
tagctagaacttggggatatatagamaaaggctgattaatttaaactttc

SEQ ID NO: 103276 - DNA, 50 bp, homo sapien
ttgtgattttggaaacattgagccaycatttaagaaatctggcatgtcca

SEQ ID NO: 103277 - DNA, 50 bp, homo sapien
caaaaagtagtggcttttctttcacrggtatgaaggttgactggaatcag

SEQ ID NO: 103278 - DNA, 50 bp, homo sapien
acaatttcctcagccaaatgtcagayaggtatagtcatttaccatgcaag

SEQ ID NO: 103279 - DNA, 50 bp, homo sapien
tacctatctgacatttggctgaggarattgtccactagaggttggggcaa

SEQ ID NO: 103280 - DNA, 50 bp, homo sapien
aacaagaaaagcatgtatactgatcratgttattatgtggccttttaaac

SEQ ID NO: 103281 - DNA, 50 bp, homo sapien
aaaatgagccataagagaagtgggasagtgttcaagtcagaagcaatact

SEQ ID NO: 103282 - DNA, 50 bp, homo sapien
ttcagaaatgttaagtgtattcacarcatcgtacaatggatctctagaac

SEQ ID NO: 103283 - DNA, 50 bp, homo sapien
ttgggaaaagtcagtggctgacgtgraaacagctgagtgcgttattctaa

SEQ ID NO: 103284 - DNA, 50 bp, homo sapien
ataggtaaacattataacaggcaaamttaaatcttattttttaaatctat

SEQ ID NO: 103285 - DNA, 50 bp, homo sapien
agactatctttggtttctgtcattayggtactttcaaatagttctctgag

SEQ ID NO: 103286 - DNA, 50 bp, homo sapien
cttagttcctattccaagctttgtaygaaagaaatgatcattttatgtct

SEQ ID NO: 103287 - DNA, 50 bp, homo sapien
gaaaagtgttagcttccaagcgtgaygaacccttcagatagactcatcag

SEQ ID NO: 103288 - DNA, 50 bp, homo sapien
ggctctaattgtccaaagggtgaaastgaattcctctaatttacacgtgg

SEQ ID NO: 103289 - DNA, 50 bp, homo sapien
atttttctgtggggttgttaatgcastccttgtcatattgttctagaatc

SEQ ID NO: 103290 - DNA, 50 bp, homo sapien
aaaagcactaatattctaaaaaaaamcagtcataatgtatagcagcatcc

SEQ ID NO: 103291 - DNA, 50 bp, homo sapien
accactggccctacctggtattttaygattcaggtgtcctcagtgaggtt

SEQ ID NO: 103292 - DNA, 50 bp, homo sapien
accagtttcatgagcttctactaccragatgctttggaaaacatttataa

SEQ ID NO: 103293 - DNA, 50 bp, homo sapien
tatatctagacaagttagtgttaaaycaccaatgctatataaaaacagtt

SEQ ID NO: 103294 - DNA, 50 bp, homo sapien
gaacactgtgtagggaaacctatgcmcgtcatgctttacttcctttagac

SEQ ID NO: 103295 - DNA, 50 bp, homo sapien
agaagagtagttctaatctgcccagragtgcctacgttattgcaaggttt

SEQ ID NO: 103296 - DNA, 50 bp, homo sapien
atgtattgagttggtgtaaacataaytgccattttttgctattagtttta

SEQ ID NO: 103297 - DNA, 50 bp, homo sapien
taaattatgcctgagtacggagaacrgattattttgtttcattaaatctt

SEQ ID NO: 103298 - DNA, 50 bp, homo sapien
tggaaatctagaatgctcaaaaagaygtgttatattcccattgctctctc

SEQ ID NO: 103299 - DNA, 50 bp, homo sapien
atcagaaaactgaacatagtcaagayggcaattctctccaaaactgatag

SEQ ID NO: 103300 - DNA, 50 bp, homo sapien
atatgtcctttctgtgaccaacgctrgacaaacatagctgagaatccccc

SEQ ID NO: 103301 - DNA, 50 bp, homo sapien
agaagatgatgatagaattaagaagsctatacatagtaaattttaaaaaa

SEQ ID NO: 103302 - DNA, 50 bp, homo sapien
cctggggaaggaggaaggcacgcacmaaatatctgttgtaactgaaagac

SEQ ID NO: 103303 - DNA, 50 bp, homo sapien
gaaaactcattcacagaagaacaacyacagatgcaaggtaaagttgggaa

SEQ ID NO: 103304 - DNA, 50 bp, homo sapien
aaccaaactgtgggcttctgaaaggwaggaaagctttagtcatcattgta

SEQ ID NO: 103305 - DNA, 50 bp, homo sapien
ctcaacttcatggaaataactatgckcaattttttttctagtaatgttat

SEQ ID NO: 103306 - DNA, 50 bp, homo sapien
tactatttactttcaaaacaagaacyggttgctccctgctataatattaa

SEQ ID NO: 103307 - DNA, 50 bp, homo sapien
atggagaaatttctgttgaatatgasaagatgcggttagaattataatat

SEQ ID NO: 103308 - DNA, 50 bp, homo sapien
ggtctacatcgtttataggttcaaastctcaattttcctttcagtaggtg

SEQ ID NO: 103309 - DNA, 50 bp, homo sapien
tggtatcactatcttctgatcaaaakttaaagatattcatttgaagaaca

SEQ ID NO: 103310 - DNA, 50 bp, homo sapien
cagagctgatgtatacatatatactyacacatagatttatatttattact

SEQ ID NO: 103311 - DNA, 50 bp, homo sapien
gtagttgctcacctaaaagccctaarttaccaaggaagtaataagaatta

SEQ ID NO: 103312 - DNA, 50 bp, homo sapien
ttactactgcaaaataagtgttaaartagaataacaaacaatggagtaat

SEQ ID NO: 103313 - DNA, 50 bp, homo sapien
aacacataagcaatcaaaagttcacyaatggtttaaaatgtatagtgtgc

SEQ ID NO: 103314 - DNA, 50 bp, homo sapien
catgaatctttactcatgatccctayggataactaaggattgatgctatt

SEQ ID NO: 103315 - DNA, 50 bp, homo sapien
cagagggcacaccatttaccaaggcygtgaaagtatgctggtgaggggac

SEQ ID NO: 103316 - DNA, 50 bp, homo sapien
cttatggttgttgtgtgactctaaaygtttacttgaacatgctagcgagc

SEQ ID NO: 103317 - DNA, 50 bp, homo sapien
agatttgctgactcatgttagtgtgkatcctcttaatatgcaggtctgtt

SEQ ID NO: 103318 - DNA, 50 bp, homo sapien
gaagtcaagctgaaaatggagagcarctatactaaagcccaatccgaggt

SEQ ID NO: 103319 - DNA, 50 bp, homo sapien
cttgatatagtactgggtttcaagaytaggaccaagaaatgtaagcagta

SEQ ID NO: 103320 - DNA, 50 bp, homo sapien
ttgattcattggaggtctttatgctwctcattcctacacctctgggcttt

SEQ ID NO: 103321 - DNA, 50 bp, homo sapien
accaagattgttatcttcaggttagrttgtcactgtggaagtgcaggagt

SEQ ID NO: 103322 - DNA, 50 bp, homo sapien
acattataacaattataaaatgaaaragttgacttatggagctatcgaga

SEQ ID NO: 103323 - DNA, 50 bp, homo sapien
ccattaataaaaagatttgcataacraactaagtgacaacttatgcatat

SEQ ID NO: 103324 - DNA, 50 bp, homo sapien
ggaacaagccagacctttggaaacaygcctgttcagatatcggtgtctgc

SEQ ID NO: 103325 - DNA, 50 bp, homo sapien
tgggttcatgagattacatgtttgaraaaattcataaaacaatgcaaaac

SEQ ID NO: 103326 - DNA, 50 bp, homo sapien
caaaggcatagaggaaccttaaatgmaaattgctaagtaaaagaggtcag

SEQ ID NO: 103327 - DNA, 50 bp, homo sapien
tttctccctaaaagacgttatgctasatacaagggacagtgaaatgcgat

SEQ ID NO: 103328 - DNA, 50 bp, homo sapien
cctctattttgaaatggtataatagragtgccaataaagatatatactgt

SEQ ID NO: 103329 - DNA, 50 bp, homo sapien
tttttgttgttgttgtgcaattattyaacactcccacttttaacagtaga

SEQ ID NO: 103330 - DNA, 50 bp, homo sapien
ctcattttttgtagttctcagaaaaycctcttttataacatctgtgtcca

SEQ ID NO: 103331 - DNA, 50 bp, homo sapien
ccttgtcaaagaccagatggctgtaraggtgtgaatttatttctgggttc

SEQ ID NO: 103332 - DNA, 50 bp, homo sapien
agattatgctgatccaacaatcttcrtttgggagtatcaggaaaaacttc

SEQ ID NO: 103333 - DNA, 50 bp, homo sapien
catagataatttgaaagttcatccartaaacaatcagtaagccctgttaa

SEQ ID NO: 103334 - DNA, 50 bp, homo sapien
ctgaactgcttgctcatcagaaatayggccccaaagtggatgtctggttc

SEQ ID NO: 103335 - DNA, 50 bp, homo sapien
gatagaatagcctacagagtcctaartgttcagagaatgtgagaaagcct

SEQ ID NO: 103336 - DNA, 50 bp, homo sapien
cagtattactcaatcaaaagcctgaragatttacaaatggacagaccaag

SEQ ID NO: 103337 - DNA, 50 bp, homo sapien
tctttatcctaattcatattccttcmattgtaccaggggtgatattgctt

SEQ ID NO: 103338 - DNA, 50 bp, homo sapien
aatatttctaaaatactcctattackcatgttgtttgatacactgctttg

SEQ ID NO: 103339 - DNA, 50 bp, homo sapien
ctgatacatgaccactcttgacatcygatctgagttctcattctctacca

SEQ ID NO: 103340 - DNA, 50 bp, homo sapien
agggtaaaatgttcagataaatataygagaagttgattatttgtccatct

SEQ ID NO: 103341 - DNA, 50 bp, homo sapien
ccatttgcattagtacaaaggaatamctgagagtaggtaatttataaaga

SEQ ID NO: 103342 - DNA, 50 bp, homo sapien
aattattttgtcaattatatctcaamgttattttaaaaatgcaattcagt

SEQ ID NO: 103343 - DNA, 50 bp, homo sapien
taaatatggcaatagatgatgaatayaggatttctttgataagtctccag

SEQ ID NO: 103344 - DNA, 50 bp, homo sapien
gaaaacagcacctacataagagaaamctttatgtcctgggatatgttcag

SEQ ID NO: 103345 - DNA, 50 bp, homo sapien
gagtgaaacagagatttcacatccakaggttaattaagccattttctatg

SEQ ID NO: 103346 - DNA, 50 bp, homo sapien
tgaaatcaactgcatccacactagcraaattctgataccaaaggacacat

SEQ ID NO: 103347 - DNA, 50 bp, homo sapien
tctgttcttcacataattgctctcckcatgtaggtaaagtcacagacatg

SEQ ID NO: 103348 - DNA, 50 bp, homo sapien
taataggaatgagtcagagtggagcygataatcggaatgagtcagggtgg

SEQ ID NO: 103349 - DNA, 50 bp, homo sapien
acaggctaaactaattccgcttggcyaatttaaagagaatgacagggtga

SEQ ID NO: 103350 - DNA, 50 bp, homo sapien
tcctcagcaaggcaatgtaattctayagaagggtgcttgcttacagatgg

SEQ ID NO: 103351 - DNA, 50 bp, homo sapien
ttttctctccaagaaggttttgaacyctgaatctcaggaactctttccat

SEQ ID NO: 103352 - DNA, 50 bp, homo sapien
tttaatcctcttcaatatatacccartgcagactctgaattctgttattc

SEQ ID NO: 103353 - DNA, 50 bp, homo sapien
ctgagttaacacttctatccactatraaccagaggtcactccacaaagat

SEQ ID NO: 103354 - DNA, 50 bp, homo sapien
tgacgaacaccaagcaagaaattggraagtaataggtcaagttaattagt

SEQ ID NO: 103355 - DNA, 50 bp, homo sapien
tgggagtaacaaaaaccaaggtgaaygatactgagggaattaaattacaa

SEQ ID NO: 103356 - DNA, 50 bp, homo sapien
tatgttaataaattgaaaatatgacwcttaaaacaagctcaattttatct

SEQ ID NO: 103357 - DNA, 50 bp, homo sapien
tctactttttcctcatgtaacttaaytcggtttactatatgcttaaagaa

SEQ ID NO: 103358 - DNA, 50 bp, homo sapien
tggggccatttccagaataggtaatraagagatatcacaaaggaccaatc

SEQ ID NO: 103359 - DNA, 50 bp, homo sapien
ttgttttctgtgtgcatgacagatcrttctctaaccctttactttgagtc

SEQ ID NO: 103360 - DNA, 50 bp, homo sapien
gacaagagtaccatacatgtactacraattggtacttattctgaggcagg

SEQ ID NO: 103361 - DNA, 50 bp, homo sapien
tagaaagttaagaaggagcctatcakgtttatcttttttttttttttttt

SEQ ID NO: 103362 - DNA, 50 bp, homo sapien
taaaaaaaagaaagttaagaagaagyctaagtattttattagaaagttaa

SEQ ID NO: 103363 - DNA, 50 bp, homo sapien
atatataatcattccaatgccaaaayggaaagtcaagattctggtccccc

SEQ ID NO: 103364 - DNA, 50 bp, homo sapien
aaggaaactatgcccagtcttacatkaaggttaagaagcatggctggtga

SEQ ID NO: 103365 - DNA, 50 bp, homo sapien
tccatgttcctctttgttgacaacayactagtctctccaactatcactac

SEQ ID NO: 103366 - DNA, 50 bp, homo sapien
cttatctgataacataagatatactsactctgcatcatagtatttaagta

SEQ ID NO: 103367 - DNA, 50 bp, homo sapien
gtttttctcatagccaggattcatasgtctaggaatcaaggggtggaaat

SEQ ID NO: 103368 - DNA, 50 bp, homo sapien
gataagaaaaaaatacaagtttaaaycatatgagaacaatgaagtaagaa

SEQ ID NO: 103369 - DNA, 50 bp, homo sapien
tgaagtaagaaggaatgatataaaasagaagtagaaaaccactattatca

SEQ ID NO: 103370 - DNA, 50 bp, homo sapien
tatctgtccaccaaatccatgatgcwctcttgtaatgccatggtttttgt

SEQ ID NO: 103371 - DNA, 50 bp, homo sapien
ggtaacagcaagataaaaaggcatgyaagtatgagagtgtggttttcaca

SEQ ID NO: 103372 - DNA, 50 bp, homo sapien
aaactaatataccaccatactttgcrgatgaccagagctggctaaaatcc

SEQ ID NO: 103373 - DNA, 50 bp, homo sapien
ctaattattcactggcctctaattaygtcatctcctaaaatactatataa

SEQ ID NO: 103374 - DNA, 50 bp, homo sapien
gtttgagaaaaatctacttgaaaaayttcacaaatagatgaaagaaactt

SEQ ID NO: 103375 - DNA, 50 bp, homo sapien
tacattctgactattagctccatcaygatattgaaattgctctcttgaat

SEQ ID NO: 103376 - DNA, 50 bp, homo sapien
attgctctatgaggagtgcatagacyacaatagattttaatagctattta

SEQ ID NO: 103377 - DNA, 50 bp, homo sapien
taaaggcagagcaagaaatctggtayaaactcatgcaaaattatggctgt

SEQ ID NO: 103378 - DNA, 50 bp, homo sapien
aaagcagatcaaaagcaaatttgcarcatctacaaaagtaaaaacgagca

SEQ ID NO: 103379 - DNA, 50 bp, homo sapien
ggatgaactacctatggcaccagaaraggcagcagctgaaggcacagagc

SEQ ID NO: 103380 - DNA, 50 bp, homo sapien
tgaatttccagtacttaagatatagratactctacctcactcctatttag

SEQ ID NO: 103381 - DNA, 50 bp, homo sapien
agtttcactgccttgaagatttataygtctacgcacaaatttagacaacc

SEQ ID NO: 103382 - DNA, 50 bp, homo sapien
gtacatgagtactacaagcatgccaygtgaaataagcaaatcatggagaa

SEQ ID NO: 103383 - DNA, 50 bp, homo sapien
tggatggagtgagataattcaagaaygtaatacctgttgcaatatgtgag

SEQ ID NO: 103384 - DNA, 50 bp, homo sapien
ctcacagttacagtgtattatgggckaaagatacacattaaaatctcaca

SEQ ID NO: 103385 - DNA, 50 bp, homo sapien
tctaaaatatgatgagtgatatttakgagaagaatcagaagaagactaag

SEQ ID NO: 103386 - DNA, 50 bp, homo sapien
aatagaacaggcttggaataaaagaygacttcagatttggacatatggaa

SEQ ID NO: 103387 - DNA, 50 bp, homo sapien
taagattacctagagagctccttaaracatagattattgggcattacatc

SEQ ID NO: 103388 - DNA, 50 bp, homo sapien
catgccagtgacaattttttattcarcaggactctcttacacatatgctg

SEQ ID NO: 103389 - DNA, 50 bp, homo sapien
cactaaacagacacactcactgaackaaaaagaggagaattgctgaagtc

SEQ ID NO: 103390 - DNA, 50 bp, homo sapien
cttaaatatgatgctaccctaagacmctgaaaatagagctgatctacttg

SEQ ID NO: 103391 - DNA, 50 bp, homo sapien
tccagatcaattatatctattagctmtaccaaggttacttcctattgttg

SEQ ID NO: 103392 - DNA, 50 bp, homo sapien
atagcaatactaagtgttcctttacrgacttaaaacataaatgcattagt

SEQ ID NO: 103393 - DNA, 50 bp, homo sapien
ctgcaggaatacattaagtaattcartggaaacataccttcttgttaata

SEQ ID NO: 103394 - DNA, 50 bp, homo sapien
aaacaacctaaccatgcaacccacgraactagaaaagcaataacaaataa

SEQ ID NO: 103395 - DNA, 50 bp, homo sapien
taaatgttctttggagaaaatcaagscaatttgtagcaggtacttttaag

SEQ ID NO: 103396 - DNA, 50 bp, homo sapien
acataagaaaggattgcataatattkaaactgcttgtattggaatgaagt

SEQ ID NO: 103397 - DNA, 50 bp, homo sapien
tgtacccaagagaattgaaagcttaygtccatacaaaaacttatgcatgc

SEQ ID NO: 103398 - DNA, 50 bp, homo sapien
ttttattaaagtcttgtttaaaatamgagaaacatcagtggtcaatggaa

SEQ ID NO: 103399 - DNA, 50 bp, homo sapien
gttttgaggagctttcaggcctagaycctaattcatttctccccagtacc

SEQ ID NO: 103400 - DNA, 50 bp, homo sapien
agtggctgtggttccagtcttcccartggaatgaagccaatctagaaaaa

SEQ ID NO: 103401 - DNA, 50 bp, homo sapien
atggatttctatggatacagaaataygaatttttagacacaccattggaa

SEQ ID NO: 103402 - DNA, 50 bp, homo sapien
gaataagaacatttatttcagctatsaggacagaagaaaatttgcttggg

SEQ ID NO: 103403 - DNA, 50 bp, homo sapien
tagccctttaaaaaactggctgtccrtaattggtaaacatgaataactca

SEQ ID NO: 103404 - DNA, 50 bp, homo sapien
tcagccttgtacttcctgatttaaayagacattgttgaaaatacagtttc

SEQ ID NO: 103405 - DNA, 50 bp, homo sapien
aataacataaaagaatatatagtgaygttccaaactgagaagtaaagaca

SEQ ID NO: 103406 - DNA, 50 bp, homo sapien
gactcacagttccctagagtagcctyatccacagggtgttgtctatttga

SEQ ID NO: 103407 - DNA, 50 bp, homo sapien
tctctggaaagtgatcaaaggcttayaacatctgaagaactgaaaaactg

SEQ ID NO: 103408 - DNA, 50 bp, homo sapien
acctccagaaatccattcttctatgmaagtcatgaaaatactggcaaaac

SEQ ID NO: 103409 - DNA, 50 bp, homo sapien
gccctctactcttgttctataaaaakaagagagcattggcaggttgcact

SEQ ID NO: 103410 - DNA, 50 bp, homo sapien
taagatgagaaagcagcatacagaamacttcaaaggcaagagcaatgtgc

SEQ ID NO: 103411 - DNA, 50 bp, homo sapien
agactgtgcatggatcaatgacatartattcccattcatgtgggaagcac

SEQ ID NO: 103412 - DNA, 50 bp, homo sapien
gccacagtatttgggcaaaggaaaascaaatgaagatcaagaataaacaa

SEQ ID NO: 103413 - DNA, 50 bp, homo sapien
gtgttcccccttaccttctacacgckaggtataaaatcctgggagccagg

SEQ ID NO: 103414 - DNA, 50 bp, homo sapien
tcttctgcctcacagcccttcttgaktatggagccttccctagacccaat

SEQ ID NO: 103415 - DNA, 50 bp, homo sapien
gacttcctttttattgcgtctaaagmactaatctcttaaagacaataatg

SEQ ID NO: 103416 - DNA, 50 bp, homo sapien
tcaccagtgtacctgacatataatargtgattaataaattcagacactac

SEQ ID NO: 103417 - DNA, 50 bp, homo sapien
ttactaagtgatttataactgttaargtgatcgaagaaggtaatttagcc

SEQ ID NO: 103418 - DNA, 50 bp, homo sapien
tataaatgacatgataaaaatcctaygaacaactccatactaatacattt

SEQ ID NO: 103419 - DNA, 50 bp, homo sapien
agctccgcgggatccgcaccaactamcgtgccgcactgacattcccagga

SEQ ID NO: 103420 - DNA, 50 bp, homo sapien
aattttgcttctattaatattgaggsctttttatctgaggttcttcatgg

SEQ ID NO: 103421 - DNA, 50 bp, homo sapien
attgttccatggaagaaaaaaattcyatccgtaatgtctatccttggaaa

SEQ ID NO: 103422 - DNA, 50 bp, homo sapien
tccccattttacagatgcatgccaayaataaagtcaagagaagtttaata

SEQ ID NO: 103423 - DNA, 50 bp, homo sapien
acaaaagtgaggtgtcgctgactgaygcataattatggtggacagaaaaa

SEQ ID NO: 103424 - DNA, 50 bp, homo sapien
gggaggttaagacagcctaattatawgtttgtgcaggagaaaacaccatg

SEQ ID NO: 103425 - DNA, 50 bp, homo sapien
cggagctgttcctatttggtcatctyacctgggaatcgataattttttaa

SEQ ID NO: 103426 - DNA, 50 bp, homo sapien
tagttacttagaattgcctggaaatktgacggtccgggaatagtttgaaa

SEQ ID NO: 103427 - DNA, 50 bp, homo sapien
agcccaagttatagcagtagcctgawttctggaatagagttatttagtgc

SEQ ID NO: 103428 - DNA, 50 bp, homo sapien
tgagaaagggacatgttattcttagmgattatgtcaggaataaggatccc

SEQ ID NO: 103429 - DNA, 50 bp, homo sapien
tactaccttttctggtttctatagcyctttggtcattttagtatttatag

SEQ ID NO: 103430 - DNA, 50 bp, homo sapien
tctttccctcaggatattcagagtgyactttaggagtagatgcatacatg

SEQ ID NO: 103431 - DNA, 50 bp, homo sapien
ctatctctcagctcttggaagtaccraaacaccttgcttttcttcctgtg

SEQ ID NO: 103432 - DNA, 50 bp, homo sapien
tgcaagggaaggaaggtgtggcccaragtcccaatctaggtgagcaagag

SEQ ID NO: 103433 - DNA, 50 bp, homo sapien
agtacattttaccagaaagaagagcrctttaaaaggcttctcactagcag

SEQ ID NO: 103434 - DNA, 50 bp, homo sapien
gatgcatagttgtcacagtcattagwaagatagtataaggtctctgcaag

SEQ ID NO: 103435 - DNA, 50 bp, homo sapien
tatctaagtgcactatgcctgtgatktgactaacttttataatcttccat

SEQ ID NO: 103436 - DNA, 50 bp, homo sapien
gagtttaattgactggttacctctaygcagtgctagataagcatggttca

SEQ ID NO: 103437 - DNA, 50 bp, homo sapien
aagaccaaaaaggcatagtccctgayatgtaggcgcccataatctggaag

SEQ ID NO: 103438 - DNA, 50 bp, homo sapien
cacaaatttgagctattaaacgtccraccttgaaaattcagtgtgcctgt

SEQ ID NO: 103439 - DNA, 50 bp, homo sapien
atattacatgattaattgtaaaggcycaatataaagtagacaatatatct

SEQ ID NO: 103440 - DNA, 50 bp, homo sapien
atttatttatttaaccctcaaatcawtattcatgctttggctgtcattca

SEQ ID NO: 103441 - DNA, 50 bp, homo sapien
gaattgctatctttccattccttaarctaatatttcaaaactaaatgtta

SEQ ID NO: 103442 - DNA, 50 bp, homo sapien
aggttatccatcaactgcttacagawccattggagtattttaatcaaagg

SEQ ID NO: 103443 - DNA, 50 bp, homo sapien
tttgaattttttataactctctggcraactaaatctttttttttaaatta

SEQ ID NO: 103444 - DNA, 50 bp, homo sapien
cttaaattttatttctatatttaacygatttaagcatctgccttcatgct

SEQ ID NO: 103445 - DNA, 50 bp, homo sapien
aataatacagtttagaagcatctgasaaattatctttcattaaaaggtag

SEQ ID NO: 103446 - DNA, 50 bp, homo sapien
acacagagtgagccctaatagaaacygtggattttagtgtataataacat

SEQ ID NO: 103447 - DNA, 50 bp, homo sapien
tggggttcaagcagttttattttgaygaatctccaaaggtgatctagaaa

SEQ ID NO: 103448 - DNA, 50 bp, homo sapien
aataacagaatgtgatgagtccttaygcctgcttgaagaatgctgcatca

SEQ ID NO: 103449 - DNA, 50 bp, homo sapien
ttcaacagtctcaatttctttcaatkaatatgattttctcttgtccttaa

SEQ ID NO: 103450 - DNA, 50 bp, homo sapien
gtgtctcaaaacattatctggcacasagaaaaagggcaatagcattccta

SEQ ID NO: 103451 - DNA, 50 bp, homo sapien
ggaataattattagtattttccaaayttattgtactaccagtcctattta

SEQ ID NO: 103452 - DNA, 50 bp, homo sapien
taagcaaagctacagagattgagcasaggtttcatggtttttcagaaaac

SEQ ID NO: 103453 - DNA, 50 bp, homo sapien
ctatgagaaactacggtcagtgttasagctgcttaataatatttccagga

SEQ ID NO: 103454 - DNA, 50 bp, homo sapien
gatttaaacaaatgttttgtacaacrgtaagattttaatgatactgtgaa

SEQ ID NO: 103455 - DNA, 50 bp, homo sapien
atatatatgtctataattttctatargagagccagaaaaaaattggcctg

SEQ ID NO: 103456 - DNA, 50 bp, homo sapien
atgcactgagagcagctgagagggcrctaatatctcataagagagagaac

SEQ ID NO: 103457 - DNA, 50 bp, homo sapien
tgttccacatctgtgcaaaaacgcawtcacattacgtaagcagaagaaat

SEQ ID NO: 103458 - DNA, 50 bp, homo sapien
ggagctattaataatttctcagataygatctcatgtattaactcagcaca

SEQ ID NO: 103459 - DNA, 50 bp, homo sapien
gcataactctaaaatgtcttaaaatsatgagtataaacaattacatagct

SEQ ID NO: 103460 - DNA, 50 bp, homo sapien
ttcacttttaacacatttaaagataraaactcactgcaaacaccaaaata

SEQ ID NO: 103461 - DNA, 50 bp, homo sapien
agatggtcaagcctcagggtatttcraggcataaaggtgaggataataga

SEQ ID NO: 103462 - DNA, 50 bp, homo sapien
tcctacccaagtgttactggtggaaygtcatgactatcagttgtccaggt

SEQ ID NO: 103463 - DNA, 50 bp, homo sapien
gagcaggtctgggaataaggaagtaygagggagacttggtacccactgct

SEQ ID NO: 103464 - DNA, 50 bp, homo sapien
ccactgaaggacatttcactgttgaytatcctgggccaacatttctagaa

SEQ ID NO: 103465 - DNA, 50 bp, homo sapien
tatctttagatacagtatggttggawcttacaaggaaacaggttcttcaa

SEQ ID NO: 103466 - DNA, 50 bp, homo sapien
aggtgtaattaggagtcagaggcttraagaaggaacggctttctcaatat

SEQ ID NO: 103467 - DNA, 50 bp, homo sapien
atgtaaagcaagaaacttcagagaaygatttcttaagcactactgctatt

SEQ ID NO: 103468 - DNA, 50 bp, homo sapien
gtgtgtgtgtgtgttatgcttaacartcagcctattaaatagctaagact

SEQ ID NO: 103469 - DNA, 50 bp, homo sapien
ggatttatacatcttggtgatagcaragcacttaacgcacagcttttgtt

SEQ ID NO: 103470 - DNA, 50 bp, homo sapien
gggaaagatgattcaggagggctagragtgtccaaaacaaagttcacatg

SEQ ID NO: 103471 - DNA, 50 bp, homo sapien
acctgcatcaaggtttatggtttcaytcgaaaaactgcctccaaaagaaa

SEQ ID NO: 103472 - DNA, 50 bp, homo sapien
cactgtataaaggaaattagagatawtagtgttattcccatcacacagaa

SEQ ID NO: 103473 - DNA, 50 bp, homo sapien
tactctgtatactccacgaaatctaygcacttgtccaaagtgtttgttct

SEQ ID NO: 103474 - DNA, 50 bp, homo sapien
gttcatttctcaatgagttatctaartagttgcaactgcataaattcaac

SEQ ID NO: 103475 - DNA, 50 bp, homo sapien
tgaaagtagggatttatggctctctracttagacaatttcgttcatcaaa

SEQ ID NO: 103476 - DNA, 50 bp, homo sapien
gaggcttgaccatcttttgacaccargaagtatgggaactcgtgaaggcc

SEQ ID NO: 103477 - DNA, 50 bp, homo sapien
agaaatggacgacacctcataaaaaygatgaaaagcagtatcctactagc

SEQ ID NO: 103478 - DNA, 50 bp, homo sapien
tgatattataggggactctataaaaycctgtaaaatcttgactctctact

SEQ ID NO: 103479 - DNA, 50 bp, homo sapien
ataaaattagaaatgaaagggaagayattatagcagagaaatacaggtta

SEQ ID NO: 103480 - DNA, 50 bp, homo sapien
ttgcttggggctaagaggaaggatcractgtgaatggcaaaagggaacat

SEQ ID NO: 103481 - DNA, 50 bp, homo sapien
gctaaagattcaagtatacacttaarcatcatctcaaagcaggtaatatt

SEQ ID NO: 103482 - DNA, 50 bp, homo sapien
tgttcttgttttttcctgactgccarctatgtgaagaacatccacagtac

SEQ ID NO: 103483 - DNA, 50 bp, homo sapien
accacatttagaaattgagttcacartaatcttcaccttatttagtttta

SEQ ID NO: 103484 - DNA, 50 bp, homo sapien
gcgtaaaatattccaaataattctamaggcgcttgattcacagactagga

SEQ ID NO: 103485 - DNA, 50 bp, homo sapien
tcagagcttaattaaagaccactcastccataatgaaagagctaccataa

SEQ ID NO: 103486 - DNA, 50 bp, homo sapien
aaatgatcctcagacactgttatggmaacccctatttataaaaactagaa

SEQ ID NO: 103487 - DNA, 50 bp, homo sapien
gaggctttgtcttcagattgtcagawaagtagctttagccattctggcct

SEQ ID NO: 103488 - DNA, 50 bp, homo sapien
tatgggagcttaagcctcacatcctraaaacggtactggtgctggcttgg

SEQ ID NO: 103489 - DNA, 50 bp, homo sapien
tagagacgggtcaatctgagcatgaygatgaggtaagggacacaacaatg

SEQ ID NO: 103490 - DNA, 50 bp, homo sapien
gcatgacgatgaggtaagggacacarcaatggtgattaggaagattttct

SEQ ID NO: 103491 - DNA, 50 bp, homo sapien
tcttgccctcccctgacagtgacctrgtaacatccaaaaggaccagtgaa

SEQ ID NO: 103492 - DNA, 50 bp, homo sapien
agttgtagaatattgaatctgaggamatttcttgagttatcagcttcaag

SEQ ID NO: 103493 - DNA, 50 bp, homo sapien
ctttaccaactactctgatctaattsaagtttgtctttgaaggaaaaaaa

SEQ ID NO: 103494 - DNA, 50 bp, homo sapien
aaaaaaaaatgttggagaatagaaaractatagtaattttgcagtcctga

SEQ ID NO: 103495 - DNA, 50 bp, homo sapien
gaacactgtgagccaatttcacttayaactgtagatacctaaatttaaat

SEQ ID NO: 103496 - DNA, 50 bp, homo sapien
aaaaatggaccaaagcaatttccaaraggagtaaggccagaggtgcggaa

SEQ ID NO: 103497 - DNA, 50 bp, homo sapien
aataaatgtgatcactgttgcaactsaattaatggcaaacatattcatgt

SEQ ID NO: 103498 - DNA, 50 bp, homo sapien
gcaataaataactcaaaaataaggtwaataacacatctttaataaaaagg

SEQ ID NO: 103499 - DNA, 50 bp, homo sapien
tagctttcttaacttcctaatctaarcctgcattattactttaatatgaa

SEQ ID NO: 103500 - DNA, 50 bp, homo sapien
tgctcatttaccattccaaaatggtsaatcctagaggccttaagaattat

SEQ ID NO: 103501 - DNA, 50 bp, homo sapien
aaaaattagtagtatttctgtatgcygatagtgaacaatctgaaaaagaa

SEQ ID NO: 103502 - DNA, 50 bp, homo sapien
aatgagaaacctaaagaattagcatyaagatttttactagactttgacat

SEQ ID NO: 103503 - DNA, 50 bp, homo sapien
tcttcccttcttttcatttttttcaytaaagaaactgtgatgtcatcaat

SEQ ID NO: 103504 - DNA, 50 bp, homo sapien
ccatccaaatgctttcaactttcctragaactctctcagattctttaaaa

SEQ ID NO: 103505 - DNA, 50 bp, homo sapien
gtgggcaggtaggaaggttgtaacaygggagagtcttccatctggaattg

SEQ ID NO: 103506 - DNA, 50 bp, homo sapien
tcttataaatgtaacagtggcttaayagtccaaaaaacatcaaactttgt

SEQ ID NO: 103507 - DNA, 50 bp, homo sapien
caagatgaaaagaacttgtctgaacraatttatggcctggaatttctaca

SEQ ID NO: 103508 - DNA, 50 bp, homo sapien
aagccaaggacatatcaacaatttcracttggtctctggtctcactggtc

SEQ ID NO: 103509 - DNA, 50 bp, homo sapien
agtcttctatgttgtaatccacataygctaactagaagtgatgtttgatc

SEQ ID NO: 103510 - DNA, 50 bp, homo sapien
catctatggggggaaaagctttatascactaattgtgaacttaatattaa

SEQ ID NO: 103511 - DNA, 50 bp, homo sapien
aggaagagtttatggtcagaaattamaaattggtagccagccatcacaga

SEQ ID NO: 103512 - DNA, 50 bp, homo sapien
tgaaatgagagtaagttttttgctgsacatttaatggttataaggaaaat

SEQ ID NO: 103513 - DNA, 50 bp, homo sapien
aaatttgttgtacatggttcataccrgcttgattgcttttataaagtgaa

SEQ ID NO: 103514 - DNA, 50 bp, homo sapien
ggaggatagtgtctatgttagtgtcrcagggaagcagtagcagtccacat

SEQ ID NO: 103515 - DNA, 50 bp, homo sapien
tccctatacgtaggctacaagagcayaatactcctattttccatcttggt

SEQ ID NO: 103516 - DNA, 50 bp, homo sapien
aagaaaggtttacaaacattagttaycgaccggctcttgaaccaaatata

SEQ ID NO: 103517 - DNA, 50 bp, homo sapien
ccaattctagatagcacagattaacygtcatacaaatgtattttaaagtg

SEQ ID NO: 103518 - DNA, 50 bp, homo sapien
gagcctataatattgcttagctgccraagcagagttgtatcatgttgaac

SEQ ID NO: 103519 - DNA, 50 bp, homo sapien
cactaagccaggtatcacacagttamgtcttaatcagtattattcagttg

SEQ ID NO: 103520 - DNA, 50 bp, homo sapien
gtcatttggattcttactgaaggtayacaattagcctacggatgatgacc

SEQ ID NO: 103521 - DNA, 50 bp, homo sapien
ttagtgtatgtcctttctcacccacrggaaatcaactttcagatggaaag

SEQ ID NO: 103522 - DNA, 50 bp, homo sapien
tcctttttccactattaatatttaaygtttggcaaataatttaaagtacg

SEQ ID NO: 103523 - DNA, 50 bp, homo sapien
ataactatttaagatcactagtttcrcgatttatcctttttccactatta

SEQ ID NO: 103524 - DNA, 50 bp, homo sapien
taggaatttatgatattaacaatcargagcctagaaaacattccaggaga

SEQ ID NO: 103525 - DNA, 50 bp, homo sapien
aatatttttcatttgtattgtttcayatgagagatgtccagttcaaaata

SEQ ID NO: 103526 - DNA, 50 bp, homo sapien
tgtttttacagctagaatattcaaaytgatcaaaagaaacactaataaag

SEQ ID NO: 103527 - DNA, 50 bp, homo sapien
tatataaaattaaactatctgctaartatgatgttaagcttttgctaagc

SEQ ID NO: 103528 - DNA, 50 bp, homo sapien
gtgctaaactatatttttaagtgaaycaatacatgaataattaaagtaag

SEQ ID NO: 103529 - DNA, 50 bp, homo sapien
aaacaaaaataaaattggcttaaaaygtatacagaggtattctaatatat

SEQ ID NO: 103530 - DNA, 50 bp, homo sapien
atggttcaagaatgtgccttaatctytgtatctcctgaaattcctcacac

SEQ ID NO: 103531 - DNA, 50 bp, homo sapien
ctttcctcagtttctccttgtagtcmgaattcataaatcttggaagctaa

SEQ ID NO: 103532 - DNA, 50 bp, homo sapien
gaataaaggaagcaagttattggctsaaggcaaacaaataccaagttgaa

SEQ ID NO: 103533 - DNA, 50 bp, homo sapien
cagggcatccccatcagccttacaascttatctcgttggattgcactagt

SEQ ID NO: 103534 - DNA, 50 bp, homo sapien
gcacatgggcctcctgaacaatctcktgtatctacagcttgataatgcca

SEQ ID NO: 103535 - DNA, 50 bp, homo sapien
gttgcagctgtctgtttttgagcgaygtctgtatgccttgcagaaccatc

SEQ ID NO: 103536 - DNA, 50 bp, homo sapien
attacagagcactaatagctttatarcactagattactactcctgaaaat

SEQ ID NO: 103537 - DNA, 50 bp, homo sapien
aaatcatgcaggaaagaaagggtagwagttgacaacatgtagtacttcct

SEQ ID NO: 103538 - DNA, 50 bp, homo sapien
tacaaaagacagatagttatggtagrataaaatattacaatgaagaaata

SEQ ID NO: 103539 - DNA, 50 bp, homo sapien
aatacatttgatttccagagaaacaktaagctgtgaaggttaagaaaaat

SEQ ID NO: 103540 - DNA, 50 bp, homo sapien
ttttgtccttacattacttcagagtsaaaatcttaggagagaaggtccaa

SEQ ID NO: 103541 - DNA, 50 bp, homo sapien
aagacatagagaagttattcaaaaawgatattacttcctatattattcca

SEQ ID NO: 103542 - DNA, 50 bp, homo sapien
tagttagcagctcccttgtgtattcwctatgtatgtaaaatctgtttgct

SEQ ID NO: 103543 - DNA, 50 bp, homo sapien
ccatccagtcacaagctcctcaatayaaaatagtctcagctttgtatcat

SEQ ID NO: 103544 - DNA, 50 bp, homo sapien
acctcatttcttagggaagactatayatggtgaatttgcaataggaaaag

SEQ ID NO: 103545 - DNA, 50 bp, homo sapien
tcttagacaaatcattccttcataartaaaaaatatctgaaatggtggta

SEQ ID NO: 103546 - DNA, 50 bp, homo sapien
aaatattagttatgagttctgtgcaygtaattaaaacaagagaacatgat

SEQ ID NO: 103547 - DNA, 50 bp, homo sapien
ccaggccacagcacatatccagttaygcaggacagaaatgagatgaaaca

SEQ ID NO: 103548 - DNA, 50 bp, homo sapien
gaaaatcaaatttgaatggaatgaasttattgatatggtctcactaagca

SEQ ID NO: 103549 - DNA, 50 bp, homo sapien
ttcagcaacaaaaattgtaaacataygtgatggcctgagcagggagaaac

SEQ ID NO: 103550 - DNA, 50 bp, homo sapien
ctgataatgtattttacagaaccatwactataatatattcccagagaatt

SEQ ID NO: 103551 - DNA, 50 bp, homo sapien
agttgaaagattttgtttaaaaagayattatggttgaagataagaataca

SEQ ID NO: 103552 - DNA, 50 bp, homo sapien
attcactgtcattaatatcgttatcyatgactgcttttaacatactttct

SEQ ID NO: 103553 - DNA, 50 bp, homo sapien
ctgaataaaagcaacacttgaatgasaccagaaatgtaacatttccaagt

SEQ ID NO: 103554 - DNA, 50 bp, homo sapien
aggaactagtgctatgaacttttgartagtaattaccaagcccatctaag

SEQ ID NO: 103555 - DNA, 50 bp, homo sapien
cttaaggcacagctaaagttccatcycttctatgacacttctatgattag

SEQ ID NO: 103556 - DNA, 50 bp, homo sapien
gcccactttattgcatctaagtacaytgctagtctcactgggagagttta

SEQ ID NO: 103557 - DNA, 50 bp, homo sapien
agaatccattcttgccttttcagctkcttctggctataggtattcctttg

SEQ ID NO: 103558 - DNA, 50 bp, homo sapien
gcttttaattttcctaactttctaarattcacaagccacatgtcagaatg

SEQ ID NO: 103559 - DNA, 50 bp, homo sapien
ttatatttgatgatttttcactttgratatctaggtagaatctattttcc

SEQ ID NO: 103560 - DNA, 50 bp, homo sapien
acttccattgcaaactggaggaagawcattttatttcatttatgactata

SEQ ID NO: 103561 - DNA, 50 bp, homo sapien
agaggttaaattaaatactggcatayctcgctttattgagcttcacttta

SEQ ID NO: 103562 - DNA, 50 bp, homo sapien
tcttttcttctaggattcagttcacmgctatttatttatcatttaaatgc

SEQ ID NO: 103563 - DNA, 50 bp, homo sapien
gtgtgcacatgtgtgtacgtgttccratggagaaaaagcactggaatatc

SEQ ID NO: 103564 - DNA, 50 bp, homo sapien
ggataaaaatttaggttgtttccaawcttgtgatattacaaacaatactg

SEQ ID NO: 103565 - DNA, 50 bp, homo sapien
actgtatatctatacctgttcttcaygcataaaaaaagaaagacttcttt

SEQ ID NO: 103566 - DNA, 50 bp, homo sapien
cagtgggaaatggtctcataaattgsaacagtttagtgaaaggaatgaaa

SEQ ID NO: 103567 - DNA, 50 bp, homo sapien
cttttgccctgctacttgcttacaayggatttagagactgagagtaactt

SEQ ID NO: 103568 - DNA, 50 bp, homo sapien
aggaaccaggacatacacttctaaaygaatactttttcaatccttttggg

SEQ ID NO: 103569 - DNA, 50 bp, homo sapien
ccaattgtgcttccatagacactgaygttcagttttgcttgttatttttt

SEQ ID NO: 103570 - DNA, 50 bp, homo sapien
caataagaggaaaatgtgatgtttgrtatggacgtgaaggcagggcagaa

SEQ ID NO: 103571 - DNA, 50 bp, homo sapien
ccagacaatgtctaaggcttgtagayaggataactcatttaaacctccaa

SEQ ID NO: 103572 - DNA, 50 bp, homo sapien
tgcttttcttatatgatctgtagaaytgggtgaccaaagagtagaggaag

SEQ ID NO: 103573 - DNA, 50 bp, homo sapien
aaaattagtcttcagtgtttgccaaygtaaagaagtcctggtacataccc

SEQ ID NO: 103574 - DNA, 50 bp, homo sapien
cagtatatttagactagcttcaacawtatatctcttttttgaatgagatg

SEQ ID NO: 103575 - DNA, 50 bp, homo sapien
gtttcttaaaatttcctagtacggastccagaattcctcagcagcatcct

SEQ ID NO: 103576 - DNA, 50 bp, homo sapien
atgactttttattttgctgataggcyagagaatgtattgagaagtttaca

SEQ ID NO: 103577 - DNA, 50 bp, homo sapien
gtacaattaattatgcattatcggaytccacagctgatgacattattcta

SEQ ID NO: 103578 - DNA, 50 bp, homo sapien
atgaaaaggcaaaatgacaacctaaycttctatttgtataggaatattca

SEQ ID NO: 103579 - DNA, 50 bp, homo sapien
gatagaagagttgaaaagggaaagcraaactcctcaagtagcttccttaa

SEQ ID NO: 103580 - DNA, 50 bp, homo sapien
atttacaaatttgtaatgatgacackacttattttaggtacacttttttc

SEQ ID NO: 103581 - DNA, 50 bp, homo sapien
taggttctttcctgcatttggctgtyagtgaagcggaagcagttgttttc

SEQ ID NO: 103582 - DNA, 50 bp, homo sapien
tctttagtcatgatttgatgaaagaygggcttttttctactcttgtattc

SEQ ID NO: 103583 - DNA, 50 bp, homo sapien
gtctcttatatatgataattttctaygggtaatttgacatgtatttgtag

SEQ ID NO: 103584 - DNA, 50 bp, homo sapien
gattgtgaaattcctcatatcctcayctattaaacttacatatattaaat

SEQ ID NO: 103585 - DNA, 50 bp, homo sapien
attcttatgtatgcctacttcgttcrctttgtcctttttctttttttatt

SEQ ID NO: 103586 - DNA, 50 bp, homo sapien
ggctttcggaaaatcaatgatgctaycgtaaagagtcttaaaaaatgttg

SEQ ID NO: 103587 - DNA, 50 bp, homo sapien
atgacctgtgaaaatttgcatgctayctataatttggtctaatgacttta

SEQ ID NO: 103588 - DNA, 50 bp, homo sapien
ttaatctgaaaatctgaaggaagtgrataataccagtcaacatggtgatg

SEQ ID NO: 103589 - DNA, 50 bp, homo sapien
atgtattcccaaaagcagctttctgyagtattcttgattgcaagctacat

SEQ ID NO: 103590 - DNA, 50 bp, homo sapien
cccctttcagggaatgtctcacggckaatcaaatgtcagttcccggtcaa

SEQ ID NO: 103591 - DNA, 50 bp, homo sapien
aagtactttcaagtgacctagctgasaagatcatacatttgctaaatatt

SEQ ID NO: 103592 - DNA, 50 bp, homo sapien
aataaagaacactgtttagttgcaarttctcattaactgaaaattaattt

SEQ ID NO: 103593 - DNA, 50 bp, homo sapien
gattactttcaccatcatctgcaacygagactaaaacaaataaacaaata

SEQ ID NO: 103594 - DNA, 50 bp, homo sapien
tgttaaagacattcttaatggaaacmagtcattactctccttcattaata

SEQ ID NO: 103595 - DNA, 50 bp, homo sapien
gctctcacatttcgatatggatcacrtgggtataatggggatatagatca

SEQ ID NO: 103596 - DNA, 50 bp, homo sapien
tctctccagaaaactgctagctttawggttatttgggctagtccaatagc

SEQ ID NO: 103597 - DNA, 50 bp, homo sapien
agacaaacagccctacctcgcagaasgaattttttaaactattagtaata

SEQ ID NO: 103598 - DNA, 50 bp, homo sapien
ttatagattgtagttttccactgaaygatctttttatctgttttgtcttt

SEQ ID NO: 103599 - DNA, 50 bp, homo sapien
aaagttttttttattgggttttacakaaatagatgcttagttgtgactga

SEQ ID NO: 103600 - DNA, 50 bp, homo sapien
agtgggagtaacttatagtatttcamgacgtatccatcttatatgaaaag

SEQ ID NO: 103601 - DNA, 50 bp, homo sapien
acacataacacaaagcagtatggtargaactctgaaaaggtattaaaatg

SEQ ID NO: 103602 - DNA, 50 bp, homo sapien
ctataaattatattattaactcaaawggtgacaataattgagagacagca

SEQ ID NO: 103603 - DNA, 50 bp, homo sapien
agataaaataggagaatgacttgacrgtatcaactagaaaggaaaattgt

SEQ ID NO: 103604 - DNA, 50 bp, homo sapien
ggagttgttcagtaatttcagattasaaatcaatttagagaaacaaaccc

SEQ ID NO: 103605 - DNA, 50 bp, homo sapien
tgcacctgctttcctattaggtaccraattcttcaggaggccagagacat

SEQ ID NO: 103606 - DNA, 50 bp, homo sapien
caatatagataaagctagttcaaaarcataattaattctactaagatttg

SEQ ID NO: 103607 - DNA, 50 bp, homo sapien
taaataagtatttttggattcctgcsatagaggttattaattgctttatg

SEQ ID NO: 103608 - DNA, 50 bp, homo sapien
tattttctgagctcttccaaggttcygtgcaccaaatcactattcaatta

SEQ ID NO: 103609 - DNA, 50 bp, homo sapien
tgttaacctttatcctaaccttcaartctgctaaagtgaagatttgttta

SEQ ID NO: 103610 - DNA, 50 bp, homo sapien
ggcttattgagggtcaacaccagacmaaagattatggaggcaaaaaaaag

SEQ ID NO: 103611 - DNA, 50 bp, homo sapien
taaggtttagaggtgtatgaagaccratcaaatggactcacttttctata

SEQ ID NO: 103612 - DNA, 50 bp, homo sapien
cttttatctagaaaattttatcccasaatggaaatcattatcctaaatta

SEQ ID NO: 103613 - DNA, 50 bp, homo sapien
caaaatatactagctatcaataagcrcaaagataatacaaattggtattg

SEQ ID NO: 103614 - DNA, 50 bp, homo sapien
gtaactatctaagtccaacagggaamaactctgaaggactgttctagttc

SEQ ID NO: 103615 - DNA, 50 bp, homo sapien
ctatgtagattgtttctaacaatacyataattccaagacactatttttca

SEQ ID NO: 103616 - DNA, 50 bp, homo sapien
tcaaaggagtcatgctaataagctcracaatattcaaataaaactggtcc

SEQ ID NO: 103617 - DNA, 50 bp, homo sapien
cttattgcttttttttgcaggccttragtatggcagaaaacatgatgtag

SEQ ID NO: 103618 - DNA, 50 bp, homo sapien
tatctactttgttagcccttggagayacaatggtgagtaaaccagacttg

SEQ ID NO: 103619 - DNA, 50 bp, homo sapien
aacttaagtagagtctatcactgaamggtaaatcttcttttataagacat

SEQ ID NO: 103620 - DNA, 50 bp, homo sapien
cagaataccaaagcagacattgtatkacagaacaacaaaataagataatc

SEQ ID NO: 103621 - DNA, 50 bp, homo sapien
agtagtttaaatgttatatccaatgygtatgtgcaatgccaacatacagc

SEQ ID NO: 103622 - DNA, 50 bp, homo sapien
gtttaattcaaacatttatcactcargactattgtgtcaaaaggaccata

SEQ ID NO: 103623 - DNA, 50 bp, homo sapien
ttgacatgactatggaatcattgtcrcacaacttaatatggtccttttga

SEQ ID NO: 103624 - DNA, 50 bp, homo sapien
agcaaaactagttaggctaaggatayggtgtataatatagcaaagaaagc

SEQ ID NO: 103625 - DNA, 50 bp, homo sapien
ctatattttggcaacttatgttttayaccttctaccaaaacattctttct

SEQ ID NO: 103626 - DNA, 50 bp, homo sapien
ttccaggctgcacagcttgtggctcsaaaaaagactccttccttttgctc

SEQ ID NO: 103627 - DNA, 50 bp, homo sapien
caagttgacagtttttaagcctaaaytctcaccattaactggactaacag

SEQ ID NO: 103628 - DNA, 50 bp, homo sapien
gagagcctcaaaataacatgaagtcrcactagaggtatttaaccagagct

SEQ ID NO: 103629 - DNA, 50 bp, homo sapien
tgggtttctgtgatgtggctgacaargagaggacctattctcatgtggaa

SEQ ID NO: 103630 - DNA, 50 bp, homo sapien
ccaagtgccagcagaacagtggctaygaaagaattgaagacttagaagtg

SEQ ID NO: 103631 - DNA, 50 bp, homo sapien
ctcaattgaggagcaataaacctcartcataggacattcattttttattt

SEQ ID NO: 103632 - DNA, 50 bp, homo sapien
cttccagcctccaaaattgtgagaartaagttagtgttatttatacatta

SEQ ID NO: 103633 - DNA, 50 bp, homo sapien
ttattacattttgggccacaagtcasatattgttataacaaaggtttcat

SEQ ID NO: 103634 - DNA, 50 bp, homo sapien
aggatctatttataatcctactttgwatattccttggtatcccatcctat

SEQ ID NO: 103635 - DNA, 50 bp, homo sapien
gatttcttacagcactcattctggcratagtcaggtatcatggcatgaaa

SEQ ID NO: 103636 - DNA, 50 bp, homo sapien
aaagccaccacatatacataacaaamatatcacacatatgcatcacacaa

SEQ ID NO: 103637 - DNA, 50 bp, homo sapien
gcagtaaatttagctttaaaactcakatctaacaaagtaacacacaacac

SEQ ID NO: 103638 - DNA, 50 bp, homo sapien
ttagggggataaatttaatctaaaayatgtacttgagaataggcaaagtg

SEQ ID NO: 103639 - DNA, 50 bp, homo sapien
atattataggagacgatgtcaaataytaaagcttcaataataagtggact

SEQ ID NO: 103640 - DNA, 50 bp, homo sapien
tagcaaccatactgataaatacctamacggataaactattaaatggacag

SEQ ID NO: 103641 - DNA, 50 bp, homo sapien
tctagatttaattttctaaggatgaygctttcttgggtgtcttttcgtca

SEQ ID NO: 103642 - DNA, 50 bp, homo sapien
ccataatgagcatactacctatggcrcagcaaaacaaagggtaatacttg

SEQ ID NO: 103643 - DNA, 50 bp, homo sapien
aagctcagtttctgctgattttacartaagtttcacagaaggaatttgac

SEQ ID NO: 103644 - DNA, 50 bp, homo sapien
cctggcacagaggctggaaatgagtrggtactgctaaaacaatgtggaat

SEQ ID NO: 103645 - DNA, 50 bp, homo sapien
taatataaagaatagcaagaatagayattggacttatgtaggcatggatt

SEQ ID NO: 103646 - DNA, 50 bp, homo sapien
agaagaaagcagaaatgattggtaaraatggttttcttgatcctcagttt

SEQ ID NO: 103647 - DNA, 50 bp, homo sapien
taccgtactctttaagtattatcaawtcaatatctgtttttttattattt

SEQ ID NO: 103648 - DNA, 50 bp, homo sapien
acccctgatcaactttaccattaatratactactgatcccttgaactttg

SEQ ID NO: 103649 - DNA, 50 bp, homo sapien
tatgtctgtaaagaagcatagaacayagtagtggctaggaagaggtcctc

SEQ ID NO: 103650 - DNA, 50 bp, homo sapien
tatccaacatgcatcagagagacccrgaaaaacagtagctcccttggtct

SEQ ID NO: 103651 - DNA, 50 bp, homo sapien
taaaaacatgcatgttttctacattrtcctccttagtgcagcataagttc

SEQ ID NO: 103652 - DNA, 50 bp, homo sapien
aaatcccagaaaacagttgaaagtcratttagaagaaggtgaatatttcg

SEQ ID NO: 103653 - DNA, 50 bp, homo sapien
agaggaacaaaccctttgttgcacartctatgaagcagcagaaacttctg

SEQ ID NO: 103654 - DNA, 50 bp, homo sapien
tggcacaaaagtcaatgcttatactraaaatccgctgaaggaggcctaag

SEQ ID NO: 103655 - DNA, 50 bp, homo sapien
ctgcaggggttaatataggctctaawgtcagatattgttggcacataatt

SEQ ID NO: 103656 - DNA, 50 bp, homo sapien
agggcactaatgaacatatctgacarggtttccaccaggccaggcctgct

SEQ ID NO: 103657 - DNA, 50 bp, homo sapien
gtacaaatggaatttacttagactaygtagagctacacatatttgaacgc

SEQ ID NO: 103658 - DNA, 50 bp, homo sapien
gccttagtctatatctcagaataccrccatctcaataatcgcaaattggc

SEQ ID NO: 103659 - DNA, 50 bp, homo sapien
gttctaagttataccaatagcaagaygtataaaatttgccaatttatcta

SEQ ID NO: 103660 - DNA, 50 bp, homo sapien
ttaaaattttttaaaagaaaatttakgttcacacaaaatctcacaaatat

SEQ ID NO: 103661 - DNA, 50 bp, homo sapien
actagtccttagaatttcaaccatamgtctcatttgaaattgcacagtcg

SEQ ID NO: 103662 - DNA, 50 bp, homo sapien
attcaaacacacatatatatatatgyaaactatgatagaaccccagctag

SEQ ID NO: 103663 - DNA, 50 bp, homo sapien
gaggatagaattaagccagggaaacrcataaaaggatggatttaggagat

SEQ ID NO: 103664 - DNA, 50 bp, homo sapien
tctgcagagagaaaatacagttccaraagcgctgacttcactaaggccat

SEQ ID NO: 103665 - DNA, 50 bp, homo sapien
ctcagatggagaaatagagaaacaaygatgaaaagacttatctgtcatta

SEQ ID NO: 103666 - DNA, 50 bp, homo sapien
gataagagagctagttaggggctagyataatagtttggaataaagtaacc

SEQ ID NO: 103667 - DNA, 50 bp, homo sapien
tttgcttcctagttttttcacctacraaatagagatgttttattaataga

SEQ ID NO: 103668 - DNA, 50 bp, homo sapien
aaagaataacaaatgaagagtacgaygaaagtacatatctttataaaatt

SEQ ID NO: 103669 - DNA, 50 bp, homo sapien
cctttctttctcctgttatactttcyacttgattaatggcttatttcctt

SEQ ID NO: 103670 - DNA, 50 bp, homo sapien
agtaaataacagctgtcacatatttycattttgtactggagacgacagtg

SEQ ID NO: 103671 - DNA, 50 bp, homo sapien
cactattaaagatgtagaacaaaaawtgtatataaactattagaagaaga

SEQ ID NO: 103672 - DNA, 50 bp, homo sapien
attaagcaactcttctgctaagagarcaaataaaggagtattagcataga

SEQ ID NO: 103673 - DNA, 50 bp, homo sapien
ttacatacaactcataagatcaataycaatgtatctcatatacataattg

SEQ ID NO: 103674 - DNA, 50 bp, homo sapien
gcacgaggtggtcttcaacaaaacamattctaaactctacttcctagcag

SEQ ID NO: 103675 - DNA, 50 bp, homo sapien
ctgccacagaaacaccaatttaacartgatatatgaacccaaatatcttt

SEQ ID NO: 103676 - DNA, 50 bp, homo sapien
agaataagataagtgaaattgccaayagcagagttgatccttcctaaggt

SEQ ID NO: 103677 - DNA, 50 bp, homo sapien
tgtgtgtctgctggtgaaacctctargaccaataaatatattcagtttta

SEQ ID NO: 103678 - DNA, 50 bp, homo sapien
cacccttaggtatgtcctctaatcaytcaaacagtctcataccacaagta

SEQ ID NO: 103679 - DNA, 50 bp, homo sapien
agcaaaccacagtgtagttgaggtaraacaaaacacagtctgtgaccaaa

SEQ ID NO: 103680 - DNA, 50 bp, homo sapien
ttaaaaaagagtacctgaaatggaartcatactatgaggttttagtttct

SEQ ID NO: 103681 - DNA, 50 bp, homo sapien
tgactgaaggtgtataattaataacracttgggactagctataatgtgta

SEQ ID NO: 103682 - DNA, 50 bp, homo sapien
tagttggattttcatttgtttgtgaygaattttggagaaaagacaatcta

SEQ ID NO: 103683 - DNA, 50 bp, homo sapien
aatacattctaagttgtttataaagwatggtactaatatatattaagtag

SEQ ID NO: 103684 - DNA, 50 bp, homo sapien
ccatttaattcaatgtgaggaattakgctaggtttcatggaggaataaaa

SEQ ID NO: 103685 - DNA, 50 bp, homo sapien
agacagagaatctttacagtttaccrcatttaatacttatttaacatatt

SEQ ID NO: 103686 - DNA, 50 bp, homo sapien
aatacaagaagcttattaatatcaawctaaaagcattaacattgctacct

SEQ ID NO: 103687 - DNA, 50 bp, homo sapien
ttccaaaaaaagttaacagttccaayagtgagagcaaaggtcacatctgc

SEQ ID NO: 103688 - DNA, 50 bp, homo sapien
tgcttacaattttcagttgatcatamggctcttccctttctatataaata

SEQ ID NO: 103689 - DNA, 50 bp, homo sapien
atgggatttggatgctaatatctaaracgcccttctaagaggtccttcta

SEQ ID NO: 103690 - DNA, 50 bp, homo sapien
ttaaatatgttttcattattaagaasaatggctaatataacttaatatgg

SEQ ID NO: 103691 - DNA, 50 bp, homo sapien
tttttctccagttcaggcctagtacrccataatctctaacattgcacctt

SEQ ID NO: 103692 - DNA, 50 bp, homo sapien
ccttaagattatgaagttttcttagmcactaagggacagatatcacaaag

SEQ ID NO: 103693 - DNA, 50 bp, homo sapien
tattattcaagttcagcaatacagtraaacatctacatacaaacttatgc

SEQ ID NO: 103694 - DNA, 50 bp, homo sapien
taaataccaatttattcttgacacascctggcatgtgaaaatggggtgac

SEQ ID NO: 103695 - DNA, 50 bp, homo sapien
agagtactcaaaaaaatggtaaagcsagtcatctggtaatgctatattgg

SEQ ID NO: 103696 - DNA, 50 bp, homo sapien
tctggggccatttaggtctgtttacmcaaggacaaatgttcaaaggagaa

SEQ ID NO: 103697 - DNA, 50 bp, homo sapien
tctagtcatccatttcttaggtgttsaggcaaggttgggatagtatgaga

SEQ ID NO: 103698 - DNA, 50 bp, homo sapien
tgtacaaccatgcctcagttagttayctatggcttctttcttgaatctaa

SEQ ID NO: 103699 - DNA, 50 bp, homo sapien
agttggatcttgatagctttttacaktaccctatccatgcacagctggtt

SEQ ID NO: 103700 - DNA, 50 bp, homo sapien
ggttaaatatatgacagtaattttaygtaggacaggtagtagttgaaatt

SEQ ID NO: 103701 - DNA, 50 bp, homo sapien
tcaatcccttgggaaactaaccataraaagctgagtttgggtatagtcac

SEQ ID NO: 103702 - DNA, 50 bp, homo sapien
agattggatactaagggatcttcaaytgtttcagaaatgttttgttaaat

SEQ ID NO: 103703 - DNA, 50 bp, homo sapien
attcctttcttatacctcatagtgcsaactgaacatcctcatctgggcag

SEQ ID NO: 103704 - DNA, 50 bp, homo sapien
acttaatttgagttcacataaaatcrgaagcctgtatttaggaagtcaaa

SEQ ID NO: 103705 - DNA, 50 bp, homo sapien
gatctgtttgcttttgaacaaatagracacagtgtagtgaaaatggtgga

SEQ ID NO: 103706 - DNA, 50 bp, homo sapien
aagactcgcttgtgtaacgttgagayagatgtcatactgctggtccaggc

SEQ ID NO: 103707 - DNA, 50 bp, homo sapien
acaaaactttttgagcatttacttaygtgccatgtattattttgtaggta

SEQ ID NO: 103708 - DNA, 50 bp, homo sapien
attaacttgggaagtatatttctaayctaggtctaatgattttaaggcat

SEQ ID NO: 103709 - DNA, 50 bp, homo sapien
ttgatcaaaatgcttctttcctctawctttaaatattgtccttttcaatg

SEQ ID NO: 103710 - DNA, 50 bp, homo sapien
accaataaaagttcagtaagaaagawtaagatatgataggacacctaaaa

SEQ ID NO: 103711 - DNA, 50 bp, homo sapien
tttcaacaatccattaatcatagaakcattgcagtatgtgcatagatttc

SEQ ID NO: 103712 - DNA, 50 bp, homo sapien
tgtatttaagtaactgagggaaaccrgagcttatgctatctagacctagg

SEQ ID NO: 103713 - DNA, 50 bp, homo sapien
acgtagtgtttatgatattttaccaratgagccaataaaaaaaatttaat

SEQ ID NO: 103714 - DNA, 50 bp, homo sapien
aaaaaaaggttcaaagtcttttgaamggctgtaagtctggagttttactg

SEQ ID NO: 103715 - DNA, 50 bp, homo sapien
agtcagtatcacagcccacacttaarggatgaaaagttatgttctctctg

SEQ ID NO: 103716 - DNA, 50 bp, homo sapien
tcctatcattaatattgcaagggtckcagcaggaacttcaactgggcctc

SEQ ID NO: 103717 - DNA, 50 bp, homo sapien
aaaatggttcccctggagactcatamcctgtagtcctcagaccagaaaag

SEQ ID NO: 103718 - DNA, 50 bp, homo sapien
cagagaaagaaaggtcaggataatgwattgataacaaaatggagctaaca

SEQ ID NO: 103719 - DNA, 50 bp, homo sapien
tttctaaacaaaaattaatacactargagtccaggtataaaaatttaaga

SEQ ID NO: 103720 - DNA, 50 bp, homo sapien
ttttctagatatacccggtgaaaaawatctgaggtttgaaatttttactg

SEQ ID NO: 103721 - DNA, 50 bp, homo sapien
aaagctatgtgtgtacacgtgtaaaygcacagaacgtgttatggaaaaac

SEQ ID NO: 103722 - DNA, 50 bp, homo sapien
tttgataccaccatatgctacagtayactaaacacattaacccaacagag

SEQ ID NO: 103723 - DNA, 50 bp, homo sapien
tacctgaataagaatgaaaacacccraagttgcataatagtcaaatcctc

SEQ ID NO: 103724 - DNA, 50 bp, homo sapien
ccattggctatatttattttcaacartgcatttcattacagccagggatg

SEQ ID NO: 103725 - DNA, 50 bp, homo sapien
aactttgacacggtccaggactgaarctctctataatcttgtaacaacct

SEQ ID NO: 103726 - DNA, 50 bp, homo sapien
ttgaagaaaattgtctgaaaactagsagtcaacatagaaaaaaaaaaaag

SEQ ID NO: 103727 - DNA, 50 bp, homo sapien
ttttacctttatctctgatgcagaamcatatcaaatgcacttttttttct

SEQ ID NO: 103728 - DNA, 50 bp, homo sapien
gtcagtaaggtttagagacctttccraagaatgggaatgttaggatgctc

SEQ ID NO: 103729 - DNA, 50 bp, homo sapien
caatctctacttaggagaacaaaacrattctactataatgagtatatgca

SEQ ID NO: 103730 - DNA, 50 bp, homo sapien
gggctgacaggtagcactgaggtgastaagcacaaattaacacagtttca

SEQ ID NO: 103731 - DNA, 50 bp, homo sapien
tgatggtaatggaaagaacaatgatraccttggaagagatactgtgagga

SEQ ID NO: 103732 - DNA, 50 bp, homo sapien
cttccttgatcttcctgaattgaaayggaaagttagttacagtaatacag

SEQ ID NO: 103733 - DNA, 50 bp, homo sapien
tgaagaagccattggtcaatcttctyaactaggcaagagtagctggatca

SEQ ID NO: 103734 - DNA, 50 bp, homo sapien
tatctaacctaatacagcagatactmtgatatccaacatgtgtttccttg

SEQ ID NO: 103735 - DNA, 50 bp, homo sapien
acttctattattgtataaaatggctmaatttctgaaaacttccaattacg

SEQ ID NO: 103736 - DNA, 50 bp, homo sapien
tcttgaatcccattgctctgctagayagatttaaatagtagtgtaagaaa

SEQ ID NO: 103737 - DNA, 50 bp, homo sapien
accgtgagaacaatttggaatagtayctaacattcgactggaggagtcag

SEQ ID NO: 103738 - DNA, 50 bp, homo sapien
ttttaacacaaatgctctagagaaawttgaaataagctgtcttaaaacag

SEQ ID NO: 103739 - DNA, 50 bp, homo sapien
cgttgtgaatgtgattaatacctctsaattgaacacttatgaaatggcta

SEQ ID NO: 103740 - DNA, 50 bp, homo sapien
tattccttctcttcacagtaatcaaygctgctagtaaaaagaacatacag

SEQ ID NO: 103741 - DNA, 50 bp, homo sapien
agcacaagacccaatatcagcaaaaygaaaatatcacaatttgaaagaat

SEQ ID NO: 103742 - DNA, 50 bp, homo sapien
ctcttaagacgttaacattttttagrcaaaggaagtcctgagtgagtgaa

SEQ ID NO: 103743 - DNA, 50 bp, homo sapien
tatatttgtatttctaacaacatcaktatatgtgatcattgtgaaataag

SEQ ID NO: 103744 - DNA, 50 bp, homo sapien
cagtccagtgccagaatgaaaattcragtctgagcatgttattcctctgt

SEQ ID NO: 103745 - DNA, 32 bp, homo sapien
ttaaacagtgttatgartcaacataggtcaac

SEQ ID NO: 103746 - DNA, 50 bp, homo sapien
tatatagatgtgctaaagtctaaaasctatatagttagataatcctagat

SEQ ID NO: 103747 - DNA, 50 bp, homo sapien
gcttctgatggatatgcgaaagaacratcccattcagctgaaatacatga

SEQ ID NO: 103748 - DNA, 50 bp, homo sapien
ctctaaacctcagttatccattctcrgaattctatcgggcatctggttca

SEQ ID NO: 103749 - DNA, 50 bp, homo sapien
tgggattgttctttcgcatatccatsagaagcttttaaaattgtactgag

SEQ ID NO: 103750 - DNA, 50 bp, homo sapien
aaaacataaagaagtgggaatcatgmaaatgaataaacatgatttccaca

SEQ ID NO: 103751 - DNA, 50 bp, homo sapien
agagcactgtatagattcccgttgayataagctggaaatgtccatagctg

SEQ ID NO: 103752 - DNA, 50 bp, homo sapien
accatgcaaactaggctggtggcaaytctggctcccctgagaaactcttt

SEQ ID NO: 103753 - DNA, 50 bp, homo sapien
agttccccaaacttatttgactgcakaatctttaaattttttttctgaag

SEQ ID NO: 103754 - DNA, 50 bp, homo sapien
gatatatatgcatatttaagaccagkagaatcagagtaaatttgggcctt

SEQ ID NO: 103755 - DNA, 50 bp, homo sapien
catgttaggcttccccttcacttacrattacatggtccttgatatttctg

SEQ ID NO: 103756 - DNA, 50 bp, homo sapien
tggatcccaaacaacaatgctcaaayatactttattgttcttgctctccc

SEQ ID NO: 103757 - DNA, 50 bp, homo sapien
ttatgctatgaattgagtaaatagargggattggtagaaacaagcacagc

SEQ ID NO: 103758 - DNA, 50 bp, homo sapien
tttattctggaattctgagggtagakcaagtaagaaggtggatctgatga

SEQ ID NO: 103759 - DNA, 50 bp, homo sapien
taaaatagtgaactacacaatttcargcaataacttactggttaccaaca

SEQ ID NO: 103760 - DNA, 50 bp, homo sapien
gttgtaattgcttcacttagtacctkagcacttgtgtagttatgaaaaac

SEQ ID NO: 103761 - DNA, 50 bp, homo sapien
tattacatgtaaggaatatttgtacrggagatttaataaagacagtattt

SEQ ID NO: 103762 - DNA, 50 bp, homo sapien
ataaaccttctcctctgtctctctaycttttcaccaaaatctacacttgt

SEQ ID NO: 103763 - DNA, 50 bp, homo sapien
tttctgtgtggggttggggagaagaygcaatagctctgttttgggatgcc

SEQ ID NO: 103764 - DNA, 50 bp, homo sapien
tctagccttactcttttccaatcaawataacaataaacaaacacaataga

SEQ ID NO: 103765 - DNA, 50 bp, homo sapien
ttctcattcttaggtttttcataaartcttctattatctctcataagaag

SEQ ID NO: 103766 - DNA, 50 bp, homo sapien
aatctagaaacaaaagtccagattasagttaaaaaggcaaggggtttaga

SEQ ID NO: 103767 - DNA, 50 bp, homo sapien
agaatctcacaggcagagagaaataraacagaaatattgtaaatagagga

SEQ ID NO: 103768 - DNA, 50 bp, homo sapien
ctcctggtaagattatgaataaagayccctcaatgataactgtgcttcag

SEQ ID NO: 103769 - DNA, 50 bp, homo sapien
cagttttgtggtttccacattagtaracttaacatcacctggatgtcact

SEQ ID NO: 103770 - DNA, 50 bp, homo sapien
gaggagagaaaaacctattcatttaygttgggttacgtgctcatctcttg

SEQ ID NO: 103771 - DNA, 50 bp, homo sapien
atgaggagagaagcaataactttatyagtacatgttttagttcaaccagg

SEQ ID NO: 103772 - DNA, 50 bp, homo sapien
gatgccagctgtggaggtccaaatargattagaatatgtgtccatcttgg

SEQ ID NO: 103773 - DNA, 50 bp, homo sapien
ggccaaagcagaacacttatgggaaygtcaactgatccagggaataaagc

SEQ ID NO: 103774 - DNA, 50 bp, homo sapien
ttaccaaaaaatgtacccagagaackggatttgaattgaaccttgttgtt

SEQ ID NO: 103775 - DNA, 50 bp, homo sapien
tgactttgtgacaatatgacaatcaytccaggccaaaaaaacaggtacaa

SEQ ID NO: 103776 - DNA, 50 bp, homo sapien
acccactaacttcaccaaaaagggckcttatacacttttagagatgctat

SEQ ID NO: 103777 - DNA, 50 bp, homo sapien
gtatgagtgaatgaattcatgagtaraatgtatgaggtagatattatagt

SEQ ID NO: 103778 - DNA, 50 bp, homo sapien
ggcctggagtgattgtcatattgtcrcaaagtcagattcttccctctatt

SEQ ID NO: 103779 - DNA, 50 bp, homo sapien
aacaccattcctagacaactagaacmactcatttcctaatacacacttct

SEQ ID NO: 103780 - DNA, 50 bp, homo sapien
atgtccctgtccaactgagaataacrgggaacaaaagacaaaagtaattg

SEQ ID NO: 103781 - DNA, 50 bp, homo sapien
aaagtttagtgatgaatggaatatayacgcttggagtggtgaaaataagc

SEQ ID NO: 103782 - DNA, 50 bp, homo sapien
actgtgtggggaagttactgccatgragtccttattcagcaaccatactg

SEQ ID NO: 103783 - DNA, 50 bp, homo sapien
ttttttaaaatcctagaatttgcacraaactataaaatacccaatgcaat

SEQ ID NO: 103784 - DNA, 50 bp, homo sapien
cataagttaaagcaaatagacagccwacacgggtagtgaacctgtacttg

SEQ ID NO: 103785 - DNA, 50 bp, homo sapien
acgccccgcgcggggcctgggcgccrgccaagacttgcagcgttctcttg

SEQ ID NO: 103786 - DNA, 50 bp, homo sapien
ttttattcttgctacttagggtttcmaaactagacatacatattcagaca

SEQ ID NO: 103787 - DNA, 50 bp, homo sapien
tgaaagtttgaagtctaagtattcaycaatatgggataggtaaataaaac

SEQ ID NO: 103788 - DNA, 50 bp, homo sapien
aactggtcagatctcaaggccttcargaatcagctagcagctctgcccag

SEQ ID NO: 103789 - DNA, 50 bp, homo sapien
tcagattgttagaaaaatagaacccratgatctcatataattgggggata

SEQ ID NO: 103790 - DNA, 50 bp, homo sapien
gaattttatatttttattcaacaaartgtaccactccttagcaaatagta

SEQ ID NO: 103791 - DNA, 50 bp, homo sapien
ttccatttctctcctaaataaccaarttagcattaccttgtcacttgcct

SEQ ID NO: 103792 - DNA, 50 bp, homo sapien
gcattaggattgttgttctgtaaatragggaactgaggttttgagaggtt

SEQ ID NO: 103793 - DNA, 50 bp, homo sapien
tttggcattttcttgagaagcagaaygtggaaatggacttcatagttgtg

SEQ ID NO: 103794 - DNA, 50 bp, homo sapien
tgcttccagttcaagtctggaattamcaaatttttgtgcttcagagatca

SEQ ID NO: 103795 - DNA, 50 bp, homo sapien
gaaatggacttcatagttgtgtctcsagtacgaaagaaaatagccagaaa

SEQ ID NO: 103796 - DNA, 50 bp, homo sapien
tctgagcttaattgcaacttaaaagsccattgaaattcagtgcaactagg

SEQ ID NO: 103797 - DNA, 50 bp, homo sapien
tctgacacacttatgaaaattgtgayatgatttgaactctgataggcaat

SEQ ID NO: 103798 - DNA, 50 bp, homo sapien
ttctcatttggtcctgacttacttaygtattactgaggtctcgaaatgtc

SEQ ID NO: 103799 - DNA, 50 bp, homo sapien
tgtatcaagaggatatactaattatwaatgtgtttgcactcaacattgtt

SEQ ID NO: 103800 - DNA, 50 bp, homo sapien
taaatttcaaaagacatgagccgaaragttgaggaagatcagaataaaat

SEQ ID NO: 103801 - DNA, 50 bp, homo sapien
aaatttaccatatttaaactctgaaraaacatagcaaatataagtcatgt

SEQ ID NO: 103802 - DNA, 50 bp, homo sapien
caatcagaagaagaaaaagaatgtcrgaaaggcctagcttctctcttaaa

SEQ ID NO: 103803 - DNA, 50 bp, homo sapien
cttttttcaaaattgtattaatactyaacaatgcatccaatcaagaaaaa

SEQ ID NO: 103804 - DNA, 50 bp, homo sapien
atctgattgaagatataacatttgcygattgaccattttagaaagtagac

SEQ ID NO: 103805 - DNA, 50 bp, homo sapien
ttgagaccagagtttgaatacttcaratcataactgttaagtctgagaat

SEQ ID NO: 103806 - DNA, 50 bp, homo sapien
ttttaatggtgatgttaactcgtaawctttaaattagtcaaaaagtgatg

SEQ ID NO: 103807 - DNA, 50 bp, homo sapien
aaaataaataagaattagagtctcawtaacggcacaccaaattctcagta

SEQ ID NO: 103808 - DNA, 50 bp, homo sapien
tagtaattttacataagtgaattagmagttttagagcatgttagcaaggc

SEQ ID NO: 103809 - DNA, 50 bp, homo sapien
tgtaaatgatatccttttgaagttayagtctaagatcttcctgaatattt

SEQ ID NO: 103810 - DNA, 50 bp, homo sapien
tacaaaatggtagatagaagtatgargacagttctgatatccattaaaaa

SEQ ID NO: 103811 - DNA, 50 bp, homo sapien
cacccactatttatatagccgtgacratatgtcaaactaaccagaaataa

SEQ ID NO: 103812 - DNA, 50 bp, homo sapien
cttttcctactcaacatgtttaaaamcaaactcactatttaagaagttac

SEQ ID NO: 103813 - DNA, 50 bp, homo sapien
aaggttacatgactactaaggagatyataagtgtttgttctagaaagaat

SEQ ID NO: 103814 - DNA, 50 bp, homo sapien
ccagaaataagtgtatgaacttcatkgtcttcagaataaaacacaaccca

SEQ ID NO: 103815 - DNA, 50 bp, homo sapien
acaattgctaccaaagttcacaggasagttagtgtaaggaaatccagaac

SEQ ID NO: 103816 - DNA, 50 bp, homo sapien
tctctgaatctagaccttgagctgtwaactattctactaaatttaaaatg

SEQ ID NO: 103817 - DNA, 50 bp, homo sapien
agcatatacacatatttcccatcgcyatactccttttgcctcctgcctct

SEQ ID NO: 103818 - DNA, 50 bp, homo sapien
tgttgatagaggagttacctgatcaygctaataaaatgtcttgcaccaat

SEQ ID NO: 103819 - DNA, 50 bp, homo sapien
tagcttctagaatgcttaaactactwaacaaattgctgtaaaggttaact

SEQ ID NO: 103820 - DNA, 50 bp, homo sapien
tgggttggtgtgaaggtattacacartctctgttatgaggctgactgact

SEQ ID NO: 103821 - DNA, 50 bp, homo sapien
aggaatataaatttttgatagtctaygctcagtagttaggtactctgaaa

SEQ ID NO: 103822 - DNA, 50 bp, homo sapien
gttgtcctctgctaaaacctaaatamatatgcatgacatcctacaaatgt

SEQ ID NO: 103823 - DNA, 50 bp, homo sapien
accagaggaccagatctgttattaamtgcaagcctaaatcacatcttgct

SEQ ID NO: 103824 - DNA, 50 bp, homo sapien
cattgccccttcaagcttagcaatasgaagcagtcggaatcctaacaggg

SEQ ID NO: 103825 - DNA, 50 bp, homo sapien
ggggcatttaaaagagtcccctttgmatatgatgaacagataacgctttc

SEQ ID NO: 103826 - DNA, 50 bp, homo sapien
tacacaatttgcctgactgtaaatcrgaggtttaaaagtacaagaaaatc

SEQ ID NO: 103827 - DNA, 50 bp, homo sapien
cttcctttcggtactaattttcctgsatatgtactgttttttaccctttc

SEQ ID NO: 103828 - DNA, 50 bp, homo sapien
caagtgagaaaacgaaagcataagakaattaactgacttaccaaagatat

SEQ ID NO: 103829 - DNA, 50 bp, homo sapien
tcttctagagctattactttactacyctattaacttgttttagtaggatt

SEQ ID NO: 103830 - DNA, 50 bp, homo sapien
tttatttatttatttatgaaatatcsaaatcactaggaggaatttggacc

SEQ ID NO: 103831 - DNA, 50 bp, homo sapien
gatagctaagtggatatatttttacrgaaacataatcatatcaaatgtag

SEQ ID NO: 103832 - DNA, 50 bp, homo sapien
agtcagtagaaacaatatttgaactracataaagaataagaagggttaaa

SEQ ID NO: 103833 - DNA, 50 bp, homo sapien
ttttattgctagggattgtggtaaarcacccaaagaatgtgggtatgtgc

SEQ ID NO: 103834 - DNA, 50 bp, homo sapien
tacagtaacaccaaaataacgctcartaagttacacagctgttttctaga

SEQ ID NO: 103835 - DNA, 50 bp, homo sapien
caatatacatttgttaaaggaataaycgaggcactcccttttcttggagt

SEQ ID NO: 103836 - DNA, 50 bp, homo sapien
ctagttagcattagaaagacatttaygaggtgacttcaccaaagccacaa

SEQ ID NO: 103837 - DNA, 50 bp, homo sapien
aactaagggaaagtaaaatgatacayggtgtagatttttatcagcacaaa

SEQ ID NO: 103838 - DNA, 50 bp, homo sapien
gcacctgatacaggtctgtcttccckgagcaatgcttcagttctccacat

SEQ ID NO: 103839 - DNA, 50 bp, homo sapien
ggtcactcatgccttctgaaggtgaygtacaaagagattagcattgtttc

SEQ ID NO: 103840 - DNA, 50 bp, homo sapien
attttcctaatagttcctccaagacragaactggtgatttcctgaggtat

SEQ ID NO: 103841 - DNA, 50 bp, homo sapien
aacagagcaaggccaaaaagactctsaaggcctcatgtaggcagctggga

SEQ ID NO: 103842 - DNA, 50 bp, homo sapien
atttcccttgaatctctatgacaatkaactctttttgctgactaattagt

SEQ ID NO: 103843 - DNA, 50 bp, homo sapien
ggctaaaaactttggagttactatayacctgctaactcttattttacata

SEQ ID NO: 103844 - DNA, 50 bp, homo sapien
ggaaaaaaattgaaacaagaaaaacyagcagcgcaggaaaaattatagca

SEQ ID NO: 103845 - DNA, 50 bp, homo sapien
ataattaacagataaataagacacartccttaacttcaaggagctcacat

SEQ ID NO: 103846 - DNA, 50 bp, homo sapien
gatgttttgctgagatttatgatggycaaaaggggtaactttgtaaattt

SEQ ID NO: 103847 - DNA, 50 bp, homo sapien
agagagaaaactactggactctctcyaaatatgaaatgacctatcatgtg

SEQ ID NO: 103848 - DNA, 50 bp, homo sapien
acaaatcctacagttccctacaatayaagatgaaaagataacagtaccta

SEQ ID NO: 103849 - DNA, 50 bp, homo sapien
ttatgcagaaaaagagaatatataaygaaggtataacaagcatgaaactt

SEQ ID NO: 103850 - DNA, 50 bp, homo sapien
tgtggtttaagagtttctgaaaatamaggatagagttgatcatgatttta

SEQ ID NO: 103851 - DNA, 50 bp, homo sapien
ctaattcttcttcctatctatcaaamacacaaaggaatacaaaaaccttg

SEQ ID NO: 103852 - DNA, 50 bp, homo sapien
gaaaacaatccatttaacatacctayaaatacctctttatctcttccttg

SEQ ID NO: 103853 - DNA, 50 bp, homo sapien
actctgtttcaaaaaaaacaaacaartgaacttcaaattttttaattaga

SEQ ID NO: 103854 - DNA, 50 bp, homo sapien
tatgttaaactctttcctttacctasagtagctcttatattcttagttag

SEQ ID NO: 103855 - DNA, 50 bp, homo sapien
atatatagcatttgacacacaatcaratatgagaaaggactttgctttta

SEQ ID NO: 103856 - DNA, 50 bp, homo sapien
tcctctaattgaaaggaataatatgsaaccaagctaggatttttgtaggg

SEQ ID NO: 103857 - DNA, 50 bp, homo sapien
gcattggaataaattatagtggaccrtcaacttatgatacctattgattg

SEQ ID NO: 103858 - DNA, 50 bp, homo sapien
gtaccatttcatgatgaataaataaygtctgaatttcattaaaaatgtag

SEQ ID NO: 103859 - DNA, 50 bp, homo sapien
ctggtctctaaaagcattttgcaatyatctggaatatccacaactgaaat

SEQ ID NO: 103860 - DNA, 50 bp, homo sapien
gtgtattcttccttctagctctccartcatgctctcttgagtcatttcac

SEQ ID NO: 103861 - DNA, 50 bp, homo sapien
acacacacacacacacaaatgtgtcyaaagaagttcagtaactaccaaat

SEQ ID NO: 103862 - DNA, 50 bp, homo sapien
aggcagagagaggaggcacgtagggycaggaccaagccctcacagaggta

SEQ ID NO: 103863 - DNA, 50 bp, homo sapien
aatatttactttatgtttcttatgcrccagcactttttgaatgcttcata

SEQ ID NO: 103864 - DNA, 50 bp, homo sapien
ttgttgatctctgtgctcagagaaargcattttactggatccagcagaat

SEQ ID NO: 103865 - DNA, 50 bp, homo sapien
aaaatatatttaagagatcaaccttkaagtgacatacaaaatggtttgga

SEQ ID NO: 103866 - DNA, 50 bp, homo sapien
aactgaagcaccaacggaagaataaygcttctaaagtctcacagaaggca

SEQ ID NO: 103867 - DNA, 50 bp, homo sapien
tcttaggtatctgcaacagggttaargatgaatgtaggcacttaattaaa

SEQ ID NO: 103868 - DNA, 50 bp, homo sapien
aataatgtagtactgctttgagcacragtcaggagtagtagaccgtgtgc

SEQ ID NO: 103869 - DNA, 50 bp, homo sapien
gctaaagccatattcatatgcataaygctcagagagtaagtatgttttgc

SEQ ID NO: 103870 - DNA, 50 bp, homo sapien
cagtaagctaacaagctaatcaccaraaaggcttatcactaataacttat

SEQ ID NO: 103871 - DNA, 50 bp, homo sapien
gatgattttgccactgggaaagaaamctagtagctttattattgtagaag

SEQ ID NO: 103872 - DNA, 50 bp, homo sapien
gaaaatatgaaaactcacaataatamctaaaagaaaaattgatgaattat

SEQ ID NO: 103873 - DNA, 50 bp, homo sapien
tgtgttgtttttagccactagcttcrtgatcatttgttacagcagcaata

SEQ ID NO: 103874 - DNA, 50 bp, homo sapien
tgaagaaacatgtaatgtcctctgarattgttcgaaggagaaaaactcga

SEQ ID NO: 103875 - DNA, 50 bp, homo sapien
ggacgatcaatatcaggccagcatamgtaaaggagagatggggtttcacc

SEQ ID NO: 103876 - DNA, 50 bp, homo sapien
gtcgctcatttaccaaatactgaagmaagatatgtggcaaaaaaaaatct

SEQ ID NO: 103877 - DNA, 50 bp, homo sapien
aacatacactccaaagtaacaaaacragtatcacagtatgcatttgaaca

SEQ ID NO: 103878 - DNA, 50 bp, homo sapien
actatttactgaatacttcttagtcycagttactatgcatgatataaatg

SEQ ID NO: 103879 - DNA, 50 bp, homo sapien
acataaataaataggtaattactaaytgtgattaagaactgtgagagaaa

SEQ ID NO: 103880 - DNA, 50 bp, homo sapien
aaaaattcattttaatctgaatgaayctgaccttgtctgtcttgtccata

SEQ ID NO: 103881 - DNA, 50 bp, homo sapien
aagttgcgttactatatgctttctcygaaccttcataatattatatactg

SEQ ID NO: 103882 - DNA, 50 bp, homo sapien
cttttttggaataaggaaaattagcygatatgatctgacccttcttccct

SEQ ID NO: 103883 - DNA, 50 bp, homo sapien
tcagaatgggattaagtttctagtaygtttccaattttgttacagcttta

SEQ ID NO: 103884 - DNA, 50 bp, homo sapien
ttgactttataactacatggtttcamatcataagtgcaggaaggaagtaa

SEQ ID NO: 103885 - DNA, 50 bp, homo sapien
aggcttactttccttaccatgaaaastcagaatgggattaagtttctagt

SEQ ID NO: 103886 - DNA, 50 bp, homo sapien
aagtctttttagttgattgttttgayatctataggcatacttaattcagg

SEQ ID NO: 103887 - DNA, 50 bp, homo sapien
atgagggaatatcttgacttttccaygtgtagaagacaatgaagcaatgt

SEQ ID NO: 103888 - DNA, 50 bp, homo sapien
catctcctttctttctaaaggcaatraccttcatgcttataaccttgcgt

SEQ ID NO: 103889 - DNA, 50 bp, homo sapien
tctaataaaaaagagttctatgaccragttggatttgacccagggataca

SEQ ID NO: 103890 - DNA, 50 bp, homo sapien
ttgtatgtgtttgacagttgaaccaratgattttatttctgaataacaag

SEQ ID NO: 103891 - DNA, 50 bp, homo sapien
agttggggagctcttcaaaatataakgctgatcatgaaaaatataatgct

SEQ ID NO: 103892 - DNA, 50 bp, homo sapien
tgactaaagtttagattcaaagacarattacaaaagagtaagcattcttg

SEQ ID NO: 103893 - DNA, 50 bp, homo sapien
aaaatcacacattttagcaattttakctgtttagcaataatttccaacat

SEQ ID NO: 103894 - DNA, 50 bp, homo sapien
caccatccacattgtgttttctcaaygattcaacctaacagggttcttat

SEQ ID NO: 103895 - DNA, 50 bp, homo sapien
atatggtaaaatatttatttcaaacratatgtcccttggtatgaacatgt

SEQ ID NO: 103896 - DNA, 50 bp, homo sapien
ctatcaaaggatgctataaaactaaygcacacactacccttggagagcat

SEQ ID NO: 103897 - DNA, 50 bp, homo sapien
atttggcagtgtcctttcaagttggrcaaacagttaaacagctgccttaa

SEQ ID NO: 103898 - DNA, 50 bp, homo sapien
aggatagataatttgtttcaaagtayatgtaacatttatcaatttagact

SEQ ID NO: 103899 - DNA, 50 bp, homo sapien
tgcattatatgtgatagacttaagcrataatatggaataataaattataa

SEQ ID NO: 103900 - DNA, 50 bp, homo sapien
ttgattgattgattaatgggtctgamgtgaaagtaaaaactataagaatt

SEQ ID NO: 103901 - DNA, 50 bp, homo sapien
aactgagtctatgaaataaaaatcaygaggcataaagatagattaaaata

SEQ ID NO: 103902 - DNA, 50 bp, homo sapien
gcttggagtactaaaaaacacaagakaacaactgagtctatgaaataaaa

SEQ ID NO: 103903 - DNA, 50 bp, homo sapien
tagaagattgatgttttagtattcarattctatccagagaaataaattta

SEQ ID NO: 103904 - DNA, 50 bp, homo sapien
gaagttgtagagacaatataactackgagagcttctctttcagttcccca

SEQ ID NO: 103905 - DNA, 50 bp, homo sapien
gagttagtagtttttattattaacamataggcaaagaacataaattctgt

SEQ ID NO: 103906 - DNA, 50 bp, homo sapien
tattgtacacttagtggatgcttacyaaatgctgacacgttatttattat

SEQ ID NO: 103907 - DNA, 50 bp, homo sapien
tagagtccctgaacttagtctaataygaaacaagtatataatatatgtag

SEQ ID NO: 103908 - DNA, 50 bp, homo sapien
gacagtttggtgctgaaatagtcaamggacaatcaaatgaccttaaagtg

SEQ ID NO: 103909 - DNA, 50 bp, homo sapien
ggtctagtctcttagaagagtagcayggaagaaacttctctgaataggaa

SEQ ID NO: 103910 - DNA, 50 bp, homo sapien
ttattttcccatgtacttgggtcatragctttcgccaatatagattaaaa

SEQ ID NO: 103911 - DNA, 50 bp, homo sapien
agtgactattacacagcaatgaaaamaatacatagagatgtacccatcaa

SEQ ID NO: 103912 - DNA, 50 bp, homo sapien
tagagccctgaatgacttttctgagratttaatctagttgcatagctatt

SEQ ID NO: 103913 - DNA, 50 bp, homo sapien
gaagtggggggtggtatatttatgaygaacaaaagcaaagaagtttagaa

SEQ ID NO: 103914 - DNA, 50 bp, homo sapien
gtaataataatatgttacaagctaaygccgactcttctctatccccaaga

SEQ ID NO: 103915 - DNA, 50 bp, homo sapien
agcacatcataaaatactaaacaaakttcactctttttattgctcttgat

SEQ ID NO: 103916 - DNA, 50 bp, homo sapien
caaaaaccaaggcaagtatgatattratagtgggctggccagaggaagga

SEQ ID NO: 103917 - DNA, 50 bp, homo sapien
ccatccttctactctctatctccacragttgaattgttttaatttttagt

SEQ ID NO: 103918 - DNA, 50 bp, homo sapien
gcagagacctctgaagtatgtccacygagcagtttcaagaacagtttgaa

SEQ ID NO: 103919 - DNA, 50 bp, homo sapien
agttcttaaaaagttttccattctcragttgataagatggctgaatagga

SEQ ID NO: 103920 - DNA, 50 bp, homo sapien
ggttgtcatatcttagagtcccgatyagctagttttcaggtggcgtctct

SEQ ID NO: 103921 - DNA, 50 bp, homo sapien
taaaatagcatattgctttctttacrggtttgaatcatagtgtcttgtgg

SEQ ID NO: 103922 - DNA, 50 bp, homo sapien
tcatttcctcaaacaagaatttgacmagacaagtaacacccttattttgt

SEQ ID NO: 103923 - DNA, 50 bp, homo sapien
taaattaaatagataactaggtaaakaaaagcaggacatacatatatcac

SEQ ID NO: 103924 - DNA, 50 bp, homo sapien
tactggcagaatgctctaagagtacraacagtcgtcagcctactgtgaat

SEQ ID NO: 103925 - DNA, 50 bp, homo sapien
agagggcacttgtcactccaggcatyagatgttatgaaaataatagatct

SEQ ID NO: 103926 - DNA, 50 bp, homo sapien
aattggggcgagcttgccttctataygtgctgtttccctttgttcttttc

SEQ ID NO: 103927 - DNA, 50 bp, homo sapien
cagcagaactcttagaattccagcayagaaatgtttacatgctgaaatgc

SEQ ID NO: 103928 - DNA, 50 bp, homo sapien
gttgtgggatcatgggttgtgcaagrccctgtagttcacattaaaggtag

SEQ ID NO: 103929 - DNA, 50 bp, homo sapien
tcttgcacaacccatgatcccacaaygcggaatcatgttattccacgcag

SEQ ID NO: 103930 - DNA, 50 bp, homo sapien
gccatgaagtgaatatttgttagcgwcctgatcaactacttccaggaaat

SEQ ID NO: 103931 - DNA, 50 bp, homo sapien
tatgcagatttatatgaatgttggamgctatagagattttgatatcattt

SEQ ID NO: 103932 - DNA, 50 bp, homo sapien
gtaaaatggggtgtccaggtctaggraattgtcaaaataaaactggggag

SEQ ID NO: 103933 - DNA, 50 bp, homo sapien
ttcagtcatttcgaagcagctttaartgtactcctttgttcactatgcct

SEQ ID NO: 103934 - DNA, 50 bp, homo sapien
tctgtgaaatagatattttacttcaytctagcaattaaaaaactgagaca

SEQ ID NO: 103935 - DNA, 50 bp, homo sapien
ttgcagaatcctaatagaatttctgyataaccggagagagagagacagag

SEQ ID NO: 103936 - DNA, 50 bp, homo sapien
aacttttgtaaagattgtcatcaaastatttatttttcatctgtaattca

SEQ ID NO: 103937 - DNA, 50 bp, homo sapien
tgtttgtatatttttgacagtttaaygtagccccagaatttaacctgtat

SEQ ID NO: 103938 - DNA, 50 bp, homo sapien
atataacaagtgaaatcctgtgatayacttaagcaacccttgtaaatcaa

SEQ ID NO: 103939 - DNA, 50 bp, homo sapien
tgaattgttgagtatttaatagagcrgaataaagaaaaggaaaataaaag

SEQ ID NO: 103940 - DNA, 50 bp, homo sapien
gattcatacagtgatacaataaaaayatagtctttctgtggtactactgt

SEQ ID NO: 103941 - DNA, 50 bp, homo sapien
acttggcattagaattcctcgaccamtaggacagggaccaagcagattca

SEQ ID NO: 103942 - DNA, 50 bp, homo sapien
gctctggaggtatttttggcgcaacycggaactcctgagtgtccatgcac

SEQ ID NO: 103943 - DNA, 50 bp, homo sapien
catctgctattggttgaggtccttarttcagagactccccaagatcaata

SEQ ID NO: 103944 - DNA, 50 bp, homo sapien
gtgtgttagggtatgaagacaggtargtaaaataataaaagaatcattag

SEQ ID NO: 103945 - DNA, 50 bp, homo sapien
cctcccctttgtaacagccggcaccmaatttgctttatatggtcatgagc

SEQ ID NO: 103946 - DNA, 50 bp, homo sapien
tgtctgtggagtggttgaagaaatcygaagaaaagagggaagtctgatgg

SEQ ID NO: 103947 - DNA, 50 bp, homo sapien
tagaacatgccacacctttcttaackcattaaacagagcagacagaacat

SEQ ID NO: 103948 - DNA, 50 bp, homo sapien
tctgttacattaatccatttgtctarctttatattatttcctaaaatcag

SEQ ID NO: 103949 - DNA, 50 bp, homo sapien
gaacgtgttaacattcacgtctgtgytcctggttaggtctcctccctctg

SEQ ID NO: 103950 - DNA, 50 bp, homo sapien
gttaattaaagctgtcttaatggaamaaatatagcttaaagtacaggcta

SEQ ID NO: 103951 - DNA, 50 bp, homo sapien
aatcaaaagcacataaggattcagayagagaacttggtggaaacctcaag

SEQ ID NO: 103952 - DNA, 50 bp, homo sapien
acatgaaatgtaataatgattttacmagttgtatctagtttttaagactt

SEQ ID NO: 103953 - DNA, 50 bp, homo sapien
aagacagcttctttcagatggaaaasgattttgtatggacacaggaggaa

SEQ ID NO: 103954 - DNA, 50 bp, homo sapien
acaacttgaacagagtttatagaaayccattttagtgagaatgctctata

SEQ ID NO: 103955 - DNA, 50 bp, homo sapien
caaggtaaaggagaaatagaaagtcratttagttttacataaatctaata

SEQ ID NO: 103956 - DNA, 50 bp, homo sapien
actacacaaatgcaaagtaggaacgmaagattcttaaatgtggatagagt

SEQ ID NO: 103957 - DNA, 50 bp, homo sapien
taaaaatgaatagtcgacattttaaraacctgactacagtttcaatttaa

SEQ ID NO: 103958 - DNA, 50 bp, homo sapien
acatttaaatagtttccttccttggmcatatctatttcaattcatttgag

SEQ ID NO: 103959 - DNA, 50 bp, homo sapien
tatggaagcaactcaactgagcatayggcatcagggagcctcttctggtc

SEQ ID NO: 103960 - DNA, 50 bp, homo sapien
ttttaggacacaaaggtaaagtaggyaaagatctttcaagaacttgtaat

SEQ ID NO: 103961 - DNA, 50 bp, homo sapien
aggagagggggtaaccaatctaacarcgttcacctaagaagaatggtttg

SEQ ID NO: 103962 - DNA, 50 bp, homo sapien
ttaactttcacaataacttgtaaaayagtcttgcattgtacagatggggt

SEQ ID NO: 103963 - DNA, 50 bp, homo sapien
agtcaaaatgcttttttcaattttaycattgactcacatttattagtttg

SEQ ID NO: 103964 - DNA, 50 bp, homo sapien
cttggaaatcaatccttcatggataycaacggacaagggcatacagaaga

SEQ ID NO: 103965 - DNA, 50 bp, homo sapien
gacctagtttccattagagaaaagaygtgccagagagagaattttttttc

SEQ ID NO: 103966 - DNA, 50 bp, homo sapien
agatctaaaagtaagacaggaaattsaaacttctaatcttacattcaaaa

SEQ ID NO: 103967 - DNA, 50 bp, homo sapien
tgggtaggtacataatactttcaggyccaacaatactggcagtccatttg

SEQ ID NO: 103968 - DNA, 50 bp, homo sapien
ctgagataaagcataatggaaacaayacatgtgcatagatacacggtatg

SEQ ID NO: 103969 - DNA, 50 bp, homo sapien
cctggacctcacaaagcaacatttamctgagtgcctctgccatgtatagc

SEQ ID NO: 103970 - DNA, 50 bp, homo sapien
attcttgatggctgctgctaacttayggtgagatgctgggtccctgccca

SEQ ID NO: 103971 - DNA, 50 bp, homo sapien
caacctccaagagaacaacctctaayacttggcagtctgaaatcaagaat

SEQ ID NO: 103972 - DNA, 50 bp, homo sapien
taagtatacaatttaaagtaaagatragctaaatgttctgaattgtatgt

SEQ ID NO: 103973 - DNA, 50 bp, homo sapien
aaattttactgatattttgaccccaytaacaatttgcaccccccttgctt

SEQ ID NO: 103974 - DNA, 50 bp, homo sapien
ccaaggtattccttacccgttgccaygtaatcaatcagctactccttttg

SEQ ID NO: 103975 - DNA, 50 bp, homo sapien
cgtaaactttgtcttcacttccacaygttcaaggacacctcttttaaagt

SEQ ID NO: 103976 - DNA, 50 bp, homo sapien
tgtctaccttgttattatttgctccrgaaccattcttaaattcagctcta

SEQ ID NO: 103977 - DNA, 50 bp, homo sapien
ctgtgattttcttgctatttacctargttaacatgtatccaaaacgacag

SEQ ID NO: 103978 - DNA, 50 bp, homo sapien
ttatatactgtacaaaaaacaattaygcattcttgaaaaggaggattact

SEQ ID NO: 103979 - DNA, 50 bp, homo sapien
tagcccaaatattcttgaacaaattyaaaacaggtatcattcaaggataa

SEQ ID NO: 103980 - DNA, 50 bp, homo sapien
atctctaaatcttagcttattctgtraaatagcgctcaccatagtcatac

SEQ ID NO: 103981 - DNA, 50 bp, homo sapien
tttgctttgtgtccaatatttatcaygtcttggtgtttcactcaacactt

SEQ ID NO: 103982 - DNA, 50 bp, homo sapien
cagctgtctccaggaacttgagtaamtgtctccaacccagcgtgtggatg

SEQ ID NO: 103983 - DNA, 50 bp, homo sapien
aaatctaaaaaccttatcatttagarcatttaaactcttcattaactttc

SEQ ID NO: 103984 - DNA, 50 bp, homo sapien
tgtttctttttgtgtgtgttagctaygggtgcaacctttacttgtctata

SEQ ID NO: 103985 - DNA, 50 bp, homo sapien
aactcttaaactattcagtatctcastaaccacactatagtatatactgt

SEQ ID NO: 103986 - DNA, 50 bp, homo sapien
tttcaaatgtgcaaggagaaacagaygctcttactacacccaactaatca

SEQ ID NO: 103987 - DNA, 50 bp, homo sapien
tttccctgaaaccaaggtaaggcccraagtattgattgtcagggttcgct

SEQ ID NO: 103988 - DNA, 50 bp, homo sapien
aactcttcacaaaagggaacatgtayagagtggaactttgccttctattc

SEQ ID NO: 103989 - DNA, 50 bp, homo sapien
ttgtaagagtcaatgcctcagctgcrataaaaaagttacaaataaagtct

SEQ ID NO: 103990 - DNA, 50 bp, homo sapien
aaattcctatgaaatacaaatgaaasctaaatctcataatttgaatggat

SEQ ID NO: 103991 - DNA, 50 bp, homo sapien
gatatttatctaaattcatgatgtaraggagttagtggacctggatttct

SEQ ID NO: 103992 - DNA, 50 bp, homo sapien
gagatctttttcttcctatcaaaaarggtttatatttcagatctgtttcc

SEQ ID NO: 103993 - DNA, 50 bp, homo sapien
aaaaattgagcacataatccatttarctaaaattgtgcacataatctaga

SEQ ID NO: 103994 - DNA, 50 bp, homo sapien
acatccagtgtctaaatccacatcayctaaaagtacctggaagatcatag

SEQ ID NO: 103995 - DNA, 50 bp, homo sapien
ggagagacttagtttttctgtcaagyagatggtgagggtaacattgttgg

SEQ ID NO: 103996 - DNA, 50 bp, homo sapien
gctgaattgtattatgggtcccagamagatcattgtaaagctcttgttcc

SEQ ID NO: 103997 - DNA, 50 bp, homo sapien
aggaagtaacattgtgatatggaacmgtacatatattcctgtattctcag

SEQ ID NO: 103998 - DNA, 50 bp, homo sapien
tgtcacaaagccagcaccagcaagarcgacaccgagctcccacgctttgt

SEQ ID NO: 103999 - DNA, 50 bp, homo sapien
gataaatatgaatcaaaacagaagarctaacaccagaggagtattgaata

SEQ ID NO: 104000 - DNA, 50 bp, homo sapien
ttatttataaatgtgctatgagagcrccaaattatctacaacgccgtgta

SEQ ID NO: 104001 - DNA, 50 bp, homo sapien
tctttttgttatttcttaaaagccaygacatagaacaaccaggaaactgg

SEQ ID NO: 104002 - DNA, 50 bp, homo sapien
caatgtaagaaactcttagatcataygcttttttaggtatgtataggagg

SEQ ID NO: 104003 - DNA, 50 bp, homo sapien
tcactgccagcaagaaaaattccacygtgagtatgaaattaaagaaatgc

SEQ ID NO: 104004 - DNA, 50 bp, homo sapien
aaatgaaatatttgcctcatgtataygcacttttaacatctaatcacata

SEQ ID NO: 104005 - DNA, 50 bp, homo sapien
gaagcaaggaagagattgttttgatscagaatctctaaccatttgatatg

SEQ ID NO: 104006 - DNA, 50 bp, homo sapien
gtttattaaacactctgtaaagccaytctatttaaaacagtatgatagag

SEQ ID NO: 104007 - DNA, 50 bp, homo sapien
catttaaatgctagataatatagtasgtgaatgagtaattttgaaagaaa

SEQ ID NO: 104008 - DNA, 50 bp, homo sapien
taccatttgtataatatgaaaagcayggaagaattgacaattgatttggc

SEQ ID NO: 104009 - DNA, 50 bp, homo sapien
taagtactttgcttctgatgtgatasatattttagagtgttattgaatgt

SEQ ID NO: 104010 - DNA, 50 bp, homo sapien
ctgaaaacttaattagcattatgcaractgtgggcttctggtatttctag

SEQ ID NO: 104011 - DNA, 32 bp, homo sapien
tttgtcatttctactcracataatactggacg

SEQ ID NO: 104012 - DNA, 50 bp, homo sapien
accaaggtttctagttgctctcatawcctttttgaagtattttatgcatt

SEQ ID NO: 104013 - DNA, 50 bp, homo sapien
agagagaccatcaaagtagatcccayggacattaaaatgacaaaatacta

SEQ ID NO: 104014 - DNA, 50 bp, homo sapien
ttttctttactaatttttgcatatgycacatctcctaaagtaatataaat

SEQ ID NO: 104015 - DNA, 50 bp, homo sapien
ccatcaatacattgtgttggcaagtsgatatagccctatctagaatagca

SEQ ID NO: 104016 - DNA, 50 bp, homo sapien
acacgtaaaagcatgccaacataaayaggtgactgataaatgattaccta

SEQ ID NO: 104017 - DNA, 50 bp, homo sapien
ggaaggggttagcagacaggtatccrcgtgttccagggaagagtcattgc

SEQ ID NO: 104018 - DNA, 50 bp, homo sapien
tatgtgaaataataaacgttagtctwaagctgctatgttttggggtaata

SEQ ID NO: 104019 - DNA, 50 bp, homo sapien
agctttgaagaacaaggatcctcaayattgtactgtaaagtcaacctgct

SEQ ID NO: 104020 - DNA, 50 bp, homo sapien
tttctctctcaccctgcacagtaaastgaaggtccttttttaagactcag

SEQ ID NO: 104021 - DNA, 50 bp, homo sapien
aaaaatattatttcacttctgaataygctttaatctctcaacttctttaa

SEQ ID NO: 104022 - DNA, 50 bp, homo sapien
aagtacaatatactgataatcctaaytggagatgctttttaatatattaa

SEQ ID NO: 104023 - DNA, 50 bp, homo sapien
atcttaaaaaatactataatattcayaattgcaatgcacattgacattat

SEQ ID NO: 104024 - DNA, 50 bp, homo sapien
aaggacactactgtgcagaaattagrcacctgaagaagctgaggttcaat

SEQ ID NO: 104025 - DNA, 50 bp, homo sapien
tctgtcaggtcctggatgagtacaarttatggtcacggtcacagcctgat

SEQ ID NO: 104026 - DNA, 50 bp, homo sapien
atgtttctcaggtgcttcttataaaygctgagaagagtgagggctaaact

SEQ ID NO: 104027 - DNA, 50 bp, homo sapien
ggtttgccactaactacagtgacaaygaggaaactagaggatagaggtcc

SEQ ID NO: 104028 - DNA, 50 bp, homo sapien
gatttttttgtctgctttattcatayattgttgtcagtttaattgaagta

SEQ ID NO: 104029 - DNA, 50 bp, homo sapien
accagacagtagctgaacttccaaarccttccagaattggcttgttaaat

SEQ ID NO: 104030 - DNA, 50 bp, homo sapien
ctttgattgtgagttctcctagtcasgtctgctgatttccaaagaggagt

SEQ ID NO: 104031 - DNA, 50 bp, homo sapien
agtggataaatttaccatttagcccrcaggttgaagaatgtaagaattag

SEQ ID NO: 104032 - DNA, 50 bp, homo sapien
ttctcagttgaatcacattgtcatayaaaattagccaaatttacctttta

SEQ ID NO: 104033 - DNA, 50 bp, homo sapien
aatgatgcatttaattccctaccatraggcaatatatagaatatacagca

SEQ ID NO: 104034 - DNA, 50 bp, homo sapien
tcgtcctgtgattcctgaatgtataygagggaactagaggtagcagtcta

SEQ ID NO: 104035 - DNA, 50 bp, homo sapien
caactgaaaccacatacaaaaactargcctaggaaaagacagattcaata

SEQ ID NO: 104036 - DNA, 50 bp, homo sapien
acatttccccttttactttagttcaycaaacctagaaccaaatttatgat

SEQ ID NO: 104037 - DNA, 50 bp, homo sapien
ggaatggttctaggacccccaaggayctcaaaatctgtgaatactcgagt

SEQ ID NO: 104038 - DNA, 50 bp, homo sapien
tagatatacatagatagatgaacaaygtgtttaatagtcacaataactcc

SEQ ID NO: 104039 - DNA, 50 bp, homo sapien
gaagtgggattttattgaagaagtaygcatggcagccaggccagtgataa

SEQ ID NO: 104040 - DNA, 50 bp, homo sapien
acagatagaaaaacttgtattttaaygatagctatatgcgtgactttagc

SEQ ID NO: 104041 - DNA, 50 bp, homo sapien
ttagttgtgtctcttgtcaaatccarttatctgcttacaagagaaacacc

SEQ ID NO: 104042 - DNA, 50 bp, homo sapien
ttttccactaaaccattcagtttgakcttatggcttcaggacagtagcag

SEQ ID NO: 104043 - DNA, 50 bp, homo sapien
tacctacagaatgtattatatttacyggtaatagcaactatttagaaaaa

SEQ ID NO: 104044 - DNA, 50 bp, homo sapien
gtggaaaagaggtggaacttaacacwctttatgtggggtttcaatcactc

SEQ ID NO: 104045 - DNA, 50 bp, homo sapien
cagtggaaatggggttggtcttcccrcgattctcatcaaccacactaagg

SEQ ID NO: 104046 - DNA, 50 bp, homo sapien
ttgcttgtaaccaactccactgtgcygaaagtgatttagagaatgtagtc

SEQ ID NO: 104047 - DNA, 50 bp, homo sapien
caagatttaaacattggaagacttamgaatatgcttgtcttttaaaaaaa

SEQ ID NO: 104048 - DNA, 50 bp, homo sapien
cagaagttggggaaatgttttagacyctttagagaatttataatgtctat

SEQ ID NO: 104049 - DNA, 50 bp, homo sapien
aaacaaacccatgggagtaaataagyctgtagagggaacagaaaatatac

SEQ ID NO: 104050 - DNA, 50 bp, homo sapien
agtgtctgcagcttttccaggcacayggttcaagttgtcaatggatctac

SEQ ID NO: 104051 - DNA, 50 bp, homo sapien
aatgctaacagtgaaagtcttaggcyataaaggtcaaagaagtaaaggtg

SEQ ID NO: 104052 - DNA, 50 bp, homo sapien
aaatcatagtcaaactcttttataaygatgtttaccaatatgcagccatc

SEQ ID NO: 104053 - DNA, 50 bp, homo sapien
gtgggtcaaatcatggctgttagtaraataagatccagcaaggttctcca

SEQ ID NO: 104054 - DNA, 50 bp, homo sapien
gtgacaatgtaattgcattattctayggtatccttaggccattcttatga

SEQ ID NO: 104055 - DNA, 50 bp, homo sapien
atccaggacagccatgtcatcacagyatgttaaagaaaaggtgtttccag

SEQ ID NO: 104056 - DNA, 50 bp, homo sapien
gatcatctcacttacctaactagatraaagaagaacattgttgtctcaat

SEQ ID NO: 104057 - DNA, 50 bp, homo sapien
aaaattcacaaattttcctaaaataygcatgaagcctgatatagttagta

SEQ ID NO: 104058 - DNA, 50 bp, homo sapien
gcagaaatactgggtcagagtgaatyatccttagaatgtggggccgagac

SEQ ID NO: 104059 - DNA, 50 bp, homo sapien
gtttcataaacagaaatttgtaagtkaagattgttgaaaagaagataatg

SEQ ID NO: 104060 - DNA, 50 bp, homo sapien
ccaggaaggaaattatggtatttcayctaatttgagacatcaattgtaaa

SEQ ID NO: 104061 - DNA, 50 bp, homo sapien
acaggactgtccaaaataactacatkcacatactggttattgagagatct

SEQ ID NO: 104062 - DNA, 50 bp, homo sapien
attgttgcggaaatgtttggtgtatytctccgttgtgaagttacttttcc

SEQ ID NO: 104063 - DNA, 50 bp, homo sapien
cttgtgttttgtctgttggactaagragttcttacgaatctatgaatcaa

SEQ ID NO: 104064 - DNA, 50 bp, homo sapien
gttacatgtgttcactttgtgaaaaytgagttagacacaggatttgttgc

SEQ ID NO: 104065 - DNA, 50 bp, homo sapien
atttgatatgacacccctgatgaackgtctcaaaatctatgtgactcttc

SEQ ID NO: 104066 - DNA, 50 bp, homo sapien
cattatgcttttgcttttatggtgcygactcttaagcatgtgcatgaaaa

SEQ ID NO: 104067 - DNA, 50 bp, homo sapien
ttatgttttaaatcactcatctatayggtttttagtactatgaacaaaat

SEQ ID NO: 104068 - DNA, 50 bp, homo sapien
cctgttgtatggaggcactgcactakacatttttttctgatcatttgcaa

SEQ ID NO: 104069 - DNA, 50 bp, homo sapien
cagaagctgacaagttcccttattaygacttccatttgttagtggagtag

SEQ ID NO: 104070 - DNA, 50 bp, homo sapien
ttggccataaacaacttaatatctcrcacctagtagtattcagtgacaca

SEQ ID NO: 104071 - DNA, 50 bp, homo sapien
gtctgggtgtgacagagatgtttacrgagtaagaggtttgctagttacag

SEQ ID NO: 104072 - DNA, 50 bp, homo sapien
gtcttcaaagtaggataagaactacratgtccactgaggtcaagaaagca

SEQ ID NO: 104073 - DNA, 50 bp, homo sapien
accactaattaagacctcaaaattaycttttctaacattactacagctac

SEQ ID NO: 104074 - DNA, 50 bp, homo sapien
ttagggagaagacagaggcttcaaaygactggtttataacccagatggga

SEQ ID NO: 104075 - DNA, 50 bp, homo sapien
tgactgaatttaattagaatgtacaygttggtgatcagtttcacacccgc

SEQ ID NO: 104076 - DNA, 50 bp, homo sapien
taaggggaaaaaattacatctgtackgaaccttatacagaccattttttt

SEQ ID NO: 104077 - DNA, 50 bp, homo sapien
agaaatgtgctgtaacagaactgacygtattgaccatttctgttgctttt

SEQ ID NO: 104078 - DNA, 50 bp, homo sapien
ctctgtatccgacaaaatggcgcatratcatctgtgaaaattggaggtaa

SEQ ID NO: 104079 - DNA, 50 bp, homo sapien
ataaaatatttttagggtcattgaaytaaccttatttctttcaatctttg

SEQ ID NO: 104080 - DNA, 50 bp, homo sapien
aaagatgtctgatagaaattgtgtgyatctctggcttatctgtccatgga

SEQ ID NO: 104081 - DNA, 50 bp, homo sapien
ttaaaactagcttgcagaatttgaaygtattttacttctataaccagagc

SEQ ID NO: 104082 - DNA, 50 bp, homo sapien
agcaatggttgttattattatcagartagcattaaaatagatgataatag

SEQ ID NO: 104083 - DNA, 50 bp, homo sapien
ttttcactactctagtaggctaatgycaggttaggacaaagaagcctagt

SEQ ID NO: 104084 - DNA, 50 bp, homo sapien
tgctgtatagcagcaattacatgaargtttattggataaatacctctgca

SEQ ID NO: 104085 - DNA, 50 bp, homo sapien
ttccatgtggtttcatgcaccattayagtaatttctgctatttccttctt

SEQ ID NO: 104086 - DNA, 50 bp, homo sapien
gtatttgtagccatctaagcaaaaayttgacaaaaatggcccaaaatttc

SEQ ID NO: 104087 - DNA, 50 bp, homo sapien
cctctggggatgaccatcctaaccayaaactgcaaacaaccttccccaat

SEQ ID NO: 104088 - DNA, 50 bp, homo sapien
ttactagtaaaatatacatcttgacratatcccagaaaaccgaggtactt

SEQ ID NO: 104089 - DNA, 50 bp, homo sapien
aatcattcatttagttattcatctayccaatcagtgcttattattcacag

SEQ ID NO: 104090 - DNA, 50 bp, homo sapien
atgttcaagtccagttcacagcctayggtttgtacataggcaaagcacac

SEQ ID NO: 104091 - DNA, 50 bp, homo sapien
ttactccccaatgatgatgaatggaraaatacttttcagggagaattgaa

SEQ ID NO: 104092 - DNA, 50 bp, homo sapien
gaagagcaaattgaataattactagyatatggaattgcttattcttagag

SEQ ID NO: 104093 - DNA, 50 bp, homo sapien
tttcaagacaaggttggatttctttytccatggttaatgggtgctatata

SEQ ID NO: 104094 - DNA, 50 bp, homo sapien
atatctgtacagctcaattttcacartaagtttagaatcagaaaaaaaaa

SEQ ID NO: 104095 - DNA, 50 bp, homo sapien
cacaattctgagcagcatggtcttcrgaaaaagttcagcagaaatgaatg

SEQ ID NO: 104096 - DNA, 50 bp, homo sapien
tgattctgtaatttttagttaacatsaatttaaggactttaatgatttta

SEQ ID NO: 104097 - DNA, 50 bp, homo sapien
ataaagttttctggagtttagatccyatgattagtttgaataaaatgacc

SEQ ID NO: 104098 - DNA, 50 bp, homo sapien
tttctcagtagctaagtctcttttaygaggtccaaaataaaatacattta

SEQ ID NO: 104099 - DNA, 50 bp, homo sapien
tttttgcatattctatgacactacartacaatcagcagaatcattacctt

SEQ ID NO: 104100 - DNA, 50 bp, homo sapien
gaaagttaatataagagccttaccaygaagagctggaagaagattttctt

SEQ ID NO: 104101 - DNA, 50 bp, homo sapien
acaacacaaagtatagaaacttaacrgaggctggacttgccatggcataa

SEQ ID NO: 104102 - DNA, 50 bp, homo sapien
taaagtttggatcattacataagccrctggctcatctccatctattagcc

SEQ ID NO: 104103 - DNA, 50 bp, homo sapien
gattttatgctgtatgaggtcgcagscttctctgtcttttctgatagaga

SEQ ID NO: 104104 - DNA, 50 bp, homo sapien
ggcaaagtttctatgaaagaggataygaaggccctagaaagttggggaaa

SEQ ID NO: 104105 - DNA, 50 bp, homo sapien
attgtttagatcaagaatacgaacaytgaaaccaattactcataaagggt

SEQ ID NO: 104106 - DNA, 50 bp, homo sapien
attatgcaggatttatcccagacatkcaaggagattcaacatacaaaaat

SEQ ID NO: 104107 - DNA, 32 bp, homo sapien
tctaactttaggtttcyatgaatgtgactatt

SEQ ID NO: 104108 - DNA, 50 bp, homo sapien
ctacttcggaatttgctaaaaggtaratgaaactcaatatttactcaaat

SEQ ID NO: 104109 - DNA, 50 bp, homo sapien
ttaactctaactaaaatttaatcaayaggtagtgagtcttatcactaagt

SEQ ID NO: 104110 - DNA, 50 bp, homo sapien
ttctagatgtacgatgattataaaasatacacttaaaaatggaaatacca

SEQ ID NO: 104111 - DNA, 50 bp, homo sapien
ttcaccttgtttctacatatgcaagraaactattggtaatttgataatta

SEQ ID NO: 104112 - DNA, 50 bp, homo sapien
agtaaaaaggatatgaaaactctttsaaaaaaacagctgtaggaacacag

SEQ ID NO: 104113 - DNA, 50 bp, homo sapien
aatggtacgattcctgatactaccamataatgtaacttcttaccaaacaa

SEQ ID NO: 104114 - DNA, 50 bp, homo sapien
catttatgtgaaagaaataatttggraaggaaacattcctttacgatatt

SEQ ID NO: 104115 - DNA, 50 bp, homo sapien
tgaagaaaagtgagctatgcaggaasagtattccatgaaaatgaaggtcg

SEQ ID NO: 104116 - DNA, 50 bp, homo sapien
gatgggaataaattggcaaaacttgyatgtaggacagctgatatggtttg

SEQ ID NO: 104117 - DNA, 50 bp, homo sapien
ccggcatcatgtaatttttcatcccrccattgaaagccattgtttccgta

SEQ ID NO: 104118 - DNA, 50 bp, homo sapien
agaggaggggattgtgattggagagraaagttccctataagactagacca

SEQ ID NO: 104119 - DNA, 50 bp, homo sapien
catgttgaacagggtaaacatgaaastcatacagaaaggtaacaaacggt

SEQ ID NO: 104120 - DNA, 50 bp, homo sapien
taaagtactttaaaagacattaagaracatttgcactttttatggaacta

SEQ ID NO: 104121 - DNA, 50 bp, homo sapien
atctttctagattatctctcttcacyctaacttcatctgtttttctctgt

SEQ ID NO: 104122 - DNA, 50 bp, homo sapien
tggcccccttcttgttggcctaacayagagctttggaattgcttggttgc

SEQ ID NO: 104123 - DNA, 50 bp, homo sapien
gaaagatgtatgaggatattagagascctaaaaagaagctgaagatataa

SEQ ID NO: 104124 - DNA, 50 bp, homo sapien
gttacagcatctttctttcttgcatytgagctttaacgttgagtgcttgg

SEQ ID NO: 104125 - DNA, 50 bp, homo sapien
tgtaggtgaaattgttatgtactgasgatcaatttttattaaatataaat

SEQ ID NO: 104126 - DNA, 50 bp, homo sapien
tacatgacattaggtgttgtttttargcttgtaaatgatgcaaacattta

SEQ ID NO: 104127 - DNA, 50 bp, homo sapien
gctgatatctcaacaggtactttcayatttaggctaactgaaatgtgagg

SEQ ID NO: 104128 - DNA, 50 bp, homo sapien
catctgaaaaatggttttaaaataargcagtctatgagggaagaaataag

SEQ ID NO: 104129 - DNA, 50 bp, homo sapien
ctcgcctctctgaacaactcagatcyctgttcaagataagaagtgaaagg

SEQ ID NO: 104130 - DNA, 50 bp, homo sapien
tgatcattttcatcatgtaattatcrccttcaggttggacacagtttgaa

SEQ ID NO: 104131 - DNA, 50 bp, homo sapien
tttttttagatctcctaaacatataycagctaatctagtggggagagagc

SEQ ID NO: 104132 - DNA, 50 bp, homo sapien
atcaggagtaacacttaggttaaatratctgttcattatctctggataca

SEQ ID NO: 104133 - DNA, 50 bp, homo sapien
gaagatgctgtatcagaatgatacartgaagacaataggatgccaaaatg

SEQ ID NO: 104134 - DNA, 50 bp, homo sapien
acgattgaagagtagagttaccatayatagctgcggtggcactgcagtgg

SEQ ID NO: 104135 - DNA, 50 bp, homo sapien
aaaggtgtaaaactacaatggtgtayaaagcaggattctgtaaggaggag

SEQ ID NO: 104136 - DNA, 50 bp, homo sapien
taatagtttctactctcagaacatcraactgtattaatataatgtgtacc

SEQ ID NO: 104137 - DNA, 50 bp, homo sapien
aggatttctgttttgtaaaaccaaayaattctaaatggtgacaccaaata

SEQ ID NO: 104138 - DNA, 50 bp, homo sapien
ttgttctattcccttactttctccaraatatacagtctctgtctctcttc

SEQ ID NO: 104139 - DNA, 50 bp, homo sapien
ttcctttggttggtagtttgtacacktagctattttcagtacatattctt

SEQ ID NO: 104140 - DNA, 50 bp, homo sapien
ttctctttctttttggctggtaagamaccaattagtacaaatctatagtc

SEQ ID NO: 104141 - DNA, 50 bp, homo sapien
ttaaaaatctaattttggaatatccygaatttcataatagtttaatatgt

SEQ ID NO: 104142 - DNA, 50 bp, homo sapien
attttgcagatacatagtcagaggaycttaagaaagagggattattgaag

SEQ ID NO: 104143 - DNA, 50 bp, homo sapien
ggtaaattggtctgggcgtggagaaragatgttcctgaaactaggatata

SEQ ID NO: 104144 - DNA, 50 bp, homo sapien
gcagtttttaaccttgttgtattgcycttctctattgtcaaattgtcctg

SEQ ID NO: 104145 - DNA, 50 bp, homo sapien
agcatgtaaaagttagtcaaaagatraatgatgctgtggtaaaatagata

SEQ ID NO: 104146 - DNA, 50 bp, homo sapien
acatatagatttactattgctatatstctttcctcattgacccattcatc

SEQ ID NO: 104147 - DNA, 50 bp, homo sapien
tatgcagtccagaagagtgtcattamcagagcctgaccgcaagcatgatt

SEQ ID NO: 104148 - DNA, 50 bp, homo sapien
cttccaacattcttttacttttccaytaacagttgccttttcttgttaac

SEQ ID NO: 104149 - DNA, 50 bp, homo sapien
ggaaaaggctatgtcatgatgaatayacgatgccacattatgaagtatgg

SEQ ID NO: 104150 - DNA, 50 bp, homo sapien
gtagaactctagcctagaacaagccrcaatggtaatttttctatgtgttt

SEQ ID NO: 104151 - DNA, 50 bp, homo sapien
gataactaatttaagaaaggaattcragctgtacattgtcttagattctt

SEQ ID NO: 104152 - DNA, 50 bp, homo sapien
agagctgagttatgtgacaaggctarctaggtaattatgtgttttgtctt

SEQ ID NO: 104153 - DNA, 50 bp, homo sapien
attaccagttcagcgtgggcctatgrtcaagcctggccaaggaaactgac

SEQ ID NO: 104154 - DNA, 50 bp, homo sapien
agaacttagaccccatcgtatcttcstctgtcttactagatgagaagaag

SEQ ID NO: 104155 - DNA, 50 bp, homo sapien
tttttattgccctatttcctactacrcagttaccttgatagatggatgca

SEQ ID NO: 104156 - DNA, 50 bp, homo sapien
tgtttctgccgttctgtggctttccratcttcgtggtattcagagagctc

SEQ ID NO: 104157 - DNA, 50 bp, homo sapien
agcatttcctggcatacaacgaatarctaaataaaaagcttcttagaaat

SEQ ID NO: 104158 - DNA, 50 bp, homo sapien
tccatggaaactaggcaggaaagtaragggaaacaaacctagtctcttcc

SEQ ID NO: 104159 - DNA, 50 bp, homo sapien
gagataagaggattaaaggaagagaytaggctatttgtttccctttactt

SEQ ID NO: 104160 - DNA, 50 bp, homo sapien
gtatattaaagcatgactatttggtyacatttatattaaaaattttgttt

SEQ ID NO: 104161 - DNA, 50 bp, homo sapien
ggagaacctgaataataaacatagcrcatttgcttctgtgtgtatattaa

SEQ ID NO: 104162 - DNA, 50 bp, homo sapien
aaagcgaattattgttcttctcttaycttccgctgctttatcatggttac

SEQ ID NO: 104163 - DNA, 50 bp, homo sapien
cattttggattcattattcagttgaratggcaattaattgaaactctctt

SEQ ID NO: 104164 - DNA, 50 bp, homo sapien
cctcaggagtttttagtttgataagyattggagggcaagtgacacaggtg

SEQ ID NO: 104165 - DNA, 50 bp, homo sapien
tgttagcatagagaccaaaaaaatckcaaatagaaacaatgaaaagacct

SEQ ID NO: 104166 - DNA, 50 bp, homo sapien
tacgtaggccaactaaaacatttaaytgggagatcacagaatgtaccccc

SEQ ID NO: 104167 - DNA, 50 bp, homo sapien
aggatagaaaaaggaatactttagcrctatggccaaagaaagagagacaa

SEQ ID NO: 104168 - DNA, 50 bp, homo sapien
ttataaaactggaaaaggaaataaaygatcacatctaccaaggagagcta

SEQ ID NO: 104169 - DNA, 50 bp, homo sapien
tccgccacacactgactattgaacartcaaaatcctctgtatggttggct

SEQ ID NO: 104170 - DNA, 50 bp, homo sapien
aagctcatgttatcacatattagtaraagtggcttcaatggatagttgaa

SEQ ID NO: 104171 - DNA, 50 bp, homo sapien
actacttttcttactatactccatakcagggtaacccatggcgtgcaatt

SEQ ID NO: 104172 - DNA, 50 bp, homo sapien
ctcaatttaccttgtccttagtagtmacatctgtattccctagcatagca

SEQ ID NO: 104173 - DNA, 50 bp, homo sapien
cccagatggaggacattggcattccrgcttacgagtcagactctgaggag

SEQ ID NO: 104174 - DNA, 50 bp, homo sapien
ttctgccaatcagattaaaacaacaycggaacttgaataattgatttgtt

SEQ ID NO: 104175 - DNA, 50 bp, homo sapien
tctattgtgacaactttaaagaagaytaagagcaaaattatattcttact

SEQ ID NO: 104176 - DNA, 50 bp, homo sapien
ggagcctccagaattgagagcaatamattaccattgcttataaattacct

SEQ ID NO: 104177 - DNA, 50 bp, homo sapien
ctatgtacatgaaatagtgtatgtgyaacctaaaaatctgaataagctgt

SEQ ID NO: 104178 - DNA, 50 bp, homo sapien
caactcaatatctttattagtaaatyacctccaaattaaacaagtttaat

SEQ ID NO: 104179 - DNA, 50 bp, homo sapien
gatacgtgaatagacatatttttaartgaatacgtgactaggaaaagaaa

SEQ ID NO: 104180 - DNA, 50 bp, homo sapien
gggaaaagaagaataagctgacacayattgaccatgctgccaggagaggc

SEQ ID NO: 104181 - DNA, 50 bp, homo sapien
gagttccctcatctaactcagtgacygcttaggctctttgcaatacaagt

SEQ ID NO: 104182 - DNA, 50 bp, homo sapien
aatgtaaaagtaagtgtaataaaaarttattgttggcatctaacatcttt

SEQ ID NO: 104183 - DNA, 50 bp, homo sapien
ctccttgttatgaaatatccttctcrcccttcaaaatatccttttctaac

SEQ ID NO: 104184 - DNA, 50 bp, homo sapien
atttggctgttactgtaaagggtcasaatatacttgcagaagggtcacta

SEQ ID NO: 104185 - DNA, 50 bp, homo sapien
tcattgtgttctctctttctgtccartgattacactttagtccaaggcta

SEQ ID NO: 104186 - DNA, 50 bp, homo sapien
agcatctggcatctttaaaaagggawtattgagtctcttcttgtttttat

SEQ ID NO: 104187 - DNA, 50 bp, homo sapien
tctctgtagtgcttagatagtttaawtgctggtttgatcagaatatgaat

SEQ ID NO: 104188 - DNA, 50 bp, homo sapien
gcaactttgagtaaatcctttcatckctaagaactttagtttactcattt

SEQ ID NO: 104189 - DNA, 50 bp, homo sapien
taataacttataaaaaatgctcttakgccattatgaagtcacattataat

SEQ ID NO: 104190 - DNA, 50 bp, homo sapien
actatggcatgattccttaaaaagargcaattaaatattttgaaaactgt

SEQ ID NO: 104191 - DNA, 50 bp, homo sapien
caggagtccaagatggctgagcagtraacagtgaacggacgctagttcta

SEQ ID NO: 104192 - DNA, 50 bp, homo sapien
agccagagaccagatcatgagcgtastagaggctatggcatgagtgtgga

SEQ ID NO: 104193 - DNA, 50 bp, homo sapien
agggttgtatcacccggctgacagayaaatataaagtaaaacctcagatg

SEQ ID NO: 104194 - DNA, 50 bp, homo sapien
atcagtatcatgcctggaattgacastgttgcttctgtcatagtatattg

SEQ ID NO: 104195 - DNA, 50 bp, homo sapien
tgttgaatgcatgacagataaagcaycttaattgttaagaaactgcagtg

SEQ ID NO: 104196 - DNA, 50 bp, homo sapien
cttaagagaggaggatctattcaaaygtaagaatttttttattgattcat

SEQ ID NO: 104197 - DNA, 50 bp, homo sapien
tgtcacttttccctaaaattcttaaktcaactctatccatcctactaaaa

SEQ ID NO: 104198 - DNA, 50 bp, homo sapien
tctgcatttccaactgaggtattcascgcatctcactgggactggttaga

SEQ ID NO: 104199 - DNA, 50 bp, homo sapien
aaagagatgctgtctaaatcctaaaygttagcaagagttttctggtctag

SEQ ID NO: 104200 - DNA, 50 bp, homo sapien
caagtcattgacaccacaggaacaayctttacatatttaagagatgattt

SEQ ID NO: 104201 - DNA, 50 bp, homo sapien
ccagttacatgttctcagacaagtasctcgtatcctattactggaaggag

SEQ ID NO: 104202 - DNA, 50 bp, homo sapien
ggaagatctccaggagtagaattatkcagattgatttagctttcctagga

SEQ ID NO: 104203 - DNA, 50 bp, homo sapien
ctccaaataaacaatgcaacgttccygatttctaatcttggttctgagag

SEQ ID NO: 104204 - DNA, 50 bp, homo sapien
cccacaagataaagttcccaaggcamtatgacccctgattccttctctat

SEQ ID NO: 104205 - DNA, 50 bp, homo sapien
ttttcaattcttgtgtcactgtgctyaactttcaaattcctgctactgtc

SEQ ID NO: 104206 - DNA, 50 bp, homo sapien
tcacccagaggagttagagtaaaggycagaacctcgaggtgagcaacagc

SEQ ID NO: 104207 - DNA, 50 bp, homo sapien
atcattgtgcatagttttcattgtasagttattggtttctcaatcatttg

SEQ ID NO: 104208 - DNA, 50 bp, homo sapien
ttttcaaaggtgtaagtcctggattraacattagatttagaaacagatta

SEQ ID NO: 104209 - DNA, 50 bp, homo sapien
ctataaatataaacttgggatgtcartataaggcaaaatattaatgccaa

SEQ ID NO: 104210 - DNA, 50 bp, homo sapien
tattaactgccttagttggctcagcrtgccttaacagaataccacacaat

SEQ ID NO: 104211 - DNA, 50 bp, homo sapien
aaataagcctaaataatgctgcggcraccctaagaaactaagctcacttg

SEQ ID NO: 104212 - DNA, 50 bp, homo sapien
gcccccatcccatataaaatccaaaygatgacagtaattgaatgacacag

SEQ ID NO: 104213 - DNA, 50 bp, homo sapien
cagaggtaattgatactcaaagacaytaaataattctacaaggttgcaca

SEQ ID NO: 104214 - DNA, 50 bp, homo sapien
aatactgagaaaatttctatatgacmaaatactctcaaaattaaagcact

SEQ ID NO: 104215 - DNA, 50 bp, homo sapien
cttctacaaattaatctatgcttttkagtcccaatgtggggtgctgattc

SEQ ID NO: 104216 - DNA, 50 bp, homo sapien
ttcaataaataactcctcacaatgayccttattttatagcagaggtaatt

SEQ ID NO: 104217 - DNA, 50 bp, homo sapien
aaccccctggaagcactttttgaaaygccaatgttgattttgaggaaatc

SEQ ID NO: 104218 - DNA, 50 bp, homo sapien
attcatatggaacatatttgtcatgsaatatatcttactgagttttaaaa

SEQ ID NO: 104219 - DNA, 50 bp, homo sapien
atagaaactatctatttacagctaargaattaagcaccagaacatttgca

SEQ ID NO: 104220 - DNA, 50 bp, homo sapien
aagcgtaaaatgtagtatgaaaggamaagccttgagtatttattaccttt

SEQ ID NO: 104221 - DNA, 50 bp, homo sapien
ttaaggcacgctgagccaactaaggyagttaataaggataattgactcaa

SEQ ID NO: 104222 - DNA, 50 bp, homo sapien
ttacatcttgagtgtcatatctttayacttacccattgtaataggctaat

SEQ ID NO: 104223 - DNA, 50 bp, homo sapien
cattacgtcctccctctccatcatcraaaataaattcacacaccaaaaaa

SEQ ID NO: 104224 - DNA, 50 bp, homo sapien
gaaatttaaaatcataaaagcgatgmaacaagtagtaagatatttgactg

SEQ ID NO: 104225 - DNA, 50 bp, homo sapien
tcttattgttttctcaatttctgtarcacttgtccttgaaccatataatt

SEQ ID NO: 104226 - DNA, 50 bp, homo sapien
aagcacattttgactgttacagttaygattaacacttctttttaaaacaa

SEQ ID NO: 104227 - DNA, 50 bp, homo sapien
agaaagttatttcttcaatattctcyctttgtaaattatccctattccta

SEQ ID NO: 104228 - DNA, 50 bp, homo sapien
taccttatacacaaatagttgtccayatttgtgattattttcttgggaca

SEQ ID NO: 104229 - DNA, 50 bp, homo sapien
cttggaaagagaacaccaatcagtgkaatgaaccaacctgttccaataaa

SEQ ID NO: 104230 - DNA, 50 bp, homo sapien
attacagcgggtaccttggtcttcaytactgctctacaccgtgttggata

SEQ ID NO: 104231 - DNA, 50 bp, homo sapien
agaggggagacagaggcctagacaastggatagactttccatgagatgag

SEQ ID NO: 104232 - DNA, 50 bp, homo sapien
aggaagtattgatttactaattatamcctcatttcttaaaactcacaata

SEQ ID NO: 104233 - DNA, 50 bp, homo sapien
ctagcctccaaaattacatgagccawtccatgatagcaaattctctctct

SEQ ID NO: 104234 - DNA, 50 bp, homo sapien
tatctggttccctgtgttttataccyggagattctggctgatctaagaga

SEQ ID NO: 104235 - DNA, 50 bp, homo sapien
tgaaagtttagtgacacattccagasgtttatttttctgtgcttattatt

SEQ ID NO: 104236 - DNA, 50 bp, homo sapien
gaattcttaacctaatgagactacamacaatccagcctctacctattata

SEQ ID NO: 104237 - DNA, 50 bp, homo sapien
tttgatgaagaacaaatttaaaatamtaactcttgcaaaaatgtctagaa

SEQ ID NO: 104238 - DNA, 50 bp, homo sapien
tgactggctaggggcagcatgaaatsattaggcagaactgaaatcaccat

SEQ ID NO: 104239 - DNA, 50 bp, homo sapien
agtaggggaagagggaagaagagtgrttaagacagatggaatagcatagg

SEQ ID NO: 104240 - DNA, 50 bp, homo sapien
cagcaaatggatcacctcatttcaawcactgatcaggtccagcctcatct

SEQ ID NO: 104241 - DNA, 50 bp, homo sapien
aatttcatattatttactggtaatartagcaatgtgtttattatatttaa

SEQ ID NO: 104242 - DNA, 50 bp, homo sapien
gtcaaagcagagtttcaaattcaagrccctagagctttacattaagctga

SEQ ID NO: 104243 - DNA, 50 bp, homo sapien
cctggaatattgcaatagcccctaaytggtcctcctacttctaccctcat

SEQ ID NO: 104244 - DNA, 50 bp, homo sapien
cactagccaagaacttaggggcaaaytgattgcatccgatccctcatcct

SEQ ID NO: 104245 - DNA, 50 bp, homo sapien
catctggagtccttttaacaatcagmagctagctatgaccttaaagagtt

SEQ ID NO: 104246 - DNA, 50 bp, homo sapien
agtaaatttgcttaaggttatggaasaaatacattgcacagctgttactt

SEQ ID NO: 104247 - DNA, 50 bp, homo sapien
ggttctttaaataaactttgtttcartcataataatactagctaccattg

SEQ ID NO: 104248 - DNA, 50 bp, homo sapien
gattttccatggtaacaagggtcaayaatttggagccaagtttatcactc

SEQ ID NO: 104249 - DNA, 50 bp, homo sapien
agagcacacacacgctcagaaaatasctgcctcacacagcagaccctggt

SEQ ID NO: 104250 - DNA, 50 bp, homo sapien
attcctatgtttattttctgaaataygtacagctctcaggctattgaatc

SEQ ID NO: 104251 - DNA, 50 bp, homo sapien
attctgaaagtactgaaaaaataaartcactaagcaagaactctgtcctg

SEQ ID NO: 104252 - DNA, 50 bp, homo sapien
ctcttatatttctgacatgtatcacrgacatttagttatgtggcttactc

SEQ ID NO: 104253 - DNA, 50 bp, homo sapien
acatataaataatgaacgccgattaygtgctagcaacaccaacttcatag

SEQ ID NO: 104254 - DNA, 50 bp, homo sapien
acttaggtgtgtcttcctttccaaartgtttatttcagaattactcattt

SEQ ID NO: 104255 - DNA, 50 bp, homo sapien
gggcaatataagttcaagctgaagartaatcaacattttttttcttagca

SEQ ID NO: 104256 - DNA, 50 bp, homo sapien
aaaattgtaagagaataaaggtaaargaagacctattggctattattgta

SEQ ID NO: 104257 - DNA, 50 bp, homo sapien
tttttgaagattggagttagttataytagggaatgctgaatttagtattt

SEQ ID NO: 104258 - DNA, 50 bp, homo sapien
cagcaaaagtgcttcttctccattcyaggactgtctttcttggatatcca

SEQ ID NO: 104259 - DNA, 50 bp, homo sapien
gagttaactcatcaagaagtagtaaytcactgaacagtccttcctggtat

SEQ ID NO: 104260 - DNA, 50 bp, homo sapien
tgtaggggccagaccatgaacaaagsatgtggacgttagtttaaagtcaa

SEQ ID NO: 104261 - DNA, 50 bp, homo sapien
tttcctttacacaaaccacttactgkattctgattgactttaaactaacg

SEQ ID NO: 104262 - DNA, 50 bp, homo sapien
gagaaacattttcttccaatcaaacyggtaatctttccttggaggcgtta

SEQ ID NO: 104263 - DNA, 50 bp, homo sapien
tcccatgagagaaagacgggggtaaygaatagaatagacagagtccagaa

SEQ ID NO: 104264 - DNA, 50 bp, homo sapien
acacctagtcttagaatggaggcaaygttgaaaccaagagtaggagagaa

SEQ ID NO: 104265 - DNA, 50 bp, homo sapien
tatctataatatgctataatttaacraagatacaaaatgaagaggagtaa

SEQ ID NO: 104266 - DNA, 50 bp, homo sapien
tatatttaatcatctttttatcctaygtgcttcataatcttcagtttcct

SEQ ID NO: 104267 - DNA, 50 bp, homo sapien
cttatatttctttttcaatgttgtakctagtccatctcatcattttttaa

SEQ ID NO: 104268 - DNA, 50 bp, homo sapien
atgcaaagtttgagatttttacaacygaaatcattttgctgtggtgatct

SEQ ID NO: 104269 - DNA, 50 bp, homo sapien
tgtgccagtccttgtgagggcttacraataaaaaggtgaggaagttatat

SEQ ID NO: 104270 - DNA, 50 bp, homo sapien
tgatgtcattttgaaggctattccamattagcatgaactacagcttaaag

SEQ ID NO: 104271 - DNA, 50 bp, homo sapien
aaattttaatatttgaattagatgaygatcctgtattaactctgttagaa

SEQ ID NO: 104272 - DNA, 50 bp, homo sapien
aacagaagatatagccccacacagarcaaggtagtcacaccatttccact

SEQ ID NO: 104273 - DNA, 50 bp, homo sapien
tacagcaggtcactaaaagaactcargaatctaaagagtgagtatggcca

SEQ ID NO: 104274 - DNA, 50 bp, homo sapien
gttgttaaataattcatcacatgtaragtaacataaccatgaccaacaat

SEQ ID NO: 104275 - DNA, 50 bp, homo sapien
tagagttgtagaaggaaagagtaatyaatttaagagcttttttgctaatt

SEQ ID NO: 104276 - DNA, 50 bp, homo sapien
agtcccaggggtgtattgcccatggycagagaggaaattaagactgctga

SEQ ID NO: 104277 - DNA, 50 bp, homo sapien
gtgttatataattctgctggaccaaraaaagtcattatttgtggtttaaa

SEQ ID NO: 104278 - DNA, 50 bp, homo sapien
acatcagcacaggcagaagagtttakgagggatataggacaagatagctt

SEQ ID NO: 104279 - DNA, 50 bp, homo sapien
taatcacatagcagttagggatgaartaacttaggcctcactctaagaga

SEQ ID NO: 104280 - DNA, 50 bp, homo sapien
ccatagcttcagttgatttcaagatmataattaatacttaatatatcact

SEQ ID NO: 104281 - DNA, 50 bp, homo sapien
ttgcaataaagccatgagatgtaaayaattcagaaatttatttcttcaac

SEQ ID NO: 104282 - DNA, 50 bp, homo sapien
gcataggaggggttttattgataaaygacagtgatttccagaaaataaga

SEQ ID NO: 104283 - DNA, 50 bp, homo sapien
tgacttattctaatagttttacggaytcagaacttatatttaaatattta

SEQ ID NO: 104284 - DNA, 50 bp, homo sapien
tggctgtgcgtaatttaatcaaaaasttttctaccttgggatagggcaga

SEQ ID NO: 104285 - DNA, 50 bp, homo sapien
aaacaatctgaccgaattgtccctargttgtgaatgttacatcctcttag

SEQ ID NO: 104286 - DNA, 50 bp, homo sapien
gggcttcatagcatcctaaagcctaygcaatttgagaggccctctttcaa

SEQ ID NO: 104287 - DNA, 50 bp, homo sapien
gcattctgtaaagaagagcttcccamatcctttcaaacagaaacttactg

SEQ ID NO: 104288 - DNA, 50 bp, homo sapien
actggaactaatacattgaaagagarataatttagccccagagaactgga

SEQ ID NO: 104289 - DNA, 50 bp, homo sapien
aaactagaagagtagaatctagtaargatggctagtttaatagcagagcc

SEQ ID NO: 104290 - DNA, 50 bp, homo sapien
cagtctgacccacttttgaacttgarcataataacaaactttctagtatt

SEQ ID NO: 104291 - DNA, 50 bp, homo sapien
tttgttacagaagaaataaaactgasattgttggaacagtacattattcc

SEQ ID NO: 104292 - DNA, 50 bp, homo sapien
aaattagttttaatcattgcttacasgatggacagtatgaacacagatca

SEQ ID NO: 104293 - DNA, 50 bp, homo sapien
ataaaacaataaacttatagagcgtraaggataaaccaagggattattgt

SEQ ID NO: 104294 - DNA, 50 bp, homo sapien
catgcaataaaatataggtttttacrgacaatccagaagaccactaagtt

SEQ ID NO: 104295 - DNA, 50 bp, homo sapien
aaataagaaaaactataaattgtgarcacgggcagcaatatgactctgaa

SEQ ID NO: 104296 - DNA, 50 bp, homo sapien
attgtttgtttgtttttttcactaaktcgttcatatccttttacccagtc

SEQ ID NO: 104297 - DNA, 50 bp, homo sapien
atgtttatctctccaagaagtatccyaattgtttgtttgtttttttcact

SEQ ID NO: 104298 - DNA, 50 bp, homo sapien
tcaaactccattgccctaaaattatmctaatatccctgaaacaccttggt

SEQ ID NO: 104299 - DNA, 50 bp, homo sapien
atgccagtgcaagtgaaatattaaartaaccactaatctggggctaaaat

SEQ ID NO: 104300 - DNA, 50 bp, homo sapien
atattgactcaatatggtatttgtgyatataagcatggattttgaatatt

SEQ ID NO: 104301 - DNA, 50 bp, homo sapien
gaacagctgaaatttccaacaatgasagctatcaaacagtggcactcgct

SEQ ID NO: 104302 - DNA, 50 bp, homo sapien
tcttgactaatataaaatgtatcaastcatttccaaattaaggattatta

SEQ ID NO: 104303 - DNA, 50 bp, homo sapien
gaaaaagaagtatgaactgaaagaasttcgtggagcaagtcatcatccta

SEQ ID NO: 104304 - DNA, 50 bp, homo sapien
aattacataaacttctgtttgaagartcgaaaattttaaatgatacataa

SEQ ID NO: 104305 - DNA, 50 bp, homo sapien
ctatgtacctatctaggagtaaaatyatagaggagtgaattgttctgtag

SEQ ID NO: 104306 - DNA, 50 bp, homo sapien
ttactctatagtttaaaccttgtgaytatttccataaccatctatgaatg

SEQ ID NO: 104307 - DNA, 50 bp, homo sapien
acggacgtttaaataacactctttargaaatgacaagtgagaacgaaaaa

SEQ ID NO: 104308 - DNA, 50 bp, homo sapien
aaaatttgattttctgtcaccattayggacgtttaaataacactctttaa

SEQ ID NO: 104309 - DNA, 50 bp, homo sapien
gacctctctgcaaggaaagatacccraaggaaatattcaaaacaaagatg

SEQ ID NO: 104310 - DNA, 50 bp, homo sapien
ggctagtttttgttagttgccactcratcccgtttattggctaagaataa

SEQ ID NO: 104311 - DNA, 50 bp, homo sapien
cttttgtgtgttcatgtacattagaycaaacatacaaatagattatgttg

SEQ ID NO: 104312 - DNA, 50 bp, homo sapien
ttagtaatgtcctttattttcttctraattctgtaggacctgtagttata

SEQ ID NO: 104313 - DNA, 50 bp, homo sapien
atttttgtcttatattcagaagaaamctttccagcaagtaggaatccttg

SEQ ID NO: 104314 - DNA, 50 bp, homo sapien
tcatactgtgctaaaatctaaaatgsaaggcttaaagcacagggaagtta

SEQ ID NO: 104315 - DNA, 50 bp, homo sapien
tgagttgctaaagggaaagaaatatyaccaaatgattttcacattattac

SEQ ID NO: 104316 - DNA, 50 bp, homo sapien
tcctggtagtgattgctgaaggctgsaatagctgtgtcaatttcttaaaa

SEQ ID NO: 104317 - DNA, 50 bp, homo sapien
tctatgtaatgtcatgaactaaaaarcaaatgacctcagaaggtggggga

SEQ ID NO: 104318 - DNA, 50 bp, homo sapien
aaaaaatacactaacagtattaacartttttccataagctcccaagttgt

SEQ ID NO: 104319 - DNA, 50 bp, homo sapien
ctctggatggaatgaatcatgtcacygagtttgccctgatctgttgccct

SEQ ID NO: 104320 - DNA, 50 bp, homo sapien
gccaacacaaacaatttaaattgtcraacttgcctgatgctgattaaatc

SEQ ID NO: 104321 - DNA, 50 bp, homo sapien
gttacccattgttatttggagggcarcataaaggcctgagggaattgaac

SEQ ID NO: 104322 - DNA, 50 bp, homo sapien
ttagaaaacatagataaactaacaawataccatgctacttcataaatgca

SEQ ID NO: 104323 - DNA, 50 bp, homo sapien
cacctatttgcttagatatttctacycttgcacatttgtttatgttatcc

SEQ ID NO: 104324 - DNA, 50 bp, homo sapien
tagctacacatgaatctggtgagtaractttggaaagctgcaatatcctc

SEQ ID NO: 104325 - DNA, 50 bp, homo sapien
acatttttacccagataacgcacaayttgatagactatcattttgaaaac

SEQ ID NO: 104326 - DNA, 50 bp, homo sapien
caagtcagtgatcacataccgaaaakaattgaatcaagttattttcaaga

SEQ ID NO: 104327 - DNA, 50 bp, homo sapien
agcactttagatatcatttctaagcygaatagtacctcttttttgatttg

SEQ ID NO: 104328 - DNA, 50 bp, homo sapien
cttgaaaaatttattagtcctgataygatgttgtaggatgtttctgcaat

SEQ ID NO: 104329 - DNA, 50 bp, homo sapien
ttgtatttcaagtaacttgtctacayagaaaagatgggaacagaggtggg

SEQ ID NO: 104330 - DNA, 50 bp, homo sapien
cagctgcagaggtgagctgccaaggytacatcattttgtgggtgggccac

SEQ ID NO: 104331 - DNA, 50 bp, homo sapien
atagtaaattgagtgcttattatacrccaagagaatttctgtttattata

SEQ ID NO: 104332 - DNA, 50 bp, homo sapien
tggtgttatatttctacctgtacctragatgagtaatagagaaaaggatg

SEQ ID NO: 104333 - DNA, 50 bp, homo sapien
attggtgccctttgcatggaggtaaytgagcttgtctggtcatgatgaga

SEQ ID NO: 104334 - DNA, 50 bp, homo sapien
aaagagggagtgaagtatatgagaawtgatgatgaagatagttggctggg

SEQ ID NO: 104335 - DNA, 50 bp, homo sapien
ttatttattctttatttcacattaasctaaggatgttacctaccacaaat

SEQ ID NO: 104336 - DNA, 50 bp, homo sapien
ttgcaacttatgcccaggtaaaagargaccagtagaatcttggagcagct

SEQ ID NO: 104337 - DNA, 50 bp, homo sapien
gaatcatctcagacatagttctctayccaaatttgctttttaggatcacc

SEQ ID NO: 104338 - DNA, 50 bp, homo sapien
gacctgcagaataggaattgaaatayctgattgcacattcacacaggcaa

SEQ ID NO: 104339 - DNA, 50 bp, homo sapien
ggtgttaatcctgagagtgtgctccrgtaaatttcctgcatagaaatctt

SEQ ID NO: 104340 - DNA, 50 bp, homo sapien
atattttctttttatagctttgccawcataatcatattacatcctgacac

SEQ ID NO: 104341 - DNA, 50 bp, homo sapien
ttttctcttacgagatattaatacaygaaatgagcaaaaaaaggaatgca

SEQ ID NO: 104342 - DNA, 50 bp, homo sapien
aataggtttgggacattgaaggagtrtgattaccacctgccttggagtag

SEQ ID NO: 104343 - DNA, 50 bp, homo sapien
taaaataatattataaattttgagcracaggtttattagtggataatttg

SEQ ID NO: 104344 - DNA, 50 bp, homo sapien
aaacataattcataactgttaggtayagaatgttgctttcagctaccatc

SEQ ID NO: 104345 - DNA, 50 bp, homo sapien
tccaaggacatgggagaaaatgggamgaacccaaattgagaagattagag

SEQ ID NO: 104346 - DNA, 50 bp, homo sapien
aagctactgactccacacacaatgcrataagtagacttatcataggggaa

SEQ ID NO: 104347 - DNA, 50 bp, homo sapien
ctagcacatcatcaaatatgaaacaygctaacacagccaaaatcttactc

SEQ ID NO: 104348 - DNA, 50 bp, homo sapien
taaaactgaaattcatcagttaaaaygaaaatactccggcttcaaagaac

SEQ ID NO: 104349 - DNA, 50 bp, homo sapien
gaaaactcattcccaaaaatatcgcmcatcctagtggcttaaattcaaat

SEQ ID NO: 104350 - DNA, 50 bp, homo sapien
ggtaagcatgtggtactttgtatttyaatcattttgattaaaaggatgga

SEQ ID NO: 104351 - DNA, 50 bp, homo sapien
tttgtatcatagtgtgtttacttgcmgataataggttatttggggagtga

SEQ ID NO: 104352 - DNA, 50 bp, homo sapien
ccaaccaatatggtatgtgagtccartctcgtccacgtatctatttcagt

SEQ ID NO: 104353 - DNA, 50 bp, homo sapien
gagtcgagagaggaaggagatagacraggagatgaagtgcggggaccaga

SEQ ID NO: 104354 - DNA, 50 bp, homo sapien
tcctgacagggcaggtattgagaaasttaattttgagatttaaattttta

SEQ ID NO: 104355 - DNA, 50 bp, homo sapien
acaccattttcctagactccttcacygtcttgacactttcctattattag

SEQ ID NO: 104356 - DNA, 50 bp, homo sapien
tattattcatggtttagaaattaaartggtagaaaatgtagtaaaatata

SEQ ID NO: 104357 - DNA, 50 bp, homo sapien
cattttgagttaggtacagtcaaagragagaagaatagatgtttccatat

SEQ ID NO: 104358 - DNA, 50 bp, homo sapien
accctggcaactgcaggttaagaaayagaccttatgtgtaattagctctg

SEQ ID NO: 104359 - DNA, 50 bp, homo sapien
acaccactagtctgattctcatataygcacactgctgtaaaagactctca

SEQ ID NO: 104360 - DNA, 50 bp, homo sapien
aaacagtgcctttcccgcagggggartttccgcagtgtactgtgactttt

SEQ ID NO: 104361 - DNA, 50 bp, homo sapien
tttccagagagtaattttctgcattsctcaacataggagtgaaaaaaaaa

SEQ ID NO: 104362 - DNA, 50 bp, homo sapien
gtgttagactatgactaaagatttayaggatgtggtacatataaataatt

SEQ ID NO: 104363 - DNA, 50 bp, homo sapien
tgtctagctagcatcaaagattagargtatgtgttgggttgggatggtgg

SEQ ID NO: 104364 - DNA, 50 bp, homo sapien
tctccatagagactatcaccaacaayaataaatcaggagcactgtctcca

SEQ ID NO: 104365 - DNA, 50 bp, homo sapien
accaaaaaatataagcaaaaacataktagtaggcattgaaactgaatagc

SEQ ID NO: 104366 - DNA, 50 bp, homo sapien
cattttgtaaaaagattacgacacarcaacttgagaaatctatagacacc

SEQ ID NO: 104367 - DNA, 50 bp, homo sapien
gtatttgaaatttatgaaataagcaygtggcattcttggatagaaatatt

SEQ ID NO: 104368 - DNA, 50 bp, homo sapien
tgtaaagaccaaattatatcagaacrcaatgtataagtaaatgtcttaca

SEQ ID NO: 104369 - DNA, 50 bp, homo sapien
aattcccctacaaaaaggcaaattartaagataatatctggaggcctcct

SEQ ID NO: 104370 - DNA, 50 bp, homo sapien
atcatatatttgtcacggcttagaamggctaatttatctccttttgtaac

SEQ ID NO: 104371 - DNA, 50 bp, homo sapien
tctgcattaaagagtcaaatataaasacaagttgaataaatcatactgga

SEQ ID NO: 104372 - DNA, 50 bp, homo sapien
tagactctttgggctaatgcaactasaagagaggtttgctcagatcttct

SEQ ID NO: 104373 - DNA, 50 bp, homo sapien
ttttcttcctccccactaccattacyattatcattttggaaacccaacat

SEQ ID NO: 104374 - DNA, 50 bp, homo sapien
agaactgggatggaagttgatttcaycgtggttgagtaagtctggtcaaa

SEQ ID NO: 104375 - DNA, 50 bp, homo sapien
ggaggagcgagtttattttgtaggcrctaccagtcaattgcattaacact

SEQ ID NO: 104376 - DNA, 50 bp, homo sapien
atagctgattcttaagatgtatgcaygtttttctactgacagaaaacatg

SEQ ID NO: 104377 - DNA, 50 bp, homo sapien
aatttaatacccaagaacttttcaayatgtggatgcgttcgtccacaaaa

SEQ ID NO: 104378 - DNA, 50 bp, homo sapien
aattatttgaaatacataaaaacagrgaaacaacatgccacaagctctgg

SEQ ID NO: 104379 - DNA, 50 bp, homo sapien
taggtatgtataatatatttgcaagratcacctatactacttaactggtg

SEQ ID NO: 104380 - DNA, 50 bp, homo sapien
ttgctgttcatagtgagatatagtasagactttaaatgattgtttatgta

SEQ ID NO: 104381 - DNA, 50 bp, homo sapien
aaaaaagttcataagctttacattayctttcatctcacttacaactttta

SEQ ID NO: 104382 - DNA, 50 bp, homo sapien
catttagctaaccaaaatcatgtccrtttaatagcagtatcttgactgac

SEQ ID NO: 104383 - DNA, 50 bp, homo sapien
aattacactgcgggtgatctgtactraggttttaccaggatcatctctgt

SEQ ID NO: 104384 - DNA, 50 bp, homo sapien
atcaagactgcctcagggaactacartgtactatgctcagatgaaaatta

SEQ ID NO: 104385 - DNA, 50 bp, homo sapien
tatagaagttacaagttttctaaatsagaatgatacagaggttatatttt

SEQ ID NO: 104386 - DNA, 50 bp, homo sapien
agctgatttatggtatctgtttgtcraagtacaatggcctcaaatggcct

SEQ ID NO: 104387 - DNA, 50 bp, homo sapien
cataccctctcttaattttttatctsagagattttgtctatttacacgtt

SEQ ID NO: 104388 - DNA, 50 bp, homo sapien
ttccttagttttttgccctcagtcargtaagataatttgttcttatacat

SEQ ID NO: 104389 - DNA, 50 bp, homo sapien
tgttttgtttttgacaatgaaattayatgagaaagattcaacaatagttt

SEQ ID NO: 104390 - DNA, 50 bp, homo sapien
cccgacctggagaaaaatttcatgastaggcagtataatcagagattgtt

SEQ ID NO: 104391 - DNA, 50 bp, homo sapien
ggctaccctgtatgtatactataagrattaaatgagaacagtgcctggca

SEQ ID NO: 104392 - DNA, 50 bp, homo sapien
ctctcagtcttttaaatcccggcctwacaccaactcttttatctggaaca

SEQ ID NO: 104393 - DNA, 50 bp, homo sapien
ttcgtagtgccacatcatcagtttcyctacgttgaagcataaatccaccc

SEQ ID NO: 104394 - DNA, 50 bp, homo sapien
ggctcttgtattggcagtttattacyatatattaacatataaactcatca

SEQ ID NO: 104395 - DNA, 50 bp, homo sapien
aaatgccaattattttacctgttacmataaatgactcataaccattgaca

SEQ ID NO: 104396 - DNA, 50 bp, homo sapien
tacatggagaaagatcaaagtagctraaagtcttagaatgtgtgatttaa

SEQ ID NO: 104397 - DNA, 50 bp, homo sapien
gtcttcggtatttattttagcagtaygaaacagactaatacaggttctca

SEQ ID NO: 104398 - DNA, 50 bp, homo sapien
ctatttgaaaatacacagagcagacmaaagaattaagcccacccaccaga

SEQ ID NO: 104399 - DNA, 50 bp, homo sapien
gaatgttataataatatctgactaaygtgaatgttatatgttttaattaa

SEQ ID NO: 104400 - DNA, 50 bp, homo sapien
tgttttatttttttcaaattttctargaccaaatatctatggatacaaaa

SEQ ID NO: 104401 - DNA, 50 bp, homo sapien
aggatgaatagaggccaataaagtaygacatgtggaccaagcctagccct

SEQ ID NO: 104402 - DNA, 50 bp, homo sapien
gttgtgaaatgtctgagtttccaaasaattcacccacactagatagttca

SEQ ID NO: 104403 - DNA, 50 bp, homo sapien
agagctgattcataaataggtgaatyaacaagtattagtttcattttagt

SEQ ID NO: 104404 - DNA, 50 bp, homo sapien
aaagaacaaaatgttcctaaccataractaaaagcagaggcaatgggacc

SEQ ID NO: 104405 - DNA, 50 bp, homo sapien
ttatttaaaagaaagtataaaaacckaagatatatagaaaaaggtaccaa

SEQ ID NO: 104406 - DNA, 50 bp, homo sapien
ctacattttcttctctattatttgtyaagtattaaaggccccagaggggt

SEQ ID NO: 104407 - DNA, 50 bp, homo sapien
tagaaatctagagctggaagctggcyatttgggtgtgagtatcagaaaaa

SEQ ID NO: 104408 - DNA, 50 bp, homo sapien
cttatgtctcccaaactctttctgayaggacttgatcaaccaatgtttgt

SEQ ID NO: 104409 - DNA, 50 bp, homo sapien
tgaagtccaatactagtaatcactcwctctgctatttattttacagaaat

SEQ ID NO: 104410 - DNA, 50 bp, homo sapien
tttaagtgaagaagattatcctcaayatcttagtggtccagattcaatca

SEQ ID NO: 104411 - DNA, 50 bp, homo sapien
ttatacactagttggagtagcatacrccccgttttgacaaccaaagtgtc

SEQ ID NO: 104412 - DNA, 50 bp, homo sapien
tttctctataaaagtcacctagttamaaaatcaaattgattcccatttct

SEQ ID NO: 104413 - DNA, 50 bp, homo sapien
ttgcctgaagcctactttactctttycataatcactccattcacatattc

SEQ ID NO: 104414 - DNA, 50 bp, homo sapien
tatactgttgctccagtatttaaaakcatagtcattttttgttgttttat

SEQ ID NO: 104415 - DNA, 50 bp, homo sapien
taacacaatgcaaactgctaagaaamtataagaaaatgaagtgttattaa

SEQ ID NO: 104416 - DNA, 50 bp, homo sapien
gttttgttggttaccttcagaattargtttaagctttcaaactagttatt

SEQ ID NO: 104417 - DNA, 50 bp, homo sapien
tttgaaaatattagatggctagaaawggtttattgtattgtactgaatct

SEQ ID NO: 104418 - DNA, 50 bp, homo sapien
taaacatttagtaattaatcaatgcyataaatgtgtaatgagtctgttct

SEQ ID NO: 104419 - DNA, 50 bp, homo sapien
cctcctaattactgccttctcccagwatttgctattctcttttatcacct

SEQ ID NO: 104420 - DNA, 50 bp, homo sapien
ggagatgataccttcatcgaagacawcctcctattagcattctagagcag

SEQ ID NO: 104421 - DNA, 50 bp, homo sapien
gaggtcaactgtacagccagtaagargtagttttaaagatttgagcttgg

SEQ ID NO: 104422 - DNA, 50 bp, homo sapien
gaaaaactttttagattcatggaacygattaaagctatgatatacattct

SEQ ID NO: 104423 - DNA, 50 bp, homo sapien
gtagaattatctcttactctgacaarttatgagttaatcatgaataatag

SEQ ID NO: 104424 - DNA, 50 bp, homo sapien
gcgaatgttacatttactgaaaacawccaattattaccttttcatcaatt

SEQ ID NO: 104425 - DNA, 50 bp, homo sapien
agaactcagtaaaattgtgaaataartgaacgtgtttaatttttaaggaa

SEQ ID NO: 104426 - DNA, 50 bp, homo sapien
tgctggcttgaaacactgtggtgaaytctatatgtaattttgcagtgagc

SEQ ID NO: 104427 - DNA, 50 bp, homo sapien
gaatcagtctcagcctgcaggtaagscaagtgggcaagataaaagtggca

SEQ ID NO: 104428 - DNA, 50 bp, homo sapien
ttattaatgaaaccaaagctttagamaacagtactattaatagtggtgac

SEQ ID NO: 104429 - DNA, 50 bp, homo sapien
aaccagaatttagtatctgttctcaycatcttactgaaattgaaaatact

SEQ ID NO: 104430 - DNA, 50 bp, homo sapien
gtggataattaccatgagtctaagargcacaaataatgatgtacagtttt

SEQ ID NO: 104431 - DNA, 50 bp, homo sapien
aagcaatttcagtggagatggtggcyatatttcagtacccaataagcagc

SEQ ID NO: 104432 - DNA, 50 bp, homo sapien
cataaagttcaagagttatacttcaycaattctttttgtcttcagcagag

SEQ ID NO: 104433 - DNA, 50 bp, homo sapien
agagtaatcacccagctaaaagtgayggaaggaatctttgacttagtaca

SEQ ID NO: 104434 - DNA, 50 bp, homo sapien
agacagaagatcaatacgtaatcacmacttgaagtatactaatcagacta

SEQ ID NO: 104435 - DNA, 50 bp, homo sapien
tgtatcatacttttgcttcagaaaayaatagcgtaaacatcaaagaggac

SEQ ID NO: 104436 - DNA, 50 bp, homo sapien
gggccaggagcactgtaccaggcatyataggactacatttctaggactac

SEQ ID NO: 104437 - DNA, 50 bp, homo sapien
cctatccaccaaatgatactaacaasaatttgtcacttagccattgcaaa

SEQ ID NO: 104438 - DNA, 50 bp, homo sapien
atatgacatatcatctcaagtattamattacagtagagagatagaagaag

SEQ ID NO: 104439 - DNA, 50 bp, homo sapien
aattgcggtttttgaactaacctaaygtatgtagcttacttctagagttc

SEQ ID NO: 104440 - DNA, 50 bp, homo sapien
atctttcagatactcagatttatacrataattgcttaggatatagtaaaa

SEQ ID NO: 104441 - DNA, 50 bp, homo sapien
tagaaaccgaggtctgccaatatgaraacagtttggattaaaaaaacatt

SEQ ID NO: 104442 - DNA, 50 bp, homo sapien
cattcagacttcctgtgtctttcacygatgtttgggcaacgataaggatt

SEQ ID NO: 104443 - DNA, 50 bp, homo sapien
tagtaatttaggatgtggctatttaytgaacaggaatgaaagctgacttg

SEQ ID NO: 104444 - DNA, 50 bp, homo sapien
ttactttaattccacatttgccctakgaaagccttcccttgtgtttcctt

SEQ ID NO: 104445 - DNA, 50 bp, homo sapien
ttctgataggaagaactgaagcggtsaacacccagaggagagaaaacatg

SEQ ID NO: 104446 - DNA, 50 bp, homo sapien
ctgggtacccttgtaagtttgtggcrcacgtttgtatctggttctgcgtc

SEQ ID NO: 104447 - DNA, 50 bp, homo sapien
actgatacttttttatgtttaaaaargtaatgatgacaataataacaatg

SEQ ID NO: 104448 - DNA, 50 bp, homo sapien
tttgaggacatgtcctttttgatgaygtataaagagcaattattcaacaa

SEQ ID NO: 104449 - DNA, 50 bp, homo sapien
acctttctgagaagggaggtattaasgaacaaaacacgtctcagttattt

SEQ ID NO: 104450 - DNA, 50 bp, homo sapien
aattgctgggcctgaccccaaaactstctgattcagtaggctaggaggtg

SEQ ID NO: 104451 - DNA, 50 bp, homo sapien
ttaagcaagcaaatattcacattacygaaatgttagagagagaagagatg

SEQ ID NO: 104452 - DNA, 50 bp, homo sapien
ttttcttttaacttcatcattaattytgcactaacttttatatcatatta

SEQ ID NO: 104453 - DNA, 50 bp, homo sapien
cttgtggtttggcttagctgcttggraagtcagtcacatttgtgacccat

SEQ ID NO: 104454 - DNA, 50 bp, homo sapien
gttgttttgccttatttgtattcagrcataatacttggcttcagaacatt

SEQ ID NO: 104455 - DNA, 50 bp, homo sapien
tgctaagttgggggagtcattttagwtgtcttgcttaattaggacttagg

SEQ ID NO: 104456 - DNA, 50 bp, homo sapien
tatcctttctaatcttaataatacgyaaaagaagtatgaaaaatttcact

SEQ ID NO: 104457 - DNA, 50 bp, homo sapien
tacttgtccttgcatccttccaatasagcaagtggcttaggcagccttaa

SEQ ID NO: 104458 - DNA, 50 bp, homo sapien
aatctagactaaaataaattggagamgagattagagctggagaatgaaat

SEQ ID NO: 104459 - DNA, 50 bp, homo sapien
gggcatttcttggtttggagggaacsaggtgattctcagtagaagtgtct

SEQ ID NO: 104460 - DNA, 50 bp, homo sapien
gatgacaatgctattaagattcgaargcagcattcgaagaggtccctctt

SEQ ID NO: 104461 - DNA, 50 bp, homo sapien
cgctgtataggtcttactactgtcaktctcatccagatgattttcaagac

SEQ ID NO: 104462 - DNA, 50 bp, homo sapien
ccaaccagtacgggagaccctactcsgagattctcaatcaaggtttaaga

SEQ ID NO: 104463 - DNA, 50 bp, homo sapien
tgacacctcaactggagtcacaattytgctaacagtactacaggtaggta

SEQ ID NO: 104464 - DNA, 50 bp, homo sapien
actgaaaatgtggaaggtgtttgaayctaattgcttaatattttgaaaat

SEQ ID NO: 104465 - DNA, 50 bp, homo sapien
ggaggtggcaaatggggttcgctgarttattcttgtttgtcaatcttgaa

SEQ ID NO: 104466 - DNA, 50 bp, homo sapien
gtgctaaatcattttatgtctctaaraattgatgaacagcaaacatccaa

SEQ ID NO: 104467 - DNA, 50 bp, homo sapien
ttttatcatctggacaagaggagaayaaaaataacaaagagacagaatct

SEQ ID NO: 104468 - DNA, 50 bp, homo sapien
gagaaaaggaaaaggtcaagtagtasagcaaccaacgaccactatgaaga

SEQ ID NO: 104469 - DNA, 50 bp, homo sapien
ggcctacagaccacttggctttttargtgatagcttgctagatcatgaga

SEQ ID NO: 104470 - DNA, 50 bp, homo sapien
gataggactaacatcccataaatatragatctgatataaaagctatagct

SEQ ID NO: 104471 - DNA, 50 bp, homo sapien
gattatatgcactaatgttataaaaktctggtgagtcaggtggtgtactc

SEQ ID NO: 104472 - DNA, 50 bp, homo sapien
taggaagacagaaggaaataaattaygaggaggacttagtatgaagtgac

SEQ ID NO: 104473 - DNA, 50 bp, homo sapien
attttatggtttaattccttgcattyaaattttctgatgcatctgggatt

SEQ ID NO: 104474 - DNA, 50 bp, homo sapien
tgagccataaaacatgaacaggataytatgaaaaaagaacaaaaccttct

SEQ ID NO: 104475 - DNA, 50 bp, homo sapien
tgctggggctggaggtcaacttatcraactttaatgagaggtacattata

SEQ ID NO: 104476 - DNA, 50 bp, homo sapien
gaaactattatctcccttgctcaagrtaatctacttttcctagagcagtc

SEQ ID NO: 104477 - DNA, 50 bp, homo sapien
gctctcaaaactcacaaatatttcartctatttcatcatgataaagatta

SEQ ID NO: 104478 - DNA, 50 bp, homo sapien
gagtggtacatcacgttcttcttttmtcttgccacagctatagttgggtc

SEQ ID NO: 104479 - DNA, 50 bp, homo sapien
agtttcaaatggatggtaggaaggaratgttagatgaaggtcttttgagt

SEQ ID NO: 104480 - DNA, 50 bp, homo sapien
tttttcacaggtttcttcacgagacyctgtatatagcagttattcaatac

SEQ ID NO: 104481 - DNA, 50 bp, homo sapien
tttttatttttttcagagatatccakaatttcgccaaatggtgatgtttt

SEQ ID NO: 104482 - DNA, 50 bp, homo sapien
aaaggtatatgggaattcttattcaygctttcagatatttaatattgtca

SEQ ID NO: 104483 - DNA, 50 bp, homo sapien
agcagtaaaaatgagttcaagggacrcctaagataacaataacaggataa

SEQ ID NO: 104484 - DNA, 50 bp, homo sapien
gctagttacatgactgtgttttaggygataacatttcatagaactacata

SEQ ID NO: 104485 - DNA, 50 bp, homo sapien
aaaatcctgtttaatcagccgtagcragctatgtgccattctctgtggaa

SEQ ID NO: 104486 - DNA, 50 bp, homo sapien
aattctatgtgcttgagcaaacaaakttaccatggaaatctctgtataac

SEQ ID NO: 104487 - DNA, 50 bp, homo sapien
gtactcttgtaaatacttaacactcratgcagaaagaattgttacaaagg

SEQ ID NO: 104488 - DNA, 50 bp, homo sapien
actccaaaagtactattttcatttamaagacggtaaaataatttgtgcca

SEQ ID NO: 104489 - DNA, 50 bp, homo sapien
tttttccatactcatgtgtgaggaaygaaacaccttaaacaatgcacatg

SEQ ID NO: 104490 - DNA, 50 bp, homo sapien
taaagccatgtgataatgctgcccartgcaaattttgaaatgctagtacg

SEQ ID NO: 104491 - DNA, 50 bp, homo sapien
agcattgggacgtgagatgagaaagyatgtaatgaaggacttggtccaaa

SEQ ID NO: 104492 - DNA, 50 bp, homo sapien
tctagttttcattggtctgcatgtcmaatccttctgtttcacacattgaa

SEQ ID NO: 104493 - DNA, 50 bp, homo sapien
ttagccaatttatatcagtgaagttmatcgtgccccaaaacaattgaaag

SEQ ID NO: 104494 - DNA, 50 bp, homo sapien
aagacaggttaacaagagaagagcayaacgaatttatttaatcaacgttt

SEQ ID NO: 104495 - DNA, 50 bp, homo sapien
gaaaggaatcattcatatatacacamgcactcatgacaaatcttacttat

SEQ ID NO: 104496 - DNA, 50 bp, homo sapien
aaatatgtaagggacacatcttaaasgagaggtgctgtaataaaatatct

SEQ ID NO: 104497 - DNA, 50 bp, homo sapien
ccttattcatcaccctcattctctcyaggctggtacatcccggtctagga

SEQ ID NO: 104498 - DNA, 50 bp, homo sapien
tgtgatcattaggaaagcaataagaygagttttagtgaacattgaaggat

SEQ ID NO: 104499 - DNA, 50 bp, homo sapien
gaccaagcaaggtaatatagtaacargttctgggaattaagatatgggca

SEQ ID NO: 104500 - DNA, 50 bp, homo sapien
tgagacatttctatggatacagaaarttagagaaataatgtgagtccaag

SEQ ID NO: 104501 - DNA, 50 bp, homo sapien
tttgtggctctagaggcctcagaccraagtcatagctgaacaggtaacaa

SEQ ID NO: 104502 - DNA, 50 bp, homo sapien
ttcaccctgtttgtggttcttcataragattgcataggacttagttaagt

SEQ ID NO: 104503 - DNA, 50 bp, homo sapien
ctaaatccaatcttatcagaattaaracataagttcattaacatttcact

SEQ ID NO: 104504 - DNA, 50 bp, homo sapien
attcttttatatagctttgtaagcarcgttatgcaaggtttaaaaattta

SEQ ID NO: 104505 - DNA, 50 bp, homo sapien
ggtatttgctgtataaatccataagraagtgaactgagaaaaagagaatg

SEQ ID NO: 104506 - DNA, 50 bp, homo sapien
gagaatttatacaagtgccgaataartgcagtcactgttgtttagtaccc

SEQ ID NO: 104507 - DNA, 50 bp, homo sapien
gttccataacctttggggccaattayaggtcatggatacactgttcctaa

SEQ ID NO: 104508 - DNA, 50 bp, homo sapien
gaaaaataggaggcttttaacgccartacatgaccagacagccagtgaac

SEQ ID NO: 104509 - DNA, 50 bp, homo sapien
caaataacacaaatgttcctgcttcrtgccactagctcgccccttcccca

SEQ ID NO: 104510 - DNA, 50 bp, homo sapien
tcttcctcttccttcctaaatcctgwatctctatgctgggaggtgacgga

SEQ ID NO: 104511 - DNA, 50 bp, homo sapien
cattgtatttcggctttctatttacraatcaacacttgactctatagaca

SEQ ID NO: 104512 - DNA, 50 bp, homo sapien
gtttggctaaattagatgaataagakagaccttcataataaattaaatct

SEQ ID NO: 104513 - DNA, 50 bp, homo sapien
gagtaggaggtttgaggggaatcaaycgaaatatgagctcttaagaggca

SEQ ID NO: 104514 - DNA, 50 bp, homo sapien
aatgctttctattatatgttacctaygctttttgcagaatttttaaaaaa

SEQ ID NO: 104515 - DNA, 50 bp, homo sapien
cagcaatcactgaagcacgtttacayagtcagagcaaacagagatgggag

SEQ ID NO: 104516 - DNA, 50 bp, homo sapien
actgggatatggtacagttaaaacayagtatgcatgaagacataactgct

SEQ ID NO: 104517 - DNA, 50 bp, homo sapien
taaacactttagaaatgccttttacyaggaaactgaattacagcaatcaa

SEQ ID NO: 104518 - DNA, 50 bp, homo sapien
aaaatagcaaataacaaaaattgtaraatgcaagggagaaatttctgatt

SEQ ID NO: 104519 - DNA, 50 bp, homo sapien
tactagaaatccctgggtgaaccacracaagccttttaagactagcaagc

SEQ ID NO: 104520 - DNA, 50 bp, homo sapien
atagaatatttcagtatagtgactcygaatatctaatacataaagacttg

SEQ ID NO: 104521 - DNA, 50 bp, homo sapien
gatggataacttgagtgatccctgcrgtattgtttctactagttacttaa

SEQ ID NO: 104522 - DNA, 50 bp, homo sapien
tactggtactttaattctatagcctraatacctggtttgggatttctgga

SEQ ID NO: 104523 - DNA, 50 bp, homo sapien
taatatgtatcacattctaaacatcrtaaggaaattaaatatataaagat

SEQ ID NO: 104524 - DNA, 50 bp, homo sapien
ctgttttttttaaactcttacctgartatgcttcgacctacttctttatt

SEQ ID NO: 104525 - DNA, 50 bp, homo sapien
tatcatttcatttagatatgaagaarttaagatagaaatattgcagacat

SEQ ID NO: 104526 - DNA, 50 bp, homo sapien
ttttttgggataaactgtgcatccartccctaggttactcaaatccttgc

SEQ ID NO: 104527 - DNA, 50 bp, homo sapien
tggaggcttgtttccacataagtcaytcattttcccatggtaagcagaca

SEQ ID NO: 104528 - DNA, 50 bp, homo sapien
cttcccaatggatcattaactttackaaatcatttcttgcattaagtaac

SEQ ID NO: 104529 - DNA, 50 bp, homo sapien
aaggtttgttttctgtcttgttatakaccctttcatcagaatacagaagt

SEQ ID NO: 104530 - DNA, 50 bp, homo sapien
ttaccactttgggttaaactcacackgcaagttgctatgacaacagagat

SEQ ID NO: 104531 - DNA, 50 bp, homo sapien
ttttcttttttaggaagtagataatmagactgttgcctctagggatttat

SEQ ID NO: 104532 - DNA, 50 bp, homo sapien
tcaaataaggaaattggagctcagarggttatccgattttaccagggaca

SEQ ID NO: 104533 - DNA, 50 bp, homo sapien
tttctctcacctgaactattaggaartcttgctaccattaatattcatag

SEQ ID NO: 104534 - DNA, 50 bp, homo sapien
atgcatatgactatgtatgtatttayggttccgtgatatggagttcaaaa

SEQ ID NO: 104535 - DNA, 50 bp, homo sapien
cctttggtaataaatatcagaattaygagcaatgtgttttctaagtcaga

SEQ ID NO: 104536 - DNA, 50 bp, homo sapien
atttggcttttatatttcacatttcraactaatcatatttagcatactat

SEQ ID NO: 104537 - DNA, 50 bp, homo sapien
ttccctgtagcttgtacttttccaargacatacttttcaatgaaaaactc

SEQ ID NO: 104538 - DNA, 50 bp, homo sapien
tgttgatagttacttagaaaactgaygaaagattataccagaagtaaagg

SEQ ID NO: 104539 - DNA, 50 bp, homo sapien
attgaaacaacaattatttttgaaargtacattctttaaagagcttctca

SEQ ID NO: 104540 - DNA, 50 bp, homo sapien
taatgacttgttgattacagaaaatragcaagggtttctagtcagtctgt

SEQ ID NO: 104541 - DNA, 50 bp, homo sapien
ctgtagaatggatacaacaaaaagaratggcagtaccaagtgttgaagag

SEQ ID NO: 104542 - DNA, 50 bp, homo sapien
ctgaagtgcctcccatgctccatgamataattgcttttgaatgaccctaa

SEQ ID NO: 104543 - DNA, 50 bp, homo sapien
agttttcttatggggaaaccacagaygaggccgtggggacataatgtagg

SEQ ID NO: 104544 - DNA, 50 bp, homo sapien
tccctctcatcattgtttcacgttasatcttgttacttttccatgacctt

SEQ ID NO: 104545 - DNA, 50 bp, homo sapien
ctactctgttgagtcatccaaatcamagtattaatttttgtcacttataa

SEQ ID NO: 104546 - DNA, 50 bp, homo sapien
tttgctgtgatgctgataagctttarcgccacacttttcactgcctggat

SEQ ID NO: 104547 - DNA, 50 bp, homo sapien
gccctttcttggatagaattattagrccttgaaatcattaaaaaaaatcc

SEQ ID NO: 104548 - DNA, 50 bp, homo sapien
gtaagtaccatattacttttcacaaygtacggatgaagaaacaagaatgc

SEQ ID NO: 104549 - DNA, 50 bp, homo sapien
tcttggcataaattccatcaatcaaraggtgaagcattgcagtcaaaaag

SEQ ID NO: 104550 - DNA, 50 bp, homo sapien
taaaatatcataggaacatctataamagttaaatccgatatttttttgct

SEQ ID NO: 104551 - DNA, 50 bp, homo sapien
gtgtaaacaaataatggtgagtaaayctactggcagctcagcctacataa

SEQ ID NO: 104552 - DNA, 50 bp, homo sapien
tttcaaacaaaaattaaagagcaagratcattactgtataaatttttccc

SEQ ID NO: 104553 - DNA, 50 bp, homo sapien
cactgagattgctacacagagcataraataaaaatcctaagtgtgtagtc

SEQ ID NO: 104554 - DNA, 50 bp, homo sapien
tcttctgacttgttctgatttgctaraaaccttcctgaagtgcaggattg

SEQ ID NO: 104555 - DNA, 50 bp, homo sapien
atctgtcaggaatgctcccttggtayagtcatgcttcaattctgatcttc

SEQ ID NO: 104556 - DNA, 50 bp, homo sapien
acagtagagacatgtaggaataaatyaactaaaggatatgcaagacttct

SEQ ID NO: 104557 - DNA, 50 bp, homo sapien
aactttgttcgttgacgtcacaaagraaaacaaatgatagctagaagttt

SEQ ID NO: 104558 - DNA, 50 bp, homo sapien
acatatcattgctacagcagttagaygactgtaaagtagttatatgcttg

SEQ ID NO: 104559 - DNA, 50 bp, homo sapien
tagaaatgacagcagtctctgattascgtggttctctgaatgcagtatcc

SEQ ID NO: 104560 - DNA, 50 bp, homo sapien
ttttctctggcttaaaagacttagamaaaatgaaacagaaaagtcacatt

SEQ ID NO: 104561 - DNA, 50 bp, homo sapien
tacccagtctaaattgaactcattarcttgcctccaaaagagcctagtcc

SEQ ID NO: 104562 - DNA, 50 bp, homo sapien
aaagccactgatctgcccaaggacaygagtaaatgcctcgagagctctgc

SEQ ID NO: 104563 - DNA, 50 bp, homo sapien
gtcattgaagtggactctctaatatragtttattcattatctaggccatt

SEQ ID NO: 104564 - DNA, 50 bp, homo sapien
tagcatgcttagacagctcatagaarcagaagacatgacttttatagttc

SEQ ID NO: 104565 - DNA, 50 bp, homo sapien
ggcctacctaatctcactaaaattcragaatattcaaaatttattttaat

SEQ ID NO: 104566 - DNA, 50 bp, homo sapien
aaaataagatcttactggaaatagayatgtcaatatattaacagaggtta

SEQ ID NO: 104567 - DNA, 50 bp, homo sapien
tgccagttagtggtgctgtttgggartaataaacattttgataaagacgt

SEQ ID NO: 104568 - DNA, 50 bp, homo sapien
aaagagatgccctagatcaatcaatkagcctgttcctaccagttactttt

SEQ ID NO: 104569 - DNA, 50 bp, homo sapien
cagtttcagaattactgttaactccraattgccaattacagcttgacttt

SEQ ID NO: 104570 - DNA, 50 bp, homo sapien
tttcaggatccaattctgtatcgaaraacttgacctttaaactagttaaa

SEQ ID NO: 104571 - DNA, 50 bp, homo sapien
gagtgtaatcacaagagtgctgatasatgtgaggtagcagaatcaaaggc

SEQ ID NO: 104572 - DNA, 50 bp, homo sapien
tgcttttaatttgtgtggtcttaccractaattaatctaccataatttgg

SEQ ID NO: 104573 - DNA, 50 bp, homo sapien
attaaaaacagacctttatattgaawctctacatgaaaaggattacatta

SEQ ID NO: 104574 - DNA, 50 bp, homo sapien
gctataatcacccagtgagtagcttrgtatcaggtatccaagataggagt

SEQ ID NO: 104575 - DNA, 50 bp, homo sapien
ttctttttattccttaaagaatatcygacaatttgctggtttgtataagt

SEQ ID NO: 104576 - DNA, 50 bp, homo sapien
ttaaggaataaaaagaattggcaaakcttggtgatacatgggtactttta

SEQ ID NO: 104577 - DNA, 50 bp, homo sapien
tacatataaatattgaataataaatratagctgctgtttgatcaaaatga

SEQ ID NO: 104578 - DNA, 50 bp, homo sapien
gtgcaacaaaaatcatgcatcataartagaatattacaaattgtacttca

SEQ ID NO: 104579 - DNA, 50 bp, homo sapien
cattagagaaatgcaaatacaacaamgagatattgctacatagctattca

SEQ ID NO: 104580 - DNA, 50 bp, homo sapien
cttgtcaatactatcactatgcctayttgtaataagagcagtcatttaaa

SEQ ID NO: 104581 - DNA, 50 bp, homo sapien
taattttcctattacgtattcccaamatcattgtataaaagatccagttc

SEQ ID NO: 104582 - DNA, 50 bp, homo sapien
atgactgaatcatatggttggtatasatttcactatttaacatactgcca

SEQ ID NO: 104583 - DNA, 50 bp, homo sapien
gcatggagtttctgtctacactgacyataacctagcctcttagtgctgcg

SEQ ID NO: 104584 - DNA, 50 bp, homo sapien
gctattaaataccaaatttccacacrggagaatgatctcagttaatgcct

SEQ ID NO: 104585 - DNA, 50 bp, homo sapien
taacaattctgcatatggaaaacacraggttattcatccatttaaacatt

SEQ ID NO: 104586 - DNA, 50 bp, homo sapien
cctgaccaatagtaaatggttgttamgtgtatatgtatatgagtgtgtat

SEQ ID NO: 104587 - DNA, 50 bp, homo sapien
tctaccaaatattaaatcatacttcmatcttcagtattccagttcacaaa

SEQ ID NO: 104588 - DNA, 50 bp, homo sapien
attcacgtgatactttttcttttcasaggaaagcatttgttttagcttgg

SEQ ID NO: 104589 - DNA, 50 bp, homo sapien
aaggcaggcttcgtattctacttcartaacagcccaaatgatgtgtatgc

SEQ ID NO: 104590 - DNA, 50 bp, homo sapien
ttcagctctagttcctagcataatamagatacgtaggtggcatttaaaaa

SEQ ID NO: 104591 - DNA, 50 bp, homo sapien
gtagtatttaagcatacaacataggrcaagagtagagaaacatgaggcta

SEQ ID NO: 104592 - DNA, 50 bp, homo sapien
aagtctgtttgtcaatacagtaaaawgcgtagaacagtttgtcacattgt

SEQ ID NO: 104593 - DNA, 50 bp, homo sapien
tcttttcacacacataggtactggcraacagcggtatcaaactgtgacca

SEQ ID NO: 104594 - DNA, 50 bp, homo sapien
tttggatcctgattaaatgtatcaaygtaggtaatatattgtgattgttt

SEQ ID NO: 104595 - DNA, 50 bp, homo sapien
acaagggaatgtttcgtgtagtggarataatgaagacaatgaagatgagg

SEQ ID NO: 104596 - DNA, 50 bp, homo sapien
attattttctcctgttgaacctgacygtcaaacgtattgtttgttacatc

SEQ ID NO: 104597 - DNA, 50 bp, homo sapien
ctccattttatgttgtccaaaacaamcaaatattgcatcctccaaaatct

SEQ ID NO: 104598 - DNA, 50 bp, homo sapien
ataggtcataataataaatttagaartccctttataagagtataccaatc

SEQ ID NO: 104599 - DNA, 50 bp, homo sapien
tgtataatatcttttaatctttacartggcctcatgaggtcggaactggg

SEQ ID NO: 104600 - DNA, 50 bp, homo sapien
acatctattctaattaaaaacaccaytgataatcgtttacaagtgcaaga

SEQ ID NO: 104601 - DNA, 50 bp, homo sapien
aaataattataatgattggttatatmaatgatggggtgtgttttcatggg

SEQ ID NO: 104602 - DNA, 50 bp, homo sapien
attcattataatgctaacttctatgyttattggtttataatctaatatat

SEQ ID NO: 104603 - DNA, 50 bp, homo sapien
attcaaaaaagtggaggaatccttgyaaatttccctggtaatcagaagtt

SEQ ID NO: 104604 - DNA, 50 bp, homo sapien
cccatgttgtagcacacttattttaygcatttgctaaatgactatgcccc

SEQ ID NO: 104605 - DNA, 50 bp, homo sapien
taatcacaactaaagactgaatcackgatctggtggataaaatagaagag

SEQ ID NO: 104606 - DNA, 50 bp, homo sapien
gccagaattattttaaagtgaattcsatgcttaatttgtgcagaggtcat

SEQ ID NO: 104607 - DNA, 50 bp, homo sapien
catcacaggggctgatgcaggggaartgcagtccaagtgccagccccaga

SEQ ID NO: 104608 - DNA, 50 bp, homo sapien
gaattatctaaataaaataccatagrcccatttacatgttacatattaca

SEQ ID NO: 104609 - DNA, 50 bp, homo sapien
aggtaactgatattgtagtcgttgaycttgtgctcaaaatgcccaatgtt

SEQ ID NO: 104610 - DNA, 50 bp, homo sapien
taaatactaaaataggtcactctcayccaagatttaagaaatgttacctt

SEQ ID NO: 104611 - DNA, 50 bp, homo sapien
cagcaaaactgatgactataacaacygtattagaaagacagatattgatt

SEQ ID NO: 104612 - DNA, 50 bp, homo sapien
ccacaaaagaccttaataactgatascatgtcttatcttggccaaggaag

SEQ ID NO: 104613 - DNA, 50 bp, homo sapien
tggcactattgatgtttcaggctacmtaattctttgttgagggtgggggt

SEQ ID NO: 104614 - DNA, 50 bp, homo sapien
gatagcatattcaatattttcctaayaacagtagtaataaacatcaaatc

SEQ ID NO: 104615 - DNA, 50 bp, homo sapien
ccagcctgctgcttacaatgtgttakagatgcttctcagggaggattgct

SEQ ID NO: 104616 - DNA, 50 bp, homo sapien
gcaatgaatggctaaccatatctatragcaaggccaatttcactcaagat

SEQ ID NO: 104617 - DNA, 50 bp, homo sapien
ggagggatagcttcttgagaatgtcmatttactgagggcaaggattgtgt

SEQ ID NO: 104618 - DNA, 50 bp, homo sapien
gaccaaatgatatttgggaagggccrctgagtacctctatctagaacctg

SEQ ID NO: 104619 - DNA, 50 bp, homo sapien
ctaattttgattgctcttagcagtgyaaaagaggagctacacagcttgat

SEQ ID NO: 104620 - DNA, 50 bp, homo sapien
aaaagtctcttataccacctacttcrcatcaaaaggagactcattcagat

SEQ ID NO: 104621 - DNA, 50 bp, homo sapien
accaggctgccctgggactgacttayggtttagaaagatttaaaagagat

SEQ ID NO: 104622 - DNA, 50 bp, homo sapien
ttaagacactggtgtgctaaagaaaygtggactctaactgggcaaacaaa

SEQ ID NO: 104623 - DNA, 50 bp, homo sapien
accacttgtttcacattagactgcaycatcctgtttcacaacacttcata

SEQ ID NO: 104624 - DNA, 50 bp, homo sapien
taaattatggtacgtaccaattatamtgctgttaaaaagaatgacgtgga

SEQ ID NO: 104625 - DNA, 50 bp, homo sapien
cttactaggtgctgagaattgaaagraaggtgctacagttgacacagatc

SEQ ID NO: 104626 - DNA, 50 bp, homo sapien
tggatcccaatatcaacaatgtacgwatttatttatttgttcaattctag

SEQ ID NO: 104627 - DNA, 50 bp, homo sapien
gaatgtatattcccactcaagcagtyaagttccaatgtccgcactcttaa

SEQ ID NO: 104628 - DNA, 50 bp, homo sapien
tcagtaattcatcattcgactatcawaacgtatccgttttttaatatttc

SEQ ID NO: 104629 - DNA, 50 bp, homo sapien
aatccatgggaggaaactgcagcackcatgtctttcgccacatcactcca

SEQ ID NO: 104630 - DNA, 50 bp, homo sapien
ctaaattcagtccattgctgtgataractttaaaaatcaaaatgttaatt

SEQ ID NO: 104631 - DNA, 50 bp, homo sapien
caataaatatttattgaaggaagacraatgaaagtctattccattaaagc

SEQ ID NO: 104632 - DNA, 50 bp, homo sapien
aataatgtaccaaatgaaaagtaggyaaaatgaatacaataggtcaccca

SEQ ID NO: 104633 - DNA, 50 bp, homo sapien
gattcccgtaggttttgtgtagtgayggcatttatgcttaaaatgtaagt

SEQ ID NO: 104634 - DNA, 50 bp, homo sapien
acggtgctacacttggagattaacamtggaacgtctttccttctagttta

SEQ ID NO: 104635 - DNA, 50 bp, homo sapien
tgcaccaccacccagggtagagacartggactaacagcaactgacaccta

SEQ ID NO: 104636 - DNA, 50 bp, homo sapien
aagagcatgacacaaagtaacatackcatggtcggaatttaacaaatgtg

SEQ ID NO: 104637 - DNA, 50 bp, homo sapien
ggtgcttcttattagacccattcagraagaaagtaagtctagaggagcca

SEQ ID NO: 104638 - DNA, 50 bp, homo sapien
aacattgagcttcttgaagaacttaycttgatggaaactgtatatcatgc

SEQ ID NO: 104639 - DNA, 50 bp, homo sapien
gccaaatacacttccctggactccaytagtatgtaaaatgttcagctgaa

SEQ ID NO: 104640 - DNA, 50 bp, homo sapien
gtcatcttgaatccacagagaagaawaagcctgatgacacactgacacac

SEQ ID NO: 104641 - DNA, 50 bp, homo sapien
aggagaagaagagggtcaccaggcargcgtttctgcagaagttgacattt

SEQ ID NO: 104642 - DNA, 50 bp, homo sapien
gcagacagacgtttctctgtagagtraatagtgacagagatgtattagaa

SEQ ID NO: 104643 - DNA, 50 bp, homo sapien
gtctatgtatgacttacacaaatacygcaaatcttaggggaacagaaaga

SEQ ID NO: 104644 - DNA, 50 bp, homo sapien
tagagagcctctccctgtttatttarattgatacttataaaggtaactca

SEQ ID NO: 104645 - DNA, 50 bp, homo sapien
tgtctaaaacaaagggattcgtctakgtatgacttacacaaatactgcaa

SEQ ID NO: 104646 - DNA, 50 bp, homo sapien
ttaaatatggattggcttagaacaayattccttaattgtgttagatcaca

SEQ ID NO: 104647 - DNA, 50 bp, homo sapien
atatatcctgattttgtttgacatamgggttttaatattagctacagaaa

SEQ ID NO: 104648 - DNA, 50 bp, homo sapien
gtgttgatccctcagctgaaccttcraaaatttgttccaaatccaagagg

SEQ ID NO: 104649 - DNA, 50 bp, homo sapien
atgtccagaaatctaagtatggaacycttgactttttacctaaataccaa

SEQ ID NO: 104650 - DNA, 50 bp, homo sapien
actcaggaagcattttctgagaactwacttaattatgggtcagggcaaat

SEQ ID NO: 104651 - DNA, 50 bp, homo sapien
tttaaaacttacattatttgaaagayattgttaggtaaatgaaaagacaa

SEQ ID NO: 104652 - DNA, 50 bp, homo sapien
acaagtttgggttatctattcaccakggtaaacacctccctgacataaaa

SEQ ID NO: 104653 - DNA, 50 bp, homo sapien
ttaaaaaaaattctattaattctaaygtgtatccctattgtaatctttta

SEQ ID NO: 104654 - DNA, 50 bp, homo sapien
aatgtatgtgatgccattttcagacrtttagagctatgttactgattgtt

SEQ ID NO: 104655 - DNA, 50 bp, homo sapien
accaagaaccaaaaaaaaaaagttayagagtgcgttatgcataatgtttt

SEQ ID NO: 104656 - DNA, 50 bp, homo sapien
tgttaaacaacacattcaaaaattcragaaaaaaacagcatctgaatgcc

SEQ ID NO: 104657 - DNA, 50 bp, homo sapien
tcatgccacactcccttggcattacyatctcccttcattagaaaatgctg

SEQ ID NO: 104658 - DNA, 50 bp, homo sapien
tgcaggttcttatatttcaaagtaartgtatttgatattcaagtaagtca

SEQ ID NO: 104659 - DNA, 50 bp, homo sapien
gctgataatgaccatcatgtggaaartcaactgttagaatctaagataca

SEQ ID NO: 104660 - DNA, 50 bp, homo sapien
agaggaaaaaaaagtgcagatttccrctagcaatgatgctaaaggtgaat

SEQ ID NO: 104661 - DNA, 50 bp, homo sapien
gtacactcagatgattccttcagacygtctcttgtcagggagagtaagaa

SEQ ID NO: 104662 - DNA, 50 bp, homo sapien
agctgtagatgggcaaggaggagacrcctctcagtagatatctctgcatt

SEQ ID NO: 104663 - DNA, 50 bp, homo sapien
atttcatgaatagttttactcatccyagtttatttgaagatgaacgggac

SEQ ID NO: 104664 - DNA, 50 bp, homo sapien
atgaaaacaacagatggaaactgacycttatgctagaaaaacaaatatgt

SEQ ID NO: 104665 - DNA, 50 bp, homo sapien
aggaattaatcaggataataaacaargtatatgaacaatatgtctagctt

SEQ ID NO: 104666 - DNA, 50 bp, homo sapien
ttccaaaaactgaactctaagaaaamaacaatgacaatgtatctcttcca

SEQ ID NO: 104667 - DNA, 50 bp, homo sapien
aatgtcagttcttcaacttatttacraactgatcaggtccaatatttatc

SEQ ID NO: 104668 - DNA, 50 bp, homo sapien
atgaatctggcatgttaatgaataayggtttgatccaaatattacattca

SEQ ID NO: 104669 - DNA, 50 bp, homo sapien
gctgtgagtattaaatgagataacaygcaaagtaactagcacatgatgat

SEQ ID NO: 104670 - DNA, 50 bp, homo sapien
gaaaaaagaaacacggtaatagataygggcaaaacataccagaagatgat

SEQ ID NO: 104671 - DNA, 50 bp, homo sapien
aaaagagttaagaatagattaagtarcagtatccatcatatacctatcaa

SEQ ID NO: 104672 - DNA, 50 bp, homo sapien
gtgtagtggcacagtctcagcttgcygcaatcttggtctcccgggttcaa

SEQ ID NO: 104673 - DNA, 50 bp, homo sapien
taccagcacagaactaacctaggaamagctgagcctcatttatttaacct

SEQ ID NO: 104674 - DNA, 50 bp, homo sapien
tgatgcaggaaatgtatgtgtgatawaagccatgcgatacgttcatatag

SEQ ID NO: 104675 - DNA, 50 bp, homo sapien
caaaagtgcattacagttaaagacarggagtttaatatgtataaatttat

SEQ ID NO: 104676 - DNA, 50 bp, homo sapien
agatgtggtcacagagaattctaaayaaaataaattgcaaagagaaatga

SEQ ID NO: 104677 - DNA, 50 bp, homo sapien
ctgctgagggactcttgctgggtgaragaagtaccttccgtgttttcttc

SEQ ID NO: 104678 - DNA, 50 bp, homo sapien
aaattgtcacaagtaaccataccaaygatctgtgaagtgaccaaaaagca

SEQ ID NO: 104679 - DNA, 50 bp, homo sapien
caacctgctttgatcaccaaatgagwcagggagaagaacatggatggaaa

SEQ ID NO: 104680 - DNA, 50 bp, homo sapien
aatgacaccccaattttgatgattarccttccatctgttgtccacttctt

SEQ ID NO: 104681 - DNA, 50 bp, homo sapien
gtcttctccctatgtcttatcagaamgctatcaattacaatgttcacaga

SEQ ID NO: 104682 - DNA, 50 bp, homo sapien
aggtctagaaaagttgagataagatwaagcatgtgttcttatcactctgg

SEQ ID NO: 104683 - DNA, 50 bp, homo sapien
catgatggtctgtagaaaatctggamgaatcaatcaaaaaatacacttag

SEQ ID NO: 104684 - DNA, 50 bp, homo sapien
accataaaacatatgtgtagtttcayggagaagttctctttaaatgaact

SEQ ID NO: 104685 - DNA, 50 bp, homo sapien
acaaaacatagagtacttcactcagratgaaatataaatatcaacactga

SEQ ID NO: 104686 - DNA, 50 bp, homo sapien
ttaggaagccttacatgtttctccasattaagacaaggttaatcataatt

SEQ ID NO: 104687 - DNA, 50 bp, homo sapien
tagtaattagagtgtggcattctgasaaaatcaggtgagtgattccacag

SEQ ID NO: 104688 - DNA, 50 bp, homo sapien
catgagtagtcagttcttttagcatrtgtgaaaaacagaaacatgaaaat

SEQ ID NO: 104689 - DNA, 50 bp, homo sapien
aagataaaagataaagaaatataaakctacccaactgtggaatcactcac

SEQ ID NO: 104690 - DNA, 50 bp, homo sapien
tcagatgacatcggcctggaatgtcrccaacagtttgagatggcaacaat

SEQ ID NO: 104691 - DNA, 50 bp, homo sapien
gccaaaccacctactatggctatacrctgatcactagcacctgtgtaatg

SEQ ID NO: 104692 - DNA, 50 bp, homo sapien
aagtgtgatgatttgtcttttgtaarcctatgaactagaatgactcacat

SEQ ID NO: 104693 - DNA, 50 bp, homo sapien
atggcagagattacatatctcatcaraataactttctatgctttatgctg

SEQ ID NO: 104694 - DNA, 50 bp, homo sapien
tgactttgaagattaacaaagctaartacgtaaatgatatcaacatgaga

SEQ ID NO: 104695 - DNA, 50 bp, homo sapien
ttccattcgtaacacaatttttatgmaacgacaagaccaaaagaacaaat

SEQ ID NO: 104696 - DNA, 50 bp, homo sapien
gagataaagcaaggatgttctcaggyatatgctggatttcttttaatatt

SEQ ID NO: 104697 - DNA, 50 bp, homo sapien
tttaattgcaatgagaatgggattawaattagaaaaaaatatcgctgatt

SEQ ID NO: 104698 - DNA, 50 bp, homo sapien
taagggtaggaagaagagtgggaagscttgattataggcagagtagaaaa

SEQ ID NO: 104699 - DNA, 50 bp, homo sapien
gtggtatataaaatcctgggaatgaycagggataagatgaacagcatagt

SEQ ID NO: 104700 - DNA, 50 bp, homo sapien
tccttctgaaaccataatgaaatgayaaagtaacacaaaaggaaataaat

SEQ ID NO: 104701 - DNA, 50 bp, homo sapien
aaatagtctaagctgctgccttatgracaagtaagaggaaatgggaagtg

SEQ ID NO: 104702 - DNA, 50 bp, homo sapien
ctgctggtcaactacaagcactgcaygtcgtgttctgagggtggctccat

SEQ ID NO: 104703 - DNA, 50 bp, homo sapien
agaattttgtacagaatataggaaaktgtatagctctgcacataatagta

SEQ ID NO: 104704 - DNA, 50 bp, homo sapien
cacctttccacccacctacaaataaytgtgtgtccaatccaatctatata

SEQ ID NO: 104705 - DNA, 50 bp, homo sapien
cctttattagtcagctaggcataaaragagagtggtaatagggtcaggca

SEQ ID NO: 104706 - DNA, 50 bp, homo sapien
taaaccctttacttctttagcggagraaccatgtcttattcaatttgttc

SEQ ID NO: 104707 - DNA, 50 bp, homo sapien
gagaaactgccacagcctaaagacartccagggaaacgtgatgactcagt

SEQ ID NO: 104708 - DNA, 50 bp, homo sapien
tggtatataggcaaatgcatgtgaarcactactgaatgaaaaatatgaaa

SEQ ID NO: 104709 - DNA, 50 bp, homo sapien
tcttcaaacattaaagctcctaggamgttaaacaatctgtcaacctcctt

SEQ ID NO: 104710 - DNA, 50 bp, homo sapien
taaacaaatatatataagaagccaaygaaaaacctgtcttaatacttcaa

SEQ ID NO: 104711 - DNA, 50 bp, homo sapien
gtgaagggacttagtgaaaacacaaytgaagatgtaaataatccaaactt

SEQ ID NO: 104712 - DNA, 50 bp, homo sapien
ccattcacaagtctgtttcacctcarctgcaaagtacagtacagtagtcc

SEQ ID NO: 104713 - DNA, 50 bp, homo sapien
cgggaaaaaaagaaaaagaagtctayagtacgctaagagatatgatatag

SEQ ID NO: 104714 - DNA, 50 bp, homo sapien
tgtcagtatcatgctggcttgactaytgtaactttgtagtaagttctgaa

SEQ ID NO: 104715 - DNA, 50 bp, homo sapien
cttcttggagtttctgagacatataragaaaggtaggtgggagagaaagt

SEQ ID NO: 104716 - DNA, 50 bp, homo sapien
aatggattttcatattacaccataarcgaaactaactctaggttaaaaat

SEQ ID NO: 104717 - DNA, 50 bp, homo sapien
caaatgcctatcaacaggtgaattcrtaaacaaactgtggtagataccta

SEQ ID NO: 104718 - DNA, 50 bp, homo sapien
ggacttcaaaaaaaggacctattaaygattaagcaattgtatcacaacaa

SEQ ID NO: 104719 - DNA, 50 bp, homo sapien
tgctgcttttatttcccttatcttcrctggtgccacagtattttattttt

SEQ ID NO: 104720 - DNA, 50 bp, homo sapien
ggcccagagttaccaaggttatagargtagtctgaaggttatactagtgt

SEQ ID NO: 104721 - DNA, 50 bp, homo sapien
atgagctttccttagcagttctgaargagttcaacctcaaacaagagagg

SEQ ID NO: 104722 - DNA, 50 bp, homo sapien
gtacgattccacaaatgggtcccctsagagtgatattaaatgcaggcaac

SEQ ID NO: 104723 - DNA, 50 bp, homo sapien
aagatttggcggatgaaggctcactstactttcaagatggtaccttgatg

SEQ ID NO: 104724 - DNA, 50 bp, homo sapien
aaagactcggagctttggcagactgyattaaagtgaagggagacatgaga

SEQ ID NO: 104725 - DNA, 50 bp, homo sapien
ttgtattgctgaacttgattctctcyaacaggactcaacatactaattaa

SEQ ID NO: 104726 - DNA, 50 bp, homo sapien
gggtaattttagataaggataaacaygtgttgaaccaaagaaataataaa

SEQ ID NO: 104727 - DNA, 50 bp, homo sapien
cattaactgtgacttaactctgagtktgaacgaaaagtacaagtatttga

SEQ ID NO: 104728 - DNA, 50 bp, homo sapien
ttaatcacctcttgattgactaaagkaaaatcctgatttaaggatctaaa

SEQ ID NO: 104729 - DNA, 50 bp, homo sapien
aacccaacatggtaacttccacgcartaagggctcaagggttccactgat

SEQ ID NO: 104730 - DNA, 32 bp, homo sapien
tacaaaatccacttgcracaaaaactgtattt

SEQ ID NO: 104731 - DNA, 50 bp, homo sapien
ctgaaatacatttataggcacttagygaatggagagaaaatctgttgata

SEQ ID NO: 104732 - DNA, 50 bp, homo sapien
tcatctgtgcctttccctcaagtacragggtctcttgaccacagaatact

SEQ ID NO: 104733 - DNA, 50 bp, homo sapien
aaatagactcccccaaatcaaacaartacctatgtccttaacaggcttag

SEQ ID NO: 104734 - DNA, 50 bp, homo sapien
ttcaggtttgagctttgtctttcaaycatttcagagcccaaggaggaagc

SEQ ID NO: 104735 - DNA, 50 bp, homo sapien
agaaattctcattcgagatgataagsctcatgtactagaatgttttgggc

SEQ ID NO: 104736 - DNA, 50 bp, homo sapien
gtgaaaactggtatgaaatgtagacygagtgaggagtatgtaggagacat

SEQ ID NO: 104737 - DNA, 50 bp, homo sapien
agggtaaataaatggtcaacaaagcractttcagacacaatgctaagtct

SEQ ID NO: 104738 - DNA, 50 bp, homo sapien
tactcttcttaggttctttgagagayatgctaaatactggaaatttgcca

SEQ ID NO: 104739 - DNA, 50 bp, homo sapien
agacaagaaattcaagtggaaagtartaagaggctgtctatgtggctcat

SEQ ID NO: 104740 - DNA, 50 bp, homo sapien
catcagagagcattagactaatctayatggttgagaaggctttagtgtta

SEQ ID NO: 104741 - DNA, 50 bp, homo sapien
catttcaggtggtgttaaatgaggakaaaaggcttgtagttaagatagag

SEQ ID NO: 104742 - DNA, 50 bp, homo sapien
cacactaactgagccagtaaatttawctaaacccatctctcctgtccatg

SEQ ID NO: 104743 - DNA, 50 bp, homo sapien
taaaacccaccttgatggctaagacsctatttcatgcttgccagcttccc

SEQ ID NO: 104744 - DNA, 50 bp, homo sapien
gtgtctaggtaatagcaggaaacccraggaagtattttctggggtcccta

SEQ ID NO: 104745 - DNA, 50 bp, homo sapien
tatgtttttttgttcagtctattgcycgctgttctatttttgtgaaggag

SEQ ID NO: 104746 - DNA, 50 bp, homo sapien
ttcctggactctctaaagacccagtmaataagtcatgttagagattatag

SEQ ID NO: 104747 - DNA, 50 bp, homo sapien
aaaattgttattcagggaccttctcraacaaatgaggaaatctttaaaaa

SEQ ID NO: 104748 - DNA, 50 bp, homo sapien
acatggtcagattgccttaaccacamagcctcatatgtagcttattcgat

SEQ ID NO: 104749 - DNA, 50 bp, homo sapien
aaaacattttaaaaccgtggactaayatcaagaaagcagctgtagcatct

SEQ ID NO: 104750 - DNA, 50 bp, homo sapien
aatagcagtataataaatggtagtaraacaaatgaaatatgatgctgatc

SEQ ID NO: 104751 - DNA, 50 bp, homo sapien
tgtgagagaatcaatggtcaatatcracactttggtagacgcattggaac

SEQ ID NO: 104752 - DNA, 50 bp, homo sapien
ataaacattttatttatatttaaatsagtaatacactttcatttgacaga

SEQ ID NO: 104753 - DNA, 50 bp, homo sapien
aagggctgctaggtggggagaaatcrgatagaatcaggtggggcagagga

SEQ ID NO: 104754 - DNA, 50 bp, homo sapien
taaagtgtttcaatttttccagtcaytaatatctatatgagttaataagt

SEQ ID NO: 104755 - DNA, 50 bp, homo sapien
tagggtgggcaaagggatattaaaarctcactgctggcaagtagttgaaa

SEQ ID NO: 104756 - DNA, 50 bp, homo sapien
tttttagaacaagggaggaagtagcragagtgaaagactttgaatatttt

SEQ ID NO: 104757 - DNA, 50 bp, homo sapien
ataaatacgttacttctgtaatggasaaaaaggtcgcttttaaagaacaa

SEQ ID NO: 104758 - DNA, 50 bp, homo sapien
cattttttgaggggagctaatttaaytgatagatagtcaaatgtctacct

SEQ ID NO: 104759 - DNA, 50 bp, homo sapien
aaaaagtaacctaacagctttcagakaacaaaatcatttgtgcttggttc

SEQ ID NO: 104760 - DNA, 50 bp, homo sapien
atccaaagtgtgaaatggctaaccakgatttgggatcgttttagaagctg

SEQ ID NO: 104761 - DNA, 50 bp, homo sapien
cttcatctccaaaatcaacccttgargtaggcaggctagggcagttaaat

SEQ ID NO: 104762 - DNA, 50 bp, homo sapien
caactatcaagtcaaaggaatccaartacatatatatattgaacctttat

SEQ ID NO: 104763 - DNA, 50 bp, homo sapien
tgcatagtggtagattttagctcaasataagaaagaacttttaaaaaatt

SEQ ID NO: 104764 - DNA, 50 bp, homo sapien
ccacatggggcaaagaagaaccaacraggactttcatgcaaaggagcatg

SEQ ID NO: 104765 - DNA, 50 bp, homo sapien
tattattatctttgcagctaattcarattaacctggaaaatatgatgata

SEQ ID NO: 104766 - DNA, 50 bp, homo sapien
tctaaacataaacatgatgcattgaraaaaatactgttggcaaagcaatt

SEQ ID NO: 104767 - DNA, 50 bp, homo sapien
tgactactttttgaacaaaagggttraacacatttgaagaaaatcaatat

SEQ ID NO: 104768 - DNA, 50 bp, homo sapien
ttatcggaagttatatttgatgataygttcactgaatctgggaaaccttc

SEQ ID NO: 104769 - DNA, 50 bp, homo sapien
caaagccgaaatcctttaggcaaacrgtcctagaaaaaaaatttattatt

SEQ ID NO: 104770 - DNA, 50 bp, homo sapien
atgttttttcagatgatcaaacaccracctagatgcagcaaaccaaatca

SEQ ID NO: 104771 - DNA, 50 bp, homo sapien
tatggtggtgggtcaaacacagttamccttggcataaggtatttctacac

SEQ ID NO: 104772 - DNA, 50 bp, homo sapien
tgtcttccgattattataaaactaamcctagcactgatccctggggctct

SEQ ID NO: 104773 - DNA, 50 bp, homo sapien
gccagactttttctatcgcctaagamaacagttactatatctgatgttct

SEQ ID NO: 104774 - DNA, 50 bp, homo sapien
attatattatccagaagctgtgaagkaccagaatgcctccacaaagccta

SEQ ID NO: 104775 - DNA, 50 bp, homo sapien
agatgacttcctttagcttctccagsaatttgttttcttatcctatctct

SEQ ID NO: 104776 - DNA, 50 bp, homo sapien
ttagggcaccaagtatccactgctasagagaacccagagctccagaccag

SEQ ID NO: 104777 - DNA, 50 bp, homo sapien
attggcatagaatctcatctaagtayataataaacccaaaattaattagt

SEQ ID NO: 104778 - DNA, 50 bp, homo sapien
atcagtatttttcctgcctttcttaygtcatggagaagtgttggactccc

SEQ ID NO: 104779 - DNA, 50 bp, homo sapien
aggaaattctgaggacgcacacaaarttggattcctgtgttgtattagtc

SEQ ID NO: 104780 - DNA, 50 bp, homo sapien
agaacctaaggtactgtctaacacayggcagctgcttacaaattctttaa

SEQ ID NO: 104781 - DNA, 50 bp, homo sapien
tctaagggaaaatttccagacactawgaagttgctaagcatgaaatcttg

SEQ ID NO: 104782 - DNA, 50 bp, homo sapien
tgccctaggccaagaatgggatccayatactgagaccaagtagcacttaa

SEQ ID NO: 104783 - DNA, 50 bp, homo sapien
tgaactcacatgcagtcttttaaaartaaatatcgatgaatatttcctgg

SEQ ID NO: 104784 - DNA, 50 bp, homo sapien
gtttgggttgttgattgtcacaagaytagatcttcatacattgcatgtca

SEQ ID NO: 104785 - DNA, 50 bp, homo sapien
ttgtaaaattgtataagggtcttaartaaacctagcattttattaccagg

SEQ ID NO: 104786 - DNA, 50 bp, homo sapien
ttattgctccctgcgagctccctacraactccccggtgcttgtccagttt

SEQ ID NO: 104787 - DNA, 50 bp, homo sapien
aacaagttttcctatgaagttaataygtttccttgattaaacccttttct

SEQ ID NO: 104788 - DNA, 50 bp, homo sapien
ctagaatataagcttaagagggagayggtgctacaatttagtgtgatttg

SEQ ID NO: 104789 - DNA, 50 bp, homo sapien
taaaatatcctctacattctcagagsctctctttttctaagtcattaaac

SEQ ID NO: 104790 - DNA, 50 bp, homo sapien
tagatgcaaatccttgagttgacccrgaaacattctgctgttttattatg

SEQ ID NO: 104791 - DNA, 50 bp, homo sapien
cctcctgtaggttccataatgaactractactcaatggaatctgagagtt

SEQ ID NO: 104792 - DNA, 50 bp, homo sapien
gtcaggggtcaggaagtgccttacaygttcacgcagtccacagtacatga

SEQ ID NO: 104793 - DNA, 50 bp, homo sapien
caaaaacatcattattaatatgcacwgtaattataacttctgaaaatgag

SEQ ID NO: 104794 - DNA, 50 bp, homo sapien
cccgtcttttgtgtatgttcatcaayttctggccttaattcatcttctga

SEQ ID NO: 104795 - DNA, 50 bp, homo sapien
tactttgtgccatatgaaaattataygaaactcaattttcagtgtccata

SEQ ID NO: 104796 - DNA, 50 bp, homo sapien
ggaagaaaaagcacgacaattaaaartaatcaaactggcccaggcgtggt

SEQ ID NO: 104797 - DNA, 50 bp, homo sapien
tagatgaacattagaacaaatttgtmaagttctcccaataccacttaatt

SEQ ID NO: 104798 - DNA, 50 bp, homo sapien
tactgagttcatgaggacaagttcamaagcagagttacgttcataatcat

SEQ ID NO: 104799 - DNA, 50 bp, homo sapien
agttgaatggacatttcagatgagaktatgtgacacgctgggatccacat

SEQ ID NO: 104800 - DNA, 50 bp, homo sapien
gacaattctttgttcttccgtatatrataagattttttccccctctggct

SEQ ID NO: 104801 - DNA, 50 bp, homo sapien
aaggaagtgaaatacattgagaaatragaacatgttatacatggtaaatc

SEQ ID NO: 104802 - DNA, 50 bp, homo sapien
gacatgtgtactgcagggcttccaayttaatattcaggtttctcagcagt

SEQ ID NO: 104803 - DNA, 50 bp, homo sapien
ctatcattcagtcatttgcttagaasaggattatttattgcacatatttg

SEQ ID NO: 104804 - DNA, 50 bp, homo sapien
ttgtttcatacctaatgtttttttcyatccttaaagagagttccacaaaa

SEQ ID NO: 104805 - DNA, 50 bp, homo sapien
aggtagttcccaaatgttggaccacragatgatgatctccacacagaaca

SEQ ID NO: 104806 - DNA, 50 bp, homo sapien
gctagatgcttcacaggattgctaaraatatacattatgtgaaagcattc

SEQ ID NO: 104807 - DNA, 50 bp, homo sapien
gctgtcattctgtggttacgaaaaasaggcaagtgagtgagtagaaagcc

SEQ ID NO: 104808 - DNA, 50 bp, homo sapien
aattaggaaaacacaaatgtaaataktgaaacaccattatctgacaggtt

SEQ ID NO: 104809 - DNA, 50 bp, homo sapien
aaaaaagctttctttcagataacaaractgacaattcacaaaatagggaa

SEQ ID NO: 104810 - DNA, 50 bp, homo sapien
ttaattaatagaaattaacccaaackcagcctttaagaaaacttcaagga

SEQ ID NO: 104811 - DNA, 50 bp, homo sapien
aaggagtcttccctcaactggtcaaraggtcagcataaagccaaagctaa

SEQ ID NO: 104812 - DNA, 50 bp, homo sapien
tcctggaagagaaaaatcctgattcrcttagctttggctttatgctgacc

SEQ ID NO: 104813 - DNA, 50 bp, homo sapien
gatagcccaccagaaagtaattctamagtttgaaagtagcatgaaaacat

SEQ ID NO: 104814 - DNA, 50 bp, homo sapien
ttatcattttagactaggaaagatayaacacagaagactctaatactcag

SEQ ID NO: 104815 - DNA, 50 bp, homo sapien
tcaaagtgactgttttcttgtcctgygacagtgttcagggtgagaaccac

SEQ ID NO: 104816 - DNA, 50 bp, homo sapien
tgcagcttagtggaatcatcacacasaattgtcgggaagtgagagaaaag

SEQ ID NO: 104817 - DNA, 50 bp, homo sapien
aggtgtcaaggcagataaagtagaawgttaaaaggcttggagacaaccaa

SEQ ID NO: 104818 - DNA, 50 bp, homo sapien
tcacgttataaaagatgctttgtaawgtttaaacaattacattactttct

SEQ ID NO: 104819 - DNA, 50 bp, homo sapien
agccactcatattagaaagatatgayagtctctaaattcaaggaaaaccc

SEQ ID NO: 104820 - DNA, 50 bp, homo sapien
atacagatagaaaaattgatattgcrgaaaatcactcaaatgattgtatg

SEQ ID NO: 104821 - DNA, 50 bp, homo sapien
gaaacaggaattgctgtattgcctcrcaggtagaagagtctttccttctg

SEQ ID NO: 104822 - DNA, 50 bp, homo sapien
aatacaagcagttattttaatgtcaygatccactgattctcttttattag

SEQ ID NO: 104823 - DNA, 50 bp, homo sapien
cccactgtgttgattccaagacacaytcatttaaacctgtggctaaaaat

SEQ ID NO: 104824 - DNA, 50 bp, homo sapien
agagcgaaggtgtacacctcctccartatggaaacactgctaagatgaca

SEQ ID NO: 104825 - DNA, 50 bp, homo sapien
ataatctcactcagaagggccactcyaaactcttgaaactgtacacactt

SEQ ID NO: 104826 - DNA, 50 bp, homo sapien
agctataaataagtaattttatatcmctgcagaaaccattccataactcc

SEQ ID NO: 104827 - DNA, 50 bp, homo sapien
aacaaagttctctctaatataaaaasatagtggcaaatgtatttctgaag

SEQ ID NO: 104828 - DNA, 50 bp, homo sapien
gtacttatttgctactctggtttaakaatgtttttcaacaagtaaacctt

SEQ ID NO: 104829 - DNA, 50 bp, homo sapien
aataaaaaaaatacaaagcatacagraaaatgacctatcttgaaaaggaa

SEQ ID NO: 104830 - DNA, 50 bp, homo sapien
aatatacatccaaaataattgcagakaacaagaagagaattagtgtagat

SEQ ID NO: 104831 - DNA, 50 bp, homo sapien
aaaccactgaagctagggtccatcaragagtccatttcatcaccctgcca

SEQ ID NO: 104832 - DNA, 50 bp, homo sapien
gcagggtataagtaaacaagtagaartgaactggcctgttgaatagagtt

SEQ ID NO: 104833 - DNA, 50 bp, homo sapien
atccccttgaagttgacattctagcrgaagaagaaaaactatacatatat

SEQ ID NO: 104834 - DNA, 50 bp, homo sapien
ctatcaaagttcaaggcacattgaaytgactacttttattaaaaccatat

SEQ ID NO: 104835 - DNA, 50 bp, homo sapien
caagtgtatacattatggtgcctaawctaagagaggttcatttccaacag

SEQ ID NO: 104836 - DNA, 50 bp, homo sapien
gctgggatacaagcatcacaaacatytaagtttctaagcaaccctctgtt

SEQ ID NO: 104837 - DNA, 50 bp, homo sapien
accttgcaaaaaatatttctagatcragtcaataggttattctgagaata

SEQ ID NO: 104838 - DNA, 50 bp, homo sapien
tcaagtaattactaccatatttggamgctaagtaagtaggtctcagtcat

SEQ ID NO: 104839 - DNA, 50 bp, homo sapien
tcagatgaataaattatcataagaaktcctgtgctttttattaaaactca

SEQ ID NO: 104840 - DNA, 50 bp, homo sapien
cctctagagaactgctagtgaataartgctccagaagataggaatattca

SEQ ID NO: 104841 - DNA, 50 bp, homo sapien
tgattcctgcaatccaagttggctasaaaaaagggccttcacattacaat

SEQ ID NO: 104842 - DNA, 50 bp, homo sapien
attgaaaaacaaggctcagaagaaaygatatacctctcataacctttgtg

SEQ ID NO: 104843 - DNA, 50 bp, homo sapien
taattagcattgcttactgtgcattraaaaacaaggctcagaagaaatga

SEQ ID NO: 104844 - DNA, 50 bp, homo sapien
ttgaaaaatattaaatgtctgtctawatatacaaaggagaaaaaatatat

SEQ ID NO: 104845 - DNA, 50 bp, homo sapien
aaggctgtatctggggacattgaacyatagcttgttaattttcttttatt

SEQ ID NO: 104846 - DNA, 50 bp, homo sapien
aaacatgaagtttagtctagtagtaktaatgggcaattgatgcaagctgt

SEQ ID NO: 104847 - DNA, 50 bp, homo sapien
gaaaacacttggttaaatatggatckttaatacctcaatagtatacaaat

SEQ ID NO: 104848 - DNA, 50 bp, homo sapien
tacttcttttatggataatataatartagccaaagagaagtcaagttttc

SEQ ID NO: 104849 - DNA, 50 bp, homo sapien
tcttcctcattcccaactgcaccctsaggacttaacacagtgcccagagc

SEQ ID NO: 104850 - DNA, 50 bp, homo sapien
agagggactaagggatcagcctaagmaggaaagtgcactgatctggcggc

SEQ ID NO: 104851 - DNA, 50 bp, homo sapien
ctgacactggacacaaattgtcttayggtggttcttggttataggtcttc

SEQ ID NO: 104852 - DNA, 50 bp, homo sapien
agacgattttgctgtaagatcagaayggaaaaagacgagcccacaaagaa

SEQ ID NO: 104853 - DNA, 50 bp, homo sapien
acccatcaccatccatctggtggaarcattacaggagcaagtggataaaa

SEQ ID NO: 104854 - DNA, 50 bp, homo sapien
tcctaatcttacatctgtcactcacratccaagaggcttaaccttgtgat

SEQ ID NO: 104855 - DNA, 50 bp, homo sapien
ttttttccaaaagcaaaatctgaaaytataatgtgtaatcctatatcatt

SEQ ID NO: 104856 - DNA, 50 bp, homo sapien
aagaagtggctcttctcgcattcctmaaagattctaatgttcagatgggg

SEQ ID NO: 104857 - DNA, 50 bp, homo sapien
catgtcttcagacaatcagtcaatayggtcaggccttccaaaggaaaagt

SEQ ID NO: 104858 - DNA, 50 bp, homo sapien
tccgagtttagcacattcaactaccygattttgcaggcgagaaaactgag

SEQ ID NO: 104859 - DNA, 50 bp, homo sapien
tcccctaaaatgaataatatataaarctcctaaaataatacattgcagct

SEQ ID NO: 104860 - DNA, 50 bp, homo sapien
accaattgagacacatatcaacacaragtggaacgttgaccaggtcctta

SEQ ID NO: 104861 - DNA, 50 bp, homo sapien
cttgtagctgtgacttcttttataaygacagcagatatgaaacatgaatt

SEQ ID NO: 104862 - DNA, 50 bp, homo sapien
cacgttctttaactcaaattgactayataaactagaagcttgaaagtaga

SEQ ID NO: 104863 - DNA, 50 bp, homo sapien
actctcaaaaaacatattatgcaaarccacttgagatttaccagaatgtt

SEQ ID NO: 104864 - DNA, 50 bp, homo sapien
attctttgtatcacagccaaactaaytgttcttaaacagtcttttatcat

SEQ ID NO: 104865 - DNA, 50 bp, homo sapien
caagctaaacctctactaattacaaygcctccaaacttatttcatttggc

SEQ ID NO: 104866 - DNA, 50 bp, homo sapien
cataaaggaaagctctacctgtccartaagttaacattcatgtagtctca

SEQ ID NO: 104867 - DNA, 50 bp, homo sapien
tgaaatggttgcatggtagctcttarcgctgatttgcagcatccatcttt

SEQ ID NO: 104868 - DNA, 50 bp, homo sapien
tttgttatcaacacgttattaagaawgggcaagatgtccttatatactag

SEQ ID NO: 104869 - DNA, 50 bp, homo sapien
tccttttttttgagacaaatttatcyaggtatacggcgagcaatgcttta

SEQ ID NO: 104870 - DNA, 50 bp, homo sapien
ataatacagaggtttttgggtatgayaaaatgtacagtctctataaaagg

SEQ ID NO: 104871 - DNA, 50 bp, homo sapien
agtgtgtggccagtatacgaagaaaygatgatagaatcagacatctttga

SEQ ID NO: 104872 - DNA, 50 bp, homo sapien
gcgtgaccaactttcctgatgtcaartctaaaaatcccatgaactggtaa

SEQ ID NO: 104873 - DNA, 50 bp, homo sapien
gaaactcttccctgtcatcttatacygaggcataaatgaactccaccaga

SEQ ID NO: 104874 - DNA, 50 bp, homo sapien
gttaggtatgcctgaagacactctcrctgttggagtttttattcaatgaa

SEQ ID NO: 104875 - DNA, 50 bp, homo sapien
agtcacagactactagaaagacagaytctccagtacattttgcttatgct

SEQ ID NO: 104876 - DNA, 50 bp, homo sapien
atgggccattcctataaaaaaagatsactgtataaagcaacttgcaagca

SEQ ID NO: 104877 - DNA, 50 bp, homo sapien
ttggagagaaaaacagctgctggcargtaaacaaatagcagtcctttgag

SEQ ID NO: 104878 - DNA, 50 bp, homo sapien
tgacaaaattccagttagggatctgyacatctaagtgttacatctctact

SEQ ID NO: 104879 - DNA, 50 bp, homo sapien
ttccttagctcagtgattctattatwaccatacatttaactgatactttt

SEQ ID NO: 104880 - DNA, 50 bp, homo sapien
aaggaaagcccctaaaaagcttcatractacaaaattggtcacaaggaag

SEQ ID NO: 104881 - DNA, 50 bp, homo sapien
gggtaattctgtctgtactgacaaarttccagttagggatctgtacatct

SEQ ID NO: 104882 - DNA, 50 bp, homo sapien
tcactgagatgatgcattctagggayggtgcagtttaggaggttgagaat

SEQ ID NO: 104883 - DNA, 50 bp, homo sapien
gtgtttcaacctctcagcatactgcrattattatgaccgtgctcaggaaa

SEQ ID NO: 104884 - DNA, 50 bp, homo sapien
cccaagattttacaactattacaaayttcaattcctttcagttactgaag

SEQ ID NO: 104885 - DNA, 50 bp, homo sapien
gcttcttgtccacaggtgtcttactwacctcattaaccccagcttcctta

SEQ ID NO: 104886 - DNA, 50 bp, homo sapien
ttttagattctaaaggatgtcaccayggaaagaagaatgaatattctaca

SEQ ID NO: 104887 - DNA, 50 bp, homo sapien
gagggagagaatatggtcctttttawgttagttgttgagtctatttcaga

SEQ ID NO: 104888 - DNA, 50 bp, homo sapien
ccttctagaacattcctatctaccaracgtaatgtagccccagtttaatt

SEQ ID NO: 104889 - DNA, 50 bp, homo sapien
attttctttgctctaactaaaggagrcattcaactatacattttccattt

SEQ ID NO: 104890 - DNA, 50 bp, homo sapien
aatttttatttctgaaacaggtatakagcgtaaaatgattccccaagttt

SEQ ID NO: 104891 - DNA, 50 bp, homo sapien
ttgatagaggaagagaggtgactccrattgagctgagtgtagaacatgta

SEQ ID NO: 104892 - DNA, 50 bp, homo sapien
tactttaaggacctatgaaggactamatttggctgagtctcactgagaac

SEQ ID NO: 104893 - DNA, 50 bp, homo sapien
tatcccatatttgttttagttgatamcgctttgatttttagtaagattgg

SEQ ID NO: 104894 - DNA, 50 bp, homo sapien
attaattttcaataagtctttgaackcttgccattcagggaagaatacat

SEQ ID NO: 104895 - DNA, 50 bp, homo sapien
ctgagatctggccaccatattcctcraaagaattcatttggactctgact

SEQ ID NO: 104896 - DNA, 50 bp, homo sapien
ctgcagtgcagatgttaattcttcayagaaccctaaatacaatgtacaat

SEQ ID NO: 104897 - DNA, 50 bp, homo sapien
attctttgataatatagcattatgasagatgttcagttatgtggcaatat

SEQ ID NO: 104898 - DNA, 50 bp, homo sapien
caataaaccatccatccagtagataygtattttgaaggaaaagctgctaa

SEQ ID NO: 104899 - DNA, 50 bp, homo sapien
ttaaaactcagtattgtctagtaaarttggatagaggtataccctacatg

SEQ ID NO: 104900 - DNA, 50 bp, homo sapien
tctgaaaatgaagaccttaaaatagyattctgagccgggtgtgttggctc

SEQ ID NO: 104901 - DNA, 50 bp, homo sapien
aattgtatcctttttataattaaaakgtcaagatcaggaatatatgtcaa

SEQ ID NO: 104902 - DNA, 50 bp, homo sapien
cacttaagacagactttaagaaggarctctcttactcacaggaaatccga

SEQ ID NO: 104903 - DNA, 50 bp, homo sapien
cctgactagggaatggtcaaacaaaygatcctcatcacctcctgatggga

SEQ ID NO: 104904 - DNA, 50 bp, homo sapien
ggtctatactatggctggggaatgasactagcagggctgggctaggagca

SEQ ID NO: 104905 - DNA, 50 bp, homo sapien
gttgagtaatagaaagagaactgaaytgggtgttaagatttagatattaa

SEQ ID NO: 104906 - DNA, 50 bp, homo sapien
ttaaaagagacttacataacatatcraccaaatttcttatttggaccaga

SEQ ID NO: 104907 - DNA, 50 bp, homo sapien
tacccttttttcccagatataggtamcacaaaatgtcactgaatatggtt

SEQ ID NO: 104908 - DNA, 50 bp, homo sapien
cacaatttaaaatgtaattttaaacratcaaacatggacttaagtaacta

SEQ ID NO: 104909 - DNA, 50 bp, homo sapien
ctctgggacagtctcaggtttagagmatttacctgcaatcacagttgtat

SEQ ID NO: 104910 - DNA, 50 bp, homo sapien
gtcttatgagaatcaatgagccagayggtttccaataatcctttctgccc

SEQ ID NO: 104911 - DNA, 50 bp, homo sapien
atttatcgctgtgcggcagaacacartaaggttcatatccatgtgaatac

SEQ ID NO: 104912 - DNA, 50 bp, homo sapien
gagagcaggcactttattagaatatrgccaaacatgacaagtgtagaaca

SEQ ID NO: 104913 - DNA, 50 bp, homo sapien
ttttaattgtctgttcactgtcttcrgaaatagttttagataattaatct

SEQ ID NO: 104914 - DNA, 50 bp, homo sapien
cttctacgtttgtccttctcttaaaytcctgggttggtattcacatggat

SEQ ID NO: 104915 - DNA, 50 bp, homo sapien
agtacaccttaggccagacccacaayatcttgaggtataaaagaaagttc

SEQ ID NO: 104916 - DNA, 50 bp, homo sapien
ttgatctgaattcttcctcattacarcattgatatagagctagggttttg

SEQ ID NO: 104917 - DNA, 50 bp, homo sapien
tacatttccctctaaggactgctttmgctacttctcataagttataatat

SEQ ID NO: 104918 - DNA, 50 bp, homo sapien
cccaagatgggagcagggctccagasgtaacgtacgaaaacgaacataag

SEQ ID NO: 104919 - DNA, 50 bp, homo sapien
gaataacttttaaaatgtaaaaaccmgggcatgttctttgtaaagtgttc

SEQ ID NO: 104920 - DNA, 50 bp, homo sapien
agaaagcacaaagatattttaacatsatcttttatcagtgattgaagcct

SEQ ID NO: 104921 - DNA, 50 bp, homo sapien
ttcacagattttgctttactaatccyaggttattaacactctttgcaaag

SEQ ID NO: 104922 - DNA, 50 bp, homo sapien
tttccagagtaaactgcatataataraaagcatgaaaggaaatacataat

SEQ ID NO: 104923 - DNA, 50 bp, homo sapien
ccttggtatgagatggattgtgaaaragaaggacaagatttgctgattta

SEQ ID NO: 104924 - DNA, 50 bp, homo sapien
catataaaagaccctaagtgaaacascaaagttgacctcttcccaaattc

SEQ ID NO: 104925 - DNA, 50 bp, homo sapien
gatgtaaacttaatgcttctcactawaaactcaattactaggtctccatt

SEQ ID NO: 104926 - DNA, 50 bp, homo sapien
gcaatttgaagtagggattgaggtamaagttctactttagtcattttttg

SEQ ID NO: 104927 - DNA, 50 bp, homo sapien
atcgcagtgaggattcaatatccaastccttccttaaaataactgcattc

SEQ ID NO: 104928 - DNA, 50 bp, homo sapien
gactctcactctgtttgagagacaayggtttggagactagaaaaatatat

SEQ ID NO: 104929 - DNA, 50 bp, homo sapien
ctaacactgcagtgacatccgtagckccaaaactcttgatcttcttcatc

SEQ ID NO: 104930 - DNA, 50 bp, homo sapien
ttcctcttactgaccttgtgagatargagatttttacagacaaggcatct

SEQ ID NO: 104931 - DNA, 50 bp, homo sapien
tctgcagtcattgttatttgtgtcayagttttataagggaaaaagtacct

SEQ ID NO: 104932 - DNA, 50 bp, homo sapien
ctctaaacacatacacaccatgtacragggtatcattcatttcttgggca

SEQ ID NO: 104933 - DNA, 50 bp, homo sapien
ggttacagaaaggcctttgcttatawatccatggagctgaaggtcacatg

SEQ ID NO: 104934 - DNA, 50 bp, homo sapien
gaactacttgcttactgtttccatasgaagataaaaacagagctatttca

SEQ ID NO: 104935 - DNA, 50 bp, homo sapien
ctaaagcttcttgtaatatgcaaaartgatcaggttatagcagattattc

SEQ ID NO: 104936 - DNA, 50 bp, homo sapien
tgagcaaaagctccttggcactccartgaaagatgagccaaaactagttg

SEQ ID NO: 104937 - DNA, 50 bp, homo sapien
aataaatgggctggagtagcacactyaaatgaggaaggtgttgcctccaa

SEQ ID NO: 104938 - DNA, 50 bp, homo sapien
catctatatatacctccatgctcagmaaaattattgtatagggcactgaa

SEQ ID NO: 104939 - DNA, 50 bp, homo sapien
agtcattgatgtttctgtatctgaaytaattggtgatattcctttatcat

SEQ ID NO: 104940 - DNA, 50 bp, homo sapien
tatggcagaattctgcacgttatgcygcaaagagttagaattattgagga

SEQ ID NO: 104941 - DNA, 50 bp, homo sapien
tatatattgtgctaaactccatgaargaaaacaaagattgctccgataga

SEQ ID NO: 104942 - DNA, 50 bp, homo sapien
attccctcctgccctaaaccaagtgmatctcagtttagctattaattcct

SEQ ID NO: 104943 - DNA, 50 bp, homo sapien
ctctcccagaaatgtgaatcttgaawgaagtgaacaaagaaggaaatgga

SEQ ID NO: 104944 - DNA, 50 bp, homo sapien
ttaaactgttgcacatgtcttttctractaaatgctacaagtattaagtc

SEQ ID NO: 104945 - DNA, 50 bp, homo sapien
aaacacatcttaagacatatagcacragtgatacatatttgagtttattc

SEQ ID NO: 104946 - DNA, 50 bp, homo sapien
tgtatttgaagtagcagagagtggtrtgtgaatcatttttgattactcag

SEQ ID NO: 104947 - DNA, 50 bp, homo sapien
aatataaagatggatatattttggawcaagagaaaacgtcaattaggcct

SEQ ID NO: 104948 - DNA, 50 bp, homo sapien
taccctctcagcctcttctcccatcragaacaaccctctacctctgtcca

SEQ ID NO: 104949 - DNA, 50 bp, homo sapien
gagtgtgtgagaagacgagactggamatgtaggttagttgcaagttgcta

SEQ ID NO: 104950 - DNA, 50 bp, homo sapien
cgtcacttctcactacttccagaatkaccaccatatttctagttattatc

SEQ ID NO: 104951 - DNA, 50 bp, homo sapien
cctagagggtgatgaataaaagtgaygctattggagagggatgtatatga

SEQ ID NO: 104952 - DNA, 50 bp, homo sapien
attctcttggctctttcttcagtgaktatccaggattccgtcacttctca

SEQ ID NO: 104953 - DNA, 50 bp, homo sapien
ctggatctcacatactatcccttgaraccaaaggacacactttagagcaa

SEQ ID NO: 104954 - DNA, 50 bp, homo sapien
ccagaactgacctctatcttcttggratttctacagtactatcattttac

SEQ ID NO: 104955 - DNA, 50 bp, homo sapien
cactaaatgggcattttcatgccaamtaaaaatgtaatataatcacacaa

SEQ ID NO: 104956 - DNA, 50 bp, homo sapien
aaaggataatgagacaagcaattaayataatggtcaagataataagatgg

SEQ ID NO: 104957 - DNA, 50 bp, homo sapien
acagcatctcaaatggaataagaaargccctgaattatatctatttaaga

SEQ ID NO: 104958 - DNA, 50 bp, homo sapien
tggctcacaaatttagattgttaatyacaagtttagattgttaaactgca

SEQ ID NO: 104959 - DNA, 50 bp, homo sapien
gggtccagttacattttccagaataygtgtttttataagtgattgaaaag

SEQ ID NO: 104960 - DNA, 50 bp, homo sapien
gttaaaaaatactttccaagttatayacagaacaatcctctgcaattatg

SEQ ID NO: 104961 - DNA, 50 bp, homo sapien
aatgctcctctggatgatatcaaaaygcagataatgaagcagaacatata

SEQ ID NO: 104962 - DNA, 50 bp, homo sapien
cttactcttccacaatatctctaaaytgtaccactcaaaacattgtcttg

SEQ ID NO: 104963 - DNA, 50 bp, homo sapien
agaacttttatcatgcaaaacctcaragaatggaagaccctggtttacat

SEQ ID NO: 104964 - DNA, 50 bp, homo sapien
cacttcaataaagtttttaggcatcmacatgctggaatatgctgagacat

SEQ ID NO: 104965 - DNA, 50 bp, homo sapien
cttaaggagcctgttctcttgggccraatgtccagaaattgaaggtgggg

SEQ ID NO: 104966 - DNA, 50 bp, homo sapien
cttgataaaacctgatatctacatayagtcaaataggaagaagagacaaa

SEQ ID NO: 104967 - DNA, 50 bp, homo sapien
cactgcttaagaagatgcattctgaygtcacattgtgggtgtgactttgg

SEQ ID NO: 104968 - DNA, 50 bp, homo sapien
ttgtgttttatttcagattacattawtacagcttctcacatacaaagaag

SEQ ID NO: 104969 - DNA, 50 bp, homo sapien
ttgggcaggatggaagtactccagaycaactccttccacactcagttctg

SEQ ID NO: 104970 - DNA, 50 bp, homo sapien
gggttcatgagattttaacacagtayggcaaaataaaaacagttgtagaa

SEQ ID NO: 104971 - DNA, 50 bp, homo sapien
atcatctgttaaatgatggataggartaaatgttctcttagctttctgat

SEQ ID NO: 104972 - DNA, 50 bp, homo sapien
tctagatgaccagcctacctctttgmatgttaatttctgactgctttaaa

SEQ ID NO: 104973 - DNA, 50 bp, homo sapien
aaggggcagcagcaaagtgctaaaarccaaaggattatgtaaaagtctaa

SEQ ID NO: 104974 - DNA, 50 bp, homo sapien
aaaacattggagaactcaacaaaacygatagctgagtgttcgaaaagctt

SEQ ID NO: 104975 - DNA, 50 bp, homo sapien
aaggaagttgtcattgtcaatcatcrcgtattcagcaattcttttttttt

SEQ ID NO: 104976 - DNA, 50 bp, homo sapien
agtcatgaaagagatgtacagaagasgcggaaatgtgagatggaggagga

SEQ ID NO: 104977 - DNA, 50 bp, homo sapien
gaaatatactgaccaaaataaaatcratgtagctatattaacatgagatt

SEQ ID NO: 104978 - DNA, 50 bp, homo sapien
agaacccccagaattcagcgacttcratttgtttgcctcccagagactaa

SEQ ID NO: 104979 - DNA, 50 bp, homo sapien
aagatgcctttaaattctaatagtcractcattatctaaaggactatcca

SEQ ID NO: 104980 - DNA, 50 bp, homo sapien
cccttttttctctttacatccttgarattcagatttgtgcaaaaaggcgt

SEQ ID NO: 104981 - DNA, 50 bp, homo sapien
taacttcagggttcctcggtgaacarcatttggactcttggtctgagagt

SEQ ID NO: 104982 - DNA, 50 bp, homo sapien
ttctggagagggagaaatcgtgtaaycttcatgaatgctatagaaaacct

SEQ ID NO: 104983 - DNA, 50 bp, homo sapien
tctacactagaatttccatatttcartaagttatcatccacttcaaataa

SEQ ID NO: 104984 - DNA, 50 bp, homo sapien
aataattgttgaataagtgaatacawcaaaggttacaacaagtctcttgc

SEQ ID NO: 104985 - DNA, 50 bp, homo sapien
taatatttgtgtgtactcaaagacayagttcttactcaacatcccaagta

SEQ ID NO: 104986 - DNA, 50 bp, homo sapien
ctcttttcctctttctatcagatcayaaaatcccaagagatggaaaatat

SEQ ID NO: 104987 - DNA, 50 bp, homo sapien
cactgtgattggtacagatgataagraacatttgagatctctttctgatg

SEQ ID NO: 104988 - DNA, 50 bp, homo sapien
acagcctatgcgactttaggtaaaayggaagcagagccacttctataatc

SEQ ID NO: 104989 - DNA, 50 bp, homo sapien
atttcctaatctgccataccttcaayacctttctgctttgctgggtggga

SEQ ID NO: 104990 - DNA, 50 bp, homo sapien
cctattagtgtgagaaagtcttccaytcaatttaatacaaagtaactggg

SEQ ID NO: 104991 - DNA, 50 bp, homo sapien
ctagaaaagtttgttcaaatgctacycttgatgttcagcccagtgattta

SEQ ID NO: 104992 - DNA, 50 bp, homo sapien
tccctcagaagaaagccgatgattamcaccaggtcaggggacagctttca

SEQ ID NO: 104993 - DNA, 50 bp, homo sapien
tattaaaggcaggaaggagcttaaarttaaatgagcccctctgtgtggta

SEQ ID NO: 104994 - DNA, 50 bp, homo sapien
agctggagagctgacttagctgccargatgtcaatgaagccgaaaactcc

SEQ ID NO: 104995 - DNA, 50 bp, homo sapien
tatctatgttgactcatcatagacgracttataatcaagatcatttcgtc

SEQ ID NO: 104996 - DNA, 50 bp, homo sapien
ataacagttctgagacaagcagataygtaggccctagtttagctttttgt

SEQ ID NO: 104997 - DNA, 50 bp, homo sapien
ttgtaatatcctcatttttgttagasagaaatcagctccactgcaacatg

SEQ ID NO: 104998 - DNA, 50 bp, homo sapien
agtttttagaaaatttcttacgtagrgattagtgctgattattcctcatg

SEQ ID NO: 104999 - DNA, 50 bp, homo sapien
gcttcctacctgtaaagtagaaagartaataccttctgcaagtgttgtga

SEQ ID NO: 105000 - DNA, 50 bp, homo sapien
tacctgatgttatgcccacttacaaytgagaaaacagaagtctagagaag

SEQ ID NO: 105001 - DNA, 50 bp, homo sapien
aaactccaccacttacaacagcatcwaaaaaacattaaatgtctagaaat

SEQ ID NO: 105002 - DNA, 50 bp, homo sapien
ataactatgtctttggcctttataaygtaagaggaggtctgataagtaag

SEQ ID NO: 105003 - DNA, 50 bp, homo sapien
aaatagacacctcatttatattacarcttttattcaataatcttgagtga

SEQ ID NO: 105004 - DNA, 50 bp, homo sapien
agtgtgggcaattgaatgctggctamtactttctccttcacgcaggaggg

SEQ ID NO: 105005 - DNA, 50 bp, homo sapien
atgagctctaatatttgaagtggtgwatagatctagttctctgggtctag

SEQ ID NO: 105006 - DNA, 50 bp, homo sapien
tggtttttaatccatctaaggctgckcaaagtgtagtaaagcacatatta

SEQ ID NO: 105007 - DNA, 50 bp, homo sapien
aaatgctttagctgagaagacagaaktatatggctaatcacctagcgatg

SEQ ID NO: 105008 - DNA, 50 bp, homo sapien
tcaaattcaacatgatcaaaactgcrtgatcttctgctgagcctggttcc

SEQ ID NO: 105009 - DNA, 50 bp, homo sapien
caacttagagacagacattataaaayaggaaatagtatatttcctaaaga

SEQ ID NO: 105010 - DNA, 50 bp, homo sapien
tgtagtatatgtaatgctttgggaaygtctctgcttagacgctagggctt

SEQ ID NO: 105011 - DNA, 50 bp, homo sapien
atcgtggattgtttccatattccacyaggatacttacattggttctcaac

SEQ ID NO: 105012 - DNA, 50 bp, homo sapien
ctgttaggttgtcataaaatgggaartgataggatgtagaaatgtctaca

SEQ ID NO: 105013 - DNA, 50 bp, homo sapien
ctttccactttagttattgtgatgcyccgggacaatgaacacatctgttc

SEQ ID NO: 105014 - DNA, 50 bp, homo sapien
gttatgattcttaatcttatggtgamtatgacaaagtaatcaacttgcta

SEQ ID NO: 105015 - DNA, 50 bp, homo sapien
ctgcaacatggataaaaacagacaastggaatattcttttaaaaaactag

SEQ ID NO: 105016 - DNA, 50 bp, homo sapien
tgtgagaatcaaatgagttagttaayataaagcatttaccaccaaatctg

SEQ ID NO: 105017 - DNA, 50 bp, homo sapien
tgccttttaggattcctactcaaccrctaaggctcaactcaggtgtcact

SEQ ID NO: 105018 - DNA, 50 bp, homo sapien
cgaagtttctttctccagagaatcawcctattttgctgtaatactaagta

SEQ ID NO: 105019 - DNA, 50 bp, homo sapien
ttggagcagaaaaggaaatctccaamggaaggagtaatattccttcaata

SEQ ID NO: 105020 - DNA, 50 bp, homo sapien
gaaggagaaaattaaaccattgcacygggagctgaaaatatacagagaaa

SEQ ID NO: 105021 - DNA, 50 bp, homo sapien
tccactatttaaaaatttaccttgaygattaagataaaacctctctgctg

SEQ ID NO: 105022 - DNA, 50 bp, homo sapien
gcaaagtgaaccctaattaaaactckcagcaaaccaaaagatatttcctt

SEQ ID NO: 105023 - DNA, 50 bp, homo sapien
gttgaaaatgaactatcaaaacataygaaaacctaaataatgtgagaaaa

SEQ ID NO: 105024 - DNA, 50 bp, homo sapien
gcttcctcagaaggtttcactgttcracttacaaaattctttgcactcag

SEQ ID NO: 105025 - DNA, 50 bp, homo sapien
aaaacagcagggtaaccattatagarcttcaatttagaatgtttgaattt

SEQ ID NO: 105026 - DNA, 50 bp, homo sapien
ctttaaaaacaaaatggtaaattagscaaagaggtttgctaatgactgca

SEQ ID NO: 105027 - DNA, 50 bp, homo sapien
tccaaaaaactcaactttatcaaaaytcacattatcaaagtccttgttcc

SEQ ID NO: 105028 - DNA, 50 bp, homo sapien
taagagtagcaggcaccagtgactaygacggaattttagcagtagctgga

SEQ ID NO: 105029 - DNA, 50 bp, homo sapien
gtaggcagtttttatctatacataartcatttgttcaaccatggtgaata

SEQ ID NO: 105030 - DNA, 50 bp, homo sapien
aaatcatgtcaggctcaccagctgayggagagaaaaatcatcctttgtag

SEQ ID NO: 105031 - DNA, 50 bp, homo sapien
cttcatttctgcttcaaatagttacrgaagagactcttagttcagcagta

SEQ ID NO: 105032 - DNA, 50 bp, homo sapien
ttaaaaattttagtctataattccascttgttataatcttttggattcac

SEQ ID NO: 105033 - DNA, 50 bp, homo sapien
taagtcatacaggtaaaaagtggcaracgcagggttcaaacccagtcagt

SEQ ID NO: 105034 - DNA, 50 bp, homo sapien
ttcccatttgcttttgggcacaaatmccacatattacacttcttttctca

SEQ ID NO: 105035 - DNA, 50 bp, homo sapien
ctatgggacacattactaatcatgaratattttgactaattatatttttc

SEQ ID NO: 105036 - DNA, 50 bp, homo sapien
ctgattttttttaagtgtaagccaaygattttatacccagccaagctgtc

SEQ ID NO: 105037 - DNA, 50 bp, homo sapien
attctgctgataacattgactaacaygcgtgaagggggttggggagggga

SEQ ID NO: 105038 - DNA, 50 bp, homo sapien
cttttaaagaaggggctgaaagatarctaacaaaacacctctagacagtt

SEQ ID NO: 105039 - DNA, 50 bp, homo sapien
gttgcataagtattcggtgaatggtkaataaggcttttcttttaatgtga

SEQ ID NO: 105040 - DNA, 50 bp, homo sapien
tacgtgtactatcagtagctccgtarcgccaaggctcatttggccattta

SEQ ID NO: 105041 - DNA, 50 bp, homo sapien
aggtacgcagaggaaaagcgaggagrtaaaatgccctggttcctgtccca

SEQ ID NO: 105042 - DNA, 50 bp, homo sapien
agggccacagtattactgagattccyaattgctgatgacccttgaggttt

SEQ ID NO: 105043 - DNA, 50 bp, homo sapien
ttcacgacatactgatgtagtgaccygaattaattaatctacttacctac

SEQ ID NO: 105044 - DNA, 50 bp, homo sapien
gtgatggctgagctgagacccaaaakaggagtcaggcttagtcaggtgag

SEQ ID NO: 105045 - DNA, 50 bp, homo sapien
gttttgcccacagtacctgtcactckaaatgactcttctcagatgccagg

SEQ ID NO: 105046 - DNA, 50 bp, homo sapien
cagtattgttattgcatcagcaccamtgaaaattagtagtgattagaact

SEQ ID NO: 105047 - DNA, 50 bp, homo sapien
tggaaccagactctgaacccaacgcyattttatcacagccatggtttaat

SEQ ID NO: 105048 - DNA, 50 bp, homo sapien
aaatcctagaatgtagtttcctttamctcacaaaatggaactctcaagac

SEQ ID NO: 105049 - DNA, 50 bp, homo sapien
cacagatagaatagatttcacataaytcttaagggccctaggattttcgg

SEQ ID NO: 105050 - DNA, 50 bp, homo sapien
cagtgtgtcagagccatggacaatakaaggcaactgaacctcttctccag

SEQ ID NO: 105051 - DNA, 50 bp, homo sapien
aattaatagataataactttttgggyatgagaggcaaaacaacagttcta

SEQ ID NO: 105052 - DNA, 50 bp, homo sapien
tgctttccacaacagtataatctcckaatcagagcaagtacttagttctt

SEQ ID NO: 105053 - DNA, 50 bp, homo sapien
tctcccccagatttgtatgttaaaaytcaccacaaagtgatggtattagg

SEQ ID NO: 105054 - DNA, 50 bp, homo sapien
gtattgcagaagaactctccatgtawtctgaaaaatcaaatgtagtagga

SEQ ID NO: 105055 - DNA, 50 bp, homo sapien
atattagctttacatgaaaaacagaratcattacattaatctaatgcaga

SEQ ID NO: 105056 - DNA, 50 bp, homo sapien
cactttgcaaaggtgaaatttaagcraagacttgagttagagagggagtc

SEQ ID NO: 105057 - DNA, 50 bp, homo sapien
ccaacttcaaaatcacggaaatatgwttgcatcagacaatggcttcaatt

SEQ ID NO: 105058 - DNA, 50 bp, homo sapien
caatatttcctttgcatgtcctcaarctataaccaaattcggggagagga

SEQ ID NO: 105059 - DNA, 50 bp, homo sapien
attcctacccaagacacaaaagatcrtctataaaccgtaataaaagaaca

SEQ ID NO: 105060 - DNA, 50 bp, homo sapien
ataaatgactcgcaaccagaacatayatgtggaatcagcacacaaaactg

SEQ ID NO: 105061 - DNA, 50 bp, homo sapien
cagtccagaaaatgttaaagaatcaygaagcagctcccagtggggaaccc

SEQ ID NO: 105062 - DNA, 50 bp, homo sapien
tcctataacaaaacaaactgatatamtagaaaagtgacatgttgcattct

SEQ ID NO: 105063 - DNA, 50 bp, homo sapien
tctagaagagaaagacaaccaataarttaaaaagataatgtcagaaagac

SEQ ID NO: 105064 - DNA, 50 bp, homo sapien
atatgcaacactataattatcactcygagtcataacccactagcttccct

SEQ ID NO: 105065 - DNA, 50 bp, homo sapien
taagtggaccagttgccaaatagatsaaatgttgagtgaactcaggtctc

SEQ ID NO: 105066 - DNA, 50 bp, homo sapien
tttagagaaatctcaaattatcatcygaggccaattgtgtttttaatgtt

SEQ ID NO: 105067 - DNA, 50 bp, homo sapien
aagtggaaaagtctcataaaaatccrgaagtggaatacaaggaacaaggt

SEQ ID NO: 105068 - DNA, 50 bp, homo sapien
aagtgtgtacactaaaaagtggatcrtaactggatgtcgtgagtatgtca

SEQ ID NO: 105069 - DNA, 50 bp, homo sapien
gactaacaggaccccatagttaggaragcgacctctagcgagcaggcctt

SEQ ID NO: 105070 - DNA, 50 bp, homo sapien
cttaaggtttttagactggaagctargatttcctaggatgaaggctctga

SEQ ID NO: 105071 - DNA, 50 bp, homo sapien
taaaaatttgtaagcatattctgcamaatttaaagcatattctgcaaagg

SEQ ID NO: 105072 - DNA, 50 bp, homo sapien
ggggtttcttgttaaagggacatcgraatctcgacatcccgagctgccac

SEQ ID NO: 105073 - DNA, 50 bp, homo sapien
tatggttcctctttggtggtattgawgagaaggaaactctatatactgaa

SEQ ID NO: 105074 - DNA, 50 bp, homo sapien
tactttcaaggagtgaattattctaygctgtacatgttcgtctctgtttg

SEQ ID NO: 105075 - DNA, 50 bp, homo sapien
ctctactggtagttaggctgcaaaawtattaagctttcataattttggtt

SEQ ID NO: 105076 - DNA, 50 bp, homo sapien
atgtgttcctgccaaatccaaatgayggacgttgcagaacactgggcgag

SEQ ID NO: 105077 - DNA, 50 bp, homo sapien
ctaaaatagttctattacacagatgkacccttcctatttatccagtcaaa

SEQ ID NO: 105078 - DNA, 50 bp, homo sapien
tccacctttgtgtcaacactgtactrtgcgtctgcctctttacagcactt

SEQ ID NO: 105079 - DNA, 50 bp, homo sapien
tttccttctaaactggaataatgcargaggtagtatggtaacatggaagt

SEQ ID NO: 105080 - DNA, 50 bp, homo sapien
gatttcatgattttctttattatgargctaaaacctgggtctgactcccc

SEQ ID NO: 105081 - DNA, 50 bp, homo sapien
tgatgatcatgagtattacctaaccrccaacttgatgatcatgagtatga

SEQ ID NO: 105082 - DNA, 50 bp, homo sapien
ataagtgaaagtctggcttaactggmactatatttttgtcaagtttagtg

SEQ ID NO: 105083 - DNA, 50 bp, homo sapien
cagaaaaccgcttaaggcattcttamatcacaaacaatagcatgagggat

SEQ ID NO: 105084 - DNA, 50 bp, homo sapien
tatgtgttatatgtatccgtctcccraagttttaagtggaacaaaactga

SEQ ID NO: 105085 - DNA, 50 bp, homo sapien
ccgactagagcccccttgcaatgctyagagccactagggtcccatgttaa

SEQ ID NO: 105086 - DNA, 50 bp, homo sapien
attcccagagtcacgatggaaggcaygtttgggagtaagagccagagtga

SEQ ID NO: 105087 - DNA, 50 bp, homo sapien
atcttagttattttcattttctacastatttgacttaatgcattatatga

SEQ ID NO: 105088 - DNA, 50 bp, homo sapien
ttgctaaagaccatttagctagctayattcaagcctagaatcttttaaaa

SEQ ID NO: 105089 - DNA, 50 bp, homo sapien
gcctgggcaaaatagcacgatctcaytcctacaaaaataaaaaattagct

SEQ ID NO: 105090 - DNA, 50 bp, homo sapien
ttaatgttattcccattttaccaacratgaaactgaggcttatgtaggat

SEQ ID NO: 105091 - DNA, 50 bp, homo sapien
gcagtgtccctattctctgtattgcrgatttatttttatatgctctgctt

SEQ ID NO: 105092 - DNA, 50 bp, homo sapien
tacaaatgaatcacatggaccaaagractagccattatattgctgaatag

SEQ ID NO: 105093 - DNA, 50 bp, homo sapien
gtcatggctaaactcagggacaaagmaaccactggagaaattaaattata

SEQ ID NO: 105094 - DNA, 50 bp, homo sapien
acaatatttttagaggtaaagaacayaatttaaactatcaacagcttggc

SEQ ID NO: 105095 - DNA, 50 bp, homo sapien
ccatgtacatggatgacttaataaasggaactcctgaatccccaccccca

SEQ ID NO: 105096 - DNA, 50 bp, homo sapien
atgtaacaaaattacttctttctggracattggcataggttggagattat

SEQ ID NO: 105097 - DNA, 50 bp, homo sapien
caaataatttttatatgtggcatgarataaggattgaagtttttgttttt

SEQ ID NO: 105098 - DNA, 50 bp, homo sapien
gctgattgagtcagaaggaaatagayaacatgataagtatgttgagaaac

SEQ ID NO: 105099 - DNA, 50 bp, homo sapien
gaatttaagccatcctaaagtgagaygtcacagaattaaactaagaaagt

SEQ ID NO: 105100 - DNA, 50 bp, homo sapien
ctagacgcctcctctgagaatattaygaatgcactacatgctaggcagaa

SEQ ID NO: 105101 - DNA, 50 bp, homo sapien
acataagataaagcaaactgaagcakatttctgtatactgacttatacaa

SEQ ID NO: 105102 - DNA, 50 bp, homo sapien
gttgagaagttactttatttcgctcrattagtgaaatcttattcttggtg

SEQ ID NO: 105103 - DNA, 50 bp, homo sapien
tcaagtgatttttgtactacttcccrcatggtatgagaaccttaaaacca

SEQ ID NO: 105104 - DNA, 50 bp, homo sapien
ggcatgggaggaaggagcagtaataygcccttggaaaacagcctggtgtc

SEQ ID NO: 105105 - DNA, 50 bp, homo sapien
caaatgctgtgattaatttaaccacsaagttcattttcctctgcagtttt

SEQ ID NO: 105106 - DNA, 50 bp, homo sapien
gccagtttacaactccgattctagcraaagagacagcctctgccattttc

SEQ ID NO: 105107 - DNA, 50 bp, homo sapien
tttctacctaaagcatctgtatttcmagtgtaccacggttgctttaaatt

SEQ ID NO: 105108 - DNA, 50 bp, homo sapien
attagctaattcccatagtcacatakgaaagtaggaacacggggatatac

SEQ ID NO: 105109 - DNA, 50 bp, homo sapien
aactgaaaaatccaaaatcaataaastatctactcataaacaaaatgaga

SEQ ID NO: 105110 - DNA, 50 bp, homo sapien
tagataccgaaatctgagtgaactgsataggatctgggcatcctgtcttg

SEQ ID NO: 105111 - DNA, 50 bp, homo sapien
agtaaagtggtgggaagtgtgactaraaagggtgacttcagggagattat

SEQ ID NO: 105112 - DNA, 50 bp, homo sapien
agtagcattgttctggctcatagaarcgattaatcagattggccagagcc

SEQ ID NO: 105113 - DNA, 50 bp, homo sapien
cttgtataaggcagagataacatcckcacagtaaagtggtgggaagtgtg

SEQ ID NO: 105114 - DNA, 50 bp, homo sapien
catttgatcatcttgcattaaacacygtgaatatctcattacacacacac

SEQ ID NO: 105115 - DNA, 50 bp, homo sapien
agtcaggaggccttctggtacaagaygtattgagttggtagttcttaagg

SEQ ID NO: 105116 - DNA, 50 bp, homo sapien
cagagcccctcaatgtataaaagatraaaggatcctgacgttgttaagaa

SEQ ID NO: 105117 - DNA, 50 bp, homo sapien
tgacttcaaaggtggggtggaagacrctgaaatgaatttttctcctttct

SEQ ID NO: 105118 - DNA, 50 bp, homo sapien
gaatggggagagactgagaacaagamcttggtgagaacgtcctcggttcc

SEQ ID NO: 105119 - DNA, 50 bp, homo sapien
atatttattgactatatttgcaaackgcatcatttctccatctttaaaat

SEQ ID NO: 105120 - DNA, 50 bp, homo sapien
attttattagattaaacaatttttarcagacctcatgcttgttggagata

SEQ ID NO: 105121 - DNA, 50 bp, homo sapien
attgtatatatctgaacacattaagyaatccattaaaaaatccatttcga

SEQ ID NO: 105122 - DNA, 50 bp, homo sapien
acagattctactttttctgttaacawagtgagtttctaaagttgatttct

SEQ ID NO: 105123 - DNA, 50 bp, homo sapien
aatatcttaatgatgactgtatctgkattatgtgatataagattactttt

SEQ ID NO: 105124 - DNA, 50 bp, homo sapien
ttgtggaaaaagatagatcaggtccyacttgaagacaaagttgctctcaa

SEQ ID NO: 105125 - DNA, 50 bp, homo sapien
tgttccaactgagtgaagtcaacacraagaaaagaggaagtataggaaat

SEQ ID NO: 105126 - DNA, 50 bp, homo sapien
tttaagcctcagttatataacccacraaaaacagagcctcctagatgtaa

SEQ ID NO: 105127 - DNA, 50 bp, homo sapien
tctgcaatgttcgacacatctttacrattccaggacaagcttttgtcccc

SEQ ID NO: 105128 - DNA, 50 bp, homo sapien
aaggtgtctgagaggtggtggcagcsaaggacagacaggcagaaggaatc

SEQ ID NO: 105129 - DNA, 50 bp, homo sapien
tctataccaagtgttcgctgctggaraggcaagctcagaattatgatcat

SEQ ID NO: 105130 - DNA, 50 bp, homo sapien
accaatcaattatactggaactctayatattgatacatatctttactagt

SEQ ID NO: 105131 - DNA, 50 bp, homo sapien
tttccatagtctcagcttttatttcktctctacaggctgctcattacctt

SEQ ID NO: 105132 - DNA, 50 bp, homo sapien
accccaatttcaacttctaacaaaasaaacatatcttctacctcatgaat

SEQ ID NO: 105133 - DNA, 50 bp, homo sapien
tgctacttctgttctgcattgataargctccaggctggatggtagtagct

SEQ ID NO: 105134 - DNA, 50 bp, homo sapien
tacgaatgcatttgttttgatttctsaagtttgacgtgttgaagctgttt

SEQ ID NO: 105135 - DNA, 50 bp, homo sapien
atgttaggatggccagatataaccaygtgagaacatagcctggtaagtgg

SEQ ID NO: 105136 - DNA, 50 bp, homo sapien
gagataggattttgggaatcgatgayggtatgggatacaggtgttgaggg

SEQ ID NO: 105137 - DNA, 50 bp, homo sapien
ggtttctagtttatgagttcagcagrtatttgactctggattcctcaatt

SEQ ID NO: 105138 - DNA, 50 bp, homo sapien
atccaattaaaaacccatctgtatgwcaagtttaagttagaaatttggtg

SEQ ID NO: 105139 - DNA, 50 bp, homo sapien
agttcataaatgtttctatcatattkaagacatagagcactttactacat

SEQ ID NO: 105140 - DNA, 50 bp, homo sapien
aaggaaaatgccttggcgttttggayggagaatgctcatcacagctctga

SEQ ID NO: 105141 - DNA, 50 bp, homo sapien
atctggcataaagatactgagatggycacaaagggtggtccccacagctg

SEQ ID NO: 105142 - DNA, 50 bp, homo sapien
aaattctgtaggctttcatggtcaascgcaatctctgtgacttcctgcgt

SEQ ID NO: 105143 - DNA, 50 bp, homo sapien
cacagctatagaaaatcaggatattkgtggaactaggagtttctccacgt

SEQ ID NO: 105144 - DNA, 50 bp, homo sapien
atccccaggacataggtaaagagaasagtcaagctttctaatttttcaaa

SEQ ID NO: 105145 - DNA, 50 bp, homo sapien
cgagacctgccagccatcagggacgratgagttttaaaggcccttactgc

SEQ ID NO: 105146 - DNA, 50 bp, homo sapien
atatcaaggctaaagttgctatattmtttttcttctgatggatgctgagt

SEQ ID NO: 105147 - DNA, 50 bp, homo sapien
atccctttttacagtcaacttcacawgaatagacaaattcaaaagtatga

SEQ ID NO: 105148 - DNA, 50 bp, homo sapien
gaattgaattgaatttgttcttagartaaatgacaataaagaaaatagta

SEQ ID NO: 105149 - DNA, 50 bp, homo sapien
gtctgcatgaagtgttaagctaggayaggaagatataaacaatttatttt

SEQ ID NO: 105150 - DNA, 50 bp, homo sapien
ctggggaaggctaaggagatactaamctagcttcaattatttgaacacct

SEQ ID NO: 105151 - DNA, 50 bp, homo sapien
ggctttacttttggagctagatatasagagacacagagatgtgatgccat

SEQ ID NO: 105152 - DNA, 50 bp, homo sapien
aggtgatttatcttggggagtttctyactatctgcattttgctgatgcac

SEQ ID NO: 105153 - DNA, 50 bp, homo sapien
agaaaacagagaggtaagaacacatwagaagacctgatatactttagcct

SEQ ID NO: 105154 - DNA, 50 bp, homo sapien
aagccgtgtcctcactgtccactccrtagaagaacaaggcataggaattt

SEQ ID NO: 105155 - DNA, 50 bp, homo sapien
taagtaatttaccatacataactgaygagcattttgctgatcacttaaca

SEQ ID NO: 105156 - DNA, 50 bp, homo sapien
cccaatgcctttcaaattaatcttgsaagttactcagaaatgcacacttg

SEQ ID NO: 105157 - DNA, 50 bp, homo sapien
gcacattcaagtctattttctcatgsctaagtgacagtgctagaagtagg

SEQ ID NO: 105158 - DNA, 50 bp, homo sapien
tagagaacattgaattatggacctascagtgatagtgatgtgatagaccc

SEQ ID NO: 105159 - DNA, 50 bp, homo sapien
ggccagcctcagatacagaggttcartcctagggctcatgaccatctctc

SEQ ID NO: 105160 - DNA, 50 bp, homo sapien
gagctgagtttcctgatccacataayggagaaataagaatccatatccaa

SEQ ID NO: 105161 - DNA, 50 bp, homo sapien
aagacccacccccatgattcaattaycaaggagcaaaagtttattttttc

SEQ ID NO: 105162 - DNA, 50 bp, homo sapien
gacaaaaatttgtagggaagcaaatmccttcaaggttgagtctttctggt

SEQ ID NO: 105163 - DNA, 50 bp, homo sapien
tttgcttgctttgttaaatatattayggcgtagaggaaagaagatgagct

SEQ ID NO: 105164 - DNA, 50 bp, homo sapien
ttttgtcctgatctcaagtttaaggrccatctttatgggtgatgcgtcac

SEQ ID NO: 105165 - DNA, 50 bp, homo sapien
aaggttaaggaaggccagtgatatasagtagtagaaaacagcagttaatg

SEQ ID NO: 105166 - DNA, 50 bp, homo sapien
aatattgtagtttccatctgtcccaygcaaattcctttcaaactgatttg

SEQ ID NO: 105167 - DNA, 50 bp, homo sapien
aatcagaagtagtatattataatcaraggagttcttggtgtaataggaac

SEQ ID NO: 105168 - DNA, 50 bp, homo sapien
taagaaatattagagatgagattagsaaacaaaagtgttaaaactgctat

SEQ ID NO: 105169 - DNA, 50 bp, homo sapien
atctttcttctaattcatcatcggamaatatccaggagccaggctagaaa

SEQ ID NO: 105170 - DNA, 50 bp, homo sapien
tgcaccagagaccatagaaagaaaayggcaagctgggaaactttacactt

SEQ ID NO: 105171 - DNA, 50 bp, homo sapien
gcattcagtttataacagagaacaarcaaacgagttggaaattgaggcta

SEQ ID NO: 105172 - DNA, 50 bp, homo sapien
acataaggtatagaattatatttaaygtgttcttaaagaattgctcctaa

SEQ ID NO: 105173 - DNA, 50 bp, homo sapien
ttcatatcatttgacttcatgatcarattagagaggtgactgggagaacg

SEQ ID NO: 105174 - DNA, 50 bp, homo sapien
tttgaactagtccaatctctataacrctttcttcatatcatttgacttca

SEQ ID NO: 105175 - DNA, 50 bp, homo sapien
aggtttctgttgtttaagccctgccrcttgtggtcctttgttaaggtaaa

SEQ ID NO: 105176 - DNA, 50 bp, homo sapien
aagtatatactgtagctacactttawtaaactacactttggcactaggtc

SEQ ID NO: 105177 - DNA, 50 bp, homo sapien
aaattttttaatgtagtgtatttaargattgttagtatggaatctgaact

SEQ ID NO: 105178 - DNA, 50 bp, homo sapien
taagcaatttgcagcacctgggtaaygaaagcatactggagagagcaatt

SEQ ID NO: 105179 - DNA, 50 bp, homo sapien
ctttttcagaattcttgaaggaaaaygatacgcaacataattaaattttg

SEQ ID NO: 105180 - DNA, 50 bp, homo sapien
ctgcattttgtggtttgagtactacytcagccacagtacaatagaatacc

SEQ ID NO: 105181 - DNA, 50 bp, homo sapien
cgaatgaccggacctaacacataaartatcgacttaaagaaaacatatag

SEQ ID NO: 105182 - DNA, 50 bp, homo sapien
tagagaaagcattgctaataacaaaygtaaggtatgtgatgctggtacac

SEQ ID NO: 105183 - DNA, 50 bp, homo sapien
taatagttacagcactttagaatgayatactttgacattgagaaatgaat

SEQ ID NO: 105184 - DNA, 50 bp, homo sapien
agtgtcaccttccctgagttgttacwcctcacattggtacacctgcctgt

SEQ ID NO: 105185 - DNA, 50 bp, homo sapien
gacagcaaacatatggaagtaagacrcaatttgtaaaagttctaattatt

SEQ ID NO: 105186 - DNA, 50 bp, homo sapien
attaaaatgtagcttataataaaatsagacttttttcaggctgtgaaagt

SEQ ID NO: 105187 - DNA, 50 bp, homo sapien
tgtcaacatcaagcattcaaaactcyaaggaaggccaggcgcggtggctc

SEQ ID NO: 105188 - DNA, 50 bp, homo sapien
ataagagtgactttcaacgcaggaarttaaagtataattagcaatgtgca

SEQ ID NO: 105189 - DNA, 50 bp, homo sapien
actgaaccataaaatgccttctctaycttgtctgctgttggagatatagg

SEQ ID NO: 105190 - DNA, 50 bp, homo sapien
aaataaaatgcaaaattttacctggrcatttgaaatttacaatatgtaga

SEQ ID NO: 105191 - DNA, 50 bp, homo sapien
cctcacccacccggattatgctgaaraagaggcagggtagggcactaaaa

SEQ ID NO: 105192 - DNA, 50 bp, homo sapien
agaaaacaaaaatattataaaccaayggagcccttcttggaagctaatac

SEQ ID NO: 105193 - DNA, 50 bp, homo sapien
aggaagtgtgagtgatttccactaamattatcatctggatcccaaaatga

SEQ ID NO: 105194 - DNA, 50 bp, homo sapien
catttgcttcatcaactttttaaggratctggttataatgcaacatggcc

SEQ ID NO: 105195 - DNA, 50 bp, homo sapien
atggaccttccctgtggacttgttayagtggtggattgcccttgtttcaa

SEQ ID NO: 105196 - DNA, 50 bp, homo sapien
aaatgtgcattttgaacagaaaaaartgaatatgaagtattattaaagaa

SEQ ID NO: 105197 - DNA, 50 bp, homo sapien
agggcagcatgcacctggggctttaraacatacatagtgagcccgagagg

SEQ ID NO: 105198 - DNA, 50 bp, homo sapien
tccccaaatattttctcagtagctaygacgtgcagggcattgtgtgaaaa

SEQ ID NO: 105199 - DNA, 50 bp, homo sapien
agagaccacgccctgctcttcacaayggcgatacacttctcaaatgtgga

SEQ ID NO: 105200 - DNA, 50 bp, homo sapien
tgttcttaagattagaaccatggtgraaaaataacataagggatatgtag

SEQ ID NO: 105201 - DNA, 50 bp, homo sapien
aactacctaacccagaaacagaatamctcctgtcacatccacatccccca

SEQ ID NO: 105202 - DNA, 50 bp, homo sapien
tccctcaactctgatgtaatatatargcatactggagttaattttcctgt

SEQ ID NO: 105203 - DNA, 50 bp, homo sapien
ggacacagaaatacccataggaagamaatatgaagaagagataggaagaa

SEQ ID NO: 105204 - DNA, 50 bp, homo sapien
ggaacaaaattaagtgctgaggatamaaaggccaagatcagtcttcaccc

SEQ ID NO: 105205 - DNA, 50 bp, homo sapien
taaactggccttaacaggatggctargtaaaagacagagggtgcgtacca

SEQ ID NO: 105206 - DNA, 50 bp, homo sapien
gtggcattggagataagtggctaaaraaagatggatcgtctcataaatgg

SEQ ID NO: 105207 - DNA, 50 bp, homo sapien
ctacatatttctttctgattccttgyacttctatcccaaaagagtgtgcc

SEQ ID NO: 105208 - DNA, 50 bp, homo sapien
gtagcaaataagcacgttttttgctrgacagaactatctgatatatctgt

SEQ ID NO: 105209 - DNA, 50 bp, homo sapien
gatactgtgaggccttatgaccagargctttagacacgaggaaaccactt

SEQ ID NO: 105210 - DNA, 50 bp, homo sapien
ctaagcatcttccatagtgttccatrataaaccttgcttgggactttaat

SEQ ID NO: 105211 - DNA, 50 bp, homo sapien
aataagtggaaggtttgtttattaastgaaagagttcggagatctgagct

SEQ ID NO: 105212 - DNA, 50 bp, homo sapien
tttttactttagcctgcatgtttctmtaagatggagagtggcatattatt

SEQ ID NO: 105213 - DNA, 50 bp, homo sapien
cctcctggcctgccaggaagtgacaygtaatactacctataaggctgaga

SEQ ID NO: 105214 - DNA, 50 bp, homo sapien
tatcaaagaaaagcaaacaaaccagraaatggtataccaaaaaaacccca

SEQ ID NO: 105215 - DNA, 50 bp, homo sapien
aatcctacatgtatatcctaaagaaytgaaaatggactcaaaaagatact

SEQ ID NO: 105216 - DNA, 50 bp, homo sapien
taaaagcctgaagaatgcagttttargatgcagaattataccggtgttag

SEQ ID NO: 105217 - DNA, 50 bp, homo sapien
ggttgtttctaccctttagctattgygaatatttctgcaaagaacatttg

SEQ ID NO: 105218 - DNA, 50 bp, homo sapien
ttgtttgttggaccctcttcacaaargaaagcacataaatcatgcatcac

SEQ ID NO: 105219 - DNA, 50 bp, homo sapien
aagaggtatgtatcttactgcaatasagaattttactcttctccattctg

SEQ ID NO: 105220 - DNA, 50 bp, homo sapien
tagtttgaacttttgacctgaaagarcatacactaaatatcatgaaacta

SEQ ID NO: 105221 - DNA, 50 bp, homo sapien
ggacaatgctcaccctctttgcaccrctatcacatcacctgttcagggca

SEQ ID NO: 105222 - DNA, 50 bp, homo sapien
cagtttttactgtaactgccaataartaatactcatctttaaaaagacat

SEQ ID NO: 105223 - DNA, 50 bp, homo sapien
caagggacattggtagcctgtgacaygcaagggcaaaatattcactaaat

SEQ ID NO: 105224 - DNA, 50 bp, homo sapien
tctttcttgacacaggattaattaawgttatttattcactgttattttga

SEQ ID NO: 105225 - DNA, 50 bp, homo sapien
accctatatctagaagagaaaatcaygtgtcccattgcttctgagaatag

SEQ ID NO: 105226 - DNA, 50 bp, homo sapien
gcgaccccccagccctcagataacaygcttctctacgagcaagaccctca

SEQ ID NO: 105227 - DNA, 50 bp, homo sapien
agaactcacttgtgaatcttagtaartaaaggtcaatttaagttagagaa

SEQ ID NO: 105228 - DNA, 50 bp, homo sapien
acacccagttaggtggtctttaaagygatttcctgccactggagggacct

SEQ ID NO: 105229 - DNA, 50 bp, homo sapien
ggtggcccaggcctgtgagtcaggarcaactctccacgtgggattcccag

SEQ ID NO: 105230 - DNA, 50 bp, homo sapien
tgattgctgtatttgaatcttagatragtcagatattatgtttccatcca

SEQ ID NO: 105231 - DNA, 50 bp, homo sapien
tctatagatggatgaatgggtaaacraagtctgtgtagtatatacagaca

SEQ ID NO: 105232 - DNA, 50 bp, homo sapien
ggataacaaaataaagatgccctaawctaagaactaatggatgaaagagg

SEQ ID NO: 105233 - DNA, 50 bp, homo sapien
cattagggacaagttcctctttcaarcaaatgtgtaaatttagtaaagtc

SEQ ID NO: 105234 - DNA, 50 bp, homo sapien
ctttttgacctttgagtaaattataracttcttttcagattgtgtccaaa

SEQ ID NO: 105235 - DNA, 50 bp, homo sapien
catttgccagtgctctatttgtcaastactaaaattcattcgtttttttg

SEQ ID NO: 105236 - DNA, 50 bp, homo sapien
gtagtgctcgtttagtgaaggaatgmgggaacaatgaataaatgaatggc

SEQ ID NO: 105237 - DNA, 50 bp, homo sapien
gtagcctttatgtggtatgcgtttayattaagaacaagataataaacatg

SEQ ID NO: 105238 - DNA, 50 bp, homo sapien
gagaaatactaagatttagaggtatyagtacatttgcccaagattgcata

SEQ ID NO: 105239 - DNA, 50 bp, homo sapien
agaagtttggaaattgtaagctaaartccgatcaggtggcacacgttatt

SEQ ID NO: 105240 - DNA, 50 bp, homo sapien
ttacctccttccggtctgttaaaaartgcctccttttctgagagggagga

SEQ ID NO: 105241 - DNA, 50 bp, homo sapien
tacagtagagaagtgctgaacataayatattggaaaaatgaggataaatc

SEQ ID NO: 105242 - DNA, 50 bp, homo sapien
attttttccctagtaaacctccacasagttaaagtcatgcctattttatc

SEQ ID NO: 105243 - DNA, 50 bp, homo sapien
tacaatagcttcttttccaattagarctgattacattttttccctaaaat

SEQ ID NO: 105244 - DNA, 50 bp, homo sapien
gaaactacatgggctatattcactamccataaaggaacttttttagccaa

SEQ ID NO: 105245 - DNA, 50 bp, homo sapien
agcaccttagacctttctggaatcaragttttggatctaagacttcaaag

SEQ ID NO: 105246 - DNA, 50 bp, homo sapien
accaaaaatggtaaataaagtcaccrcttccaggcttagctactgtcctc

SEQ ID NO: 105247 - DNA, 50 bp, homo sapien
aacaaaccttccaacattatagataycttcctccaagtggataatgagct

SEQ ID NO: 105248 - DNA, 50 bp, homo sapien
aactagcgggcaaatgaaaatagaaraaaaaatcattgagaacctctctt

SEQ ID NO: 105249 - DNA, 50 bp, homo sapien
ttttctctgcgctcgggaataataaytcggaatgacccaaggaaccagag

SEQ ID NO: 105250 - DNA, 50 bp, homo sapien
gtagtgtagacctttaagattccaaytataagcctgtaattattaccagg

SEQ ID NO: 105251 - DNA, 50 bp, homo sapien
tgattcatagacagtgatgccagtarccttttacctttgttatatcttga

SEQ ID NO: 105252 - DNA, 50 bp, homo sapien
cacacacagccaatccatcgtagaamcatcctgttgagatcagacttgaa

SEQ ID NO: 105253 - DNA, 50 bp, homo sapien
aaaggacatcctttctatctctaccrgattcactctctctttgaagaaag

SEQ ID NO: 105254 - DNA, 50 bp, homo sapien
gaaaatatgaaactctgagactgcasacaagtgaatggtatttgagtaat

SEQ ID NO: 105255 - DNA, 50 bp, homo sapien
gcaatccatgaacatgttatatctcratagttaagccatctttgaattat

SEQ ID NO: 105256 - DNA, 50 bp, homo sapien
gggtcaacatcacctgactgatgaargtaaggagtattctgaatgtcagg

SEQ ID NO: 105257 - DNA, 50 bp, homo sapien
gttcccctctgacagccctgttggayggaactttgctttatagaggcatc

SEQ ID NO: 105258 - DNA, 50 bp, homo sapien
gagagccagcttaacatttctcttcwatcatactctttgctcaaagtaat

SEQ ID NO: 105259 - DNA, 50 bp, homo sapien
acattacagtttgtcaggactctacyaaatacaatttaaccctgttttac

SEQ ID NO: 105260 - DNA, 50 bp, homo sapien
tccggtgtgtgtaacacaggccttcmatggtcatgcgaacacaatgaaat

SEQ ID NO: 105261 - DNA, 50 bp, homo sapien
tagccttcctgcctagctgtaaccayctcgttttggggaatgggactggc

SEQ ID NO: 105262 - DNA, 50 bp, homo sapien
tcctgtttactcactgcttgcttggraatacattggtacatttctggctc

SEQ ID NO: 105263 - DNA, 50 bp, homo sapien
ggttagccttggttatgctaatgtgwcaaagagctcccatagcgaagtgg

SEQ ID NO: 105264 - DNA, 50 bp, homo sapien
aatgtttgagatgatgaatatgttamctaaaatgatctgatcactataca

SEQ ID NO: 105265 - DNA, 50 bp, homo sapien
ctgaggtaggtggtggtcatagggcrctctgaggacaggcagtagggctg

SEQ ID NO: 105266 - DNA, 50 bp, homo sapien
aagacataggtgagattagattaaaracattgtgacttgcacatgtttga

SEQ ID NO: 105267 - DNA, 50 bp, homo sapien
tggctctggatttatgatgtaagccraacgtggatactgagccagacacg

SEQ ID NO: 105268 - DNA, 50 bp, homo sapien
tagtagaggatttagaaaatatttayggctttggaaaacatgtctctaag

SEQ ID NO: 105269 - DNA, 50 bp, homo sapien
ctagcactgagatgtgttagccaccrcagagtctcatatataaattcaca

SEQ ID NO: 105270 - DNA, 50 bp, homo sapien
ctttgtctagatgtcttacaaaggawataaaaaatgaaagaggaaaaggg

SEQ ID NO: 105271 - DNA, 50 bp, homo sapien
gaataaaataacagaaaacacaaaaytaatgcaaagtgatgacaagtgcc

SEQ ID NO: 105272 - DNA, 50 bp, homo sapien
tttctgggcactactgggcagataasgttcatacaaaggacacacatgca

SEQ ID NO: 105273 - DNA, 50 bp, homo sapien
tgtatgttaggtaagtcgaactgttwcctttccagaaaagacagtgccca

SEQ ID NO: 105274 - DNA, 50 bp, homo sapien
tggtttataccacaatgagaaattaygatttgactcagaaaaaatcactt

SEQ ID NO: 105275 - DNA, 50 bp, homo sapien
gtgacctgtgaggctattatttctasgatattttgctaatctattctaga

SEQ ID NO: 105276 - DNA, 50 bp, homo sapien
tcttgaagacaaatcaaccacactartaaattattcgacctgcaggttat

SEQ ID NO: 105277 - DNA, 50 bp, homo sapien
cacgctacagacagcatttctattayaattgtcacctttgatttctgtga

SEQ ID NO: 105278 - DNA, 50 bp, homo sapien
gattaaaaccagcaaacctttttcarctcctggaaatcccagaaccttag

SEQ ID NO: 105279 - DNA, 50 bp, homo sapien
tatataggaggagtccttaacctggracccatgagcttcttaaaatatat

SEQ ID NO: 105280 - DNA, 50 bp, homo sapien
gacatgccactactcctgaaaattayggtggttttgtaattcacaaaatc

SEQ ID NO: 105281 - DNA, 50 bp, homo sapien
ccatttagagtgcaagggtctcaaaytgtatatggaaattgaagaaactt

SEQ ID NO: 105282 - DNA, 50 bp, homo sapien
ttcacatcagaaacattttgccactrtcttcttaggatacatatgtccat

SEQ ID NO: 105283 - DNA, 50 bp, homo sapien
ggagagctgagcaccagcggagggaragtcgggggtcatggaaaccaaat

SEQ ID NO: 105284 - DNA, 50 bp, homo sapien
gagattcaaaaatacatatatttgawaaaagacttcatatccacaatata

SEQ ID NO: 105285 - DNA, 50 bp, homo sapien
tagtattcaaaactctttcaagacamtaaaacatcctaaggagaaacaat

SEQ ID NO: 105286 - DNA, 50 bp, homo sapien
acatctcagagcacttctgccgtcarttacgaagtttcaatataagaatt

SEQ ID NO: 105287 - DNA, 50 bp, homo sapien
gggcaaaacttttccagtgaatgtakgttttactttttcttttcttttct

SEQ ID NO: 105288 - DNA, 50 bp, homo sapien
ggctgtgatgaggcaacggtgtccawtgagttgttttagaaaaagtgagt

SEQ ID NO: 105289 - DNA, 50 bp, homo sapien
tgtgtcaaacactaatgcatatagayactaatacaatgaaaactgaggaa

SEQ ID NO: 105290 - DNA, 50 bp, homo sapien
aagcggacacttcaaaatcaaacaaygtagcaattgaaagtaaacactaa

SEQ ID NO: 105291 - DNA, 50 bp, homo sapien
gtaacaaaaacaaaatttaaagcaarcatcgtaatgaatcttgctttggt

SEQ ID NO: 105292 - DNA, 50 bp, homo sapien
cggtggttttgtaattcacaaaatcrcttcaaaagagtatggagtgtgta

SEQ ID NO: 105293 - DNA, 50 bp, homo sapien
gtattcaaacatattcccttgaaatkaagccctcgctgtgttgtgtgggt

SEQ ID NO: 105294 - DNA, 50 bp, homo sapien
ggtggcactgcggatatttttacacrggataatgtgacctgcccagcctg

SEQ ID NO: 105295 - DNA, 50 bp, homo sapien
tcttaattgccaatgtggattctcayaaaattaaacagtattattctgtc

SEQ ID NO: 105296 - DNA, 50 bp, homo sapien
agtatagagaaatttctaataatgaraactgtccaacaatgttattggct

SEQ ID NO: 105297 - DNA, 50 bp, homo sapien
atgatatttgagatcacacaggccawctcctccattgtacagatgatgac

SEQ ID NO: 105298 - DNA, 50 bp, homo sapien
tacatgatagggctgatatggcaatmaaatcattttgtctccctctacca

SEQ ID NO: 105299 - DNA, 50 bp, homo sapien
aaatatgcttagcttctggggtagawgtgagatttagccacggttcagtg

SEQ ID NO: 105300 - DNA, 50 bp, homo sapien
atcacaggctcctgcttaccgcggtsgtttttagatccgtctttcgcctg

SEQ ID NO: 105301 - DNA, 50 bp, homo sapien
ttttaacaacctcacctattcgaaastttaaagactagaggaattttatg

SEQ ID NO: 105302 - DNA, 50 bp, homo sapien
tgcttgactacaaatgcataattaaragagtctgtcagcaggggtgggac

SEQ ID NO: 105303 - DNA, 50 bp, homo sapien
tctaaactaaatttatataaccccartactagccaaaatactattctggc

SEQ ID NO: 105304 - DNA, 50 bp, homo sapien
cacaagcagtacacaaaatggacaaygaatagtaaagggaatttataaaa

SEQ ID NO: 105305 - DNA, 50 bp, homo sapien
aggacccactccaaaccctgtttccygaatgatcaatgccttcccccatc

SEQ ID NO: 105306 - DNA, 50 bp, homo sapien
cccaggcatttgctcctttctcgtargtaggtttgcctatctttaaaagc

SEQ ID NO: 105307 - DNA, 50 bp, homo sapien
gaaaaaaatataccccctgttaaaarttactgtctcttctttattacatt

SEQ ID NO: 105308 - DNA, 50 bp, homo sapien
agacccagataaacacattaggtgaygccccaatttggagatagaccaca

SEQ ID NO: 105309 - DNA, 50 bp, homo sapien
aacaggatcaggtgttattactaccragaagaagtgtgattcttgaatct

SEQ ID NO: 105310 - DNA, 50 bp, homo sapien
tacaaatttgtacttctttgctccayagctactaagcaatagctgttgaa

SEQ ID NO: 105311 - DNA, 50 bp, homo sapien
agaagtgtcagggatgccaccataaygcaaactgtggttttgattatctc

SEQ ID NO: 105312 - DNA, 50 bp, homo sapien
gggtttaatactttgaacctgaacayaggaatagatcactttttaaaatt

SEQ ID NO: 105313 - DNA, 50 bp, homo sapien
agcccagttttttagtagctcaagaraagatcttcaatttatgtctccgc

SEQ ID NO: 105314 - DNA, 50 bp, homo sapien
aatgaagtgcattgcctttgaggtcragatcacttaattccaggctcact

SEQ ID NO: 105315 - DNA, 50 bp, homo sapien
ttcagccttggactgctaatgctaamgttgagctttcaccatcagcccca

SEQ ID NO: 105316 - DNA, 50 bp, homo sapien
aaggaattaagcttaatgtctttaaratgagtatataaaggagcaaaaag

SEQ ID NO: 105317 - DNA, 50 bp, homo sapien
aaggtgagaaatatttggaaattaartgtctgagaacaccaagattatca

SEQ ID NO: 105318 - DNA, 50 bp, homo sapien
aaaggaaaatttcttcatacaaccasagcagtcctaaaacagttcatttt

SEQ ID NO: 105319 - DNA, 50 bp, homo sapien
catacacttcaatatatttgtgcatmaaatttcaaaagctctagaaccct

SEQ ID NO: 105320 - DNA, 50 bp, homo sapien
tcagtggctggcaattagtcgatacyaaatagatacgtattaagagatag

SEQ ID NO: 105321 - DNA, 50 bp, homo sapien
gatgattctgcaagtctgtaaaccaytgggaatattataaacaagaaaat

SEQ ID NO: 105322 - DNA, 50 bp, homo sapien
acaagatttgctgaatatcatataarcaattggtgaaaattgcaccatca

SEQ ID NO: 105323 - DNA, 50 bp, homo sapien
ttgcacaggattgtgagttattctgmagatgtaaaaatataaaattcatt

SEQ ID NO: 105324 - DNA, 50 bp, homo sapien
atgtaaaactatttggaagctaataygatatctgaccttagttctagaga

SEQ ID NO: 105325 - DNA, 50 bp, homo sapien
tgtttatgggcttcttgaagtcttargcactgagaaaacatgcaaagatt

SEQ ID NO: 105326 - DNA, 50 bp, homo sapien
tcatcacagaaactcagcgtcaggartcaaagactttaaatctcactata

SEQ ID NO: 105327 - DNA, 50 bp, homo sapien
agcagctggaagaagaatattgaccrctctcaacccaaagaaatgataaa

SEQ ID NO: 105328 - DNA, 50 bp, homo sapien
tggctaactggagggtgagcatctayggcctctcattagaccaggaaaag

SEQ ID NO: 105329 - DNA, 50 bp, homo sapien
tctgttactcctagaactcacttaaygttcaccagttcatacacattcat

SEQ ID NO: 105330 - DNA, 50 bp, homo sapien
cttggggacctagaaaagatgaggaygtcaagaggaaaatatggtccagc

SEQ ID NO: 105331 - DNA, 50 bp, homo sapien
ttctcctcaagtgggtcctgaatacwctcacttatgcatctacttacatg

SEQ ID NO: 105332 - DNA, 50 bp, homo sapien
agcctcccaagtagctgggactataygctcataacaacacactcagctac

SEQ ID NO: 105333 - DNA, 50 bp, homo sapien
tggatcctgactcaaagaacaatgaygactataacaggcattttgaggac

SEQ ID NO: 105334 - DNA, 50 bp, homo sapien
acaagctaaatatcagaatgagaaayattaccagggatgaagagggaaat

SEQ ID NO: 105335 - DNA, 50 bp, homo sapien
ataggaagttctctgtgaccttttcycaggtaagaatcaagtgattccat

SEQ ID NO: 105336 - DNA, 50 bp, homo sapien
tggtcccccagtggtctcgtcataarcaaagggacactcttatcttaccc

SEQ ID NO: 105337 - DNA, 50 bp, homo sapien
tatatcttctttggtgaagtagcaaytcaaatattttgccatctctttat

SEQ ID NO: 105338 - DNA, 50 bp, homo sapien
aatccactcttacctaaatctccagyttgccagcttactctacagatttt

SEQ ID NO: 105339 - DNA, 50 bp, homo sapien
caataaaccaccataatacatcacargtcttggcaaaggttgtttccctc

SEQ ID NO: 105340 - DNA, 50 bp, homo sapien
actcgagaagatatgtgattgttgartaattatacagtgaccatatatca

SEQ ID NO: 105341 - DNA, 50 bp, homo sapien
tagcactaaatagataatcattgagrataaaaatcatacatttcaattgt

SEQ ID NO: 105342 - DNA, 50 bp, homo sapien
agccattatctcttcaattgttgcckctaccctatttgataatttcagtt

SEQ ID NO: 105343 - DNA, 50 bp, homo sapien
cccaccacctctccctgctggaccaygaggttagcgactttgaaaagttt

SEQ ID NO: 105344 - DNA, 50 bp, homo sapien
ttttatttttttcaataggtctatcrataattgttacactataaactttt

SEQ ID NO: 105345 - DNA, 50 bp, homo sapien
ggattaaactaactgcatgtgtagastcaccaaacacagtaaaattatca

SEQ ID NO: 105346 - DNA, 50 bp, homo sapien
tcatgtacaaaacatgcttctattasggacacaataatttgttcaacagc

SEQ ID NO: 105347 - DNA, 50 bp, homo sapien
tctgctgtaactaccattacctggayatagaacagtaaaacaggaaagta

SEQ ID NO: 105348 - DNA, 50 bp, homo sapien
cagtcagagaaagggggaccaaagcyactccgtgtactctcacattcgtc

SEQ ID NO: 105349 - DNA, 50 bp, homo sapien
taaaggggaacgtctctgattggcarcatctctctttcatttattgagct

SEQ ID NO: 105350 - DNA, 50 bp, homo sapien
attgacttggatttaaaagatgtttyctgttgatagtacttcccagtatg

SEQ ID NO: 105351 - DNA, 50 bp, homo sapien
acacacatttaatgtgagagatcacyatgacagagaaatggcctttgcca

SEQ ID NO: 105352 - DNA, 50 bp, homo sapien
tgtcccaaggctcatctgtggacctkttattttccatcactccctgctcc

SEQ ID NO: 105353 - DNA, 50 bp, homo sapien
ttcaatcatcactattcctgaattayttttaatactgcaagagtttttca

SEQ ID NO: 105354 - DNA, 50 bp, homo sapien
cttttgcttgtaagaatgcaaataasatgcttcgagactcagtctctctc

SEQ ID NO: 105355 - DNA, 50 bp, homo sapien
aaatatgttttatataccttttccartctcttcttctggaacactctaag

SEQ ID NO: 105356 - DNA, 50 bp, homo sapien
catttccaccgagtggctggcctcasttaggattgcagtgagcaagctgc

SEQ ID NO: 105357 - DNA, 50 bp, homo sapien
acgttatcaagatattctgtccttcygaaatccacaagatgtgtgtgcaa

SEQ ID NO: 105358 - DNA, 50 bp, homo sapien
caattctccttaaacaactggtttakgaaaagctactggactaagttctc

SEQ ID NO: 105359 - DNA, 50 bp, homo sapien
tggaagtcagatctagcggctctaaygtaagatcagagttccataaagaa

SEQ ID NO: 105360 - DNA, 50 bp, homo sapien
ctcttaccggaacttcaacgacttamaatcatctgcatctcccagcaatc

SEQ ID NO: 105361 - DNA, 50 bp, homo sapien
ctaccttctagagttcccactggtayaaaaggtggctgacgctgagtgct

SEQ ID NO: 105362 - DNA, 50 bp, homo sapien
gtgtgcaagctccttaggtgtacccrcaaatttagaaatagaaggtggcg

SEQ ID NO: 105363 - DNA, 50 bp, homo sapien
atttttcaggttaacttcaaggtttraaacaatgttagtctaatatggaa

SEQ ID NO: 105364 - DNA, 50 bp, homo sapien
agaatattatttaatggcatggaaasacaccacatgacaaaattcaattc

SEQ ID NO: 105365 - DNA, 50 bp, homo sapien
caatcagcccagagcctggctcccartaacacccacaatacctgttgcat

SEQ ID NO: 105366 - DNA, 50 bp, homo sapien
gggtcagataattgacatttaggaaktcttgagagaggggacttaaaatg

SEQ ID NO: 105367 - DNA, 50 bp, homo sapien
ttctctagaattactgatactatgargttgcaaaaatagcagccttggaa

SEQ ID NO: 105368 - DNA, 50 bp, homo sapien
gaacacttggggagtccttggtccaygctttgttagcacaacagactaca

SEQ ID NO: 105369 - DNA, 50 bp, homo sapien
ggggtagggtgatttgccttgaatcrcaacatattcctacctggagacac

SEQ ID NO: 105370 - DNA, 50 bp, homo sapien
catcagtaactatgaggagatgatayatgtttagcctacaaggaaacaga

SEQ ID NO: 105371 - DNA, 50 bp, homo sapien
agaatcactcttttccttaaaatackgcacaaaattctagtctttattat

SEQ ID NO: 105372 - DNA, 50 bp, homo sapien
ttatgaagctctattagcattatagscaaggttaattgatcatttcagta

SEQ ID NO: 105373 - DNA, 50 bp, homo sapien
caggcatgtgattcaccatgtagccygcggaaaacgctggccctcccacc

SEQ ID NO: 105374 - DNA, 50 bp, homo sapien
ctatcaaccatcagcaaaccattaaytgaataagttgacgtattagcttt

SEQ ID NO: 105375 - DNA, 50 bp, homo sapien
ccagaccagcactcttctgggtacartagggaaatacgaagaatatctgt

SEQ ID NO: 105376 - DNA, 50 bp, homo sapien
  misc_feature (1)..(1): n is a, c, g, or t
ngagagatggaggcagggcagttctrtagtcttcaccacagtgattcttt

SEQ ID NO: 105377 - DNA, 50 bp, homo sapien
ttgcaaagataatgctatttacttayatgcattttaactatgtattttaa

SEQ ID NO: 105378 - DNA, 50 bp, homo sapien
cctgtggggagctgtgaacagcatcrgcaacgagttggcactgagagtgt

SEQ ID NO: 105379 - DNA, 50 bp, homo sapien
tgctatacctatcagggttgaggacycatttttgtgtttcgacacattct

SEQ ID NO: 105380 - DNA, 50 bp, homo sapien
ttatgaaatatctctgcacttacaayttggcattcaatagaaggtgaaaa

SEQ ID NO: 105381 - DNA, 50 bp, homo sapien
ccaaaggacacagcccccgaggacgratgggactcaacaggtggagacag

SEQ ID NO: 105382 - DNA, 50 bp, homo sapien
tctttggagtctactaaaagagttaygttgcttcaaagatgaggctcatt

SEQ ID NO: 105383 - DNA, 50 bp, homo sapien
gattttcgattgtttaagaaaaaacsatagatacgaatggtgttcaaaat

SEQ ID NO: 105384 - DNA, 50 bp, homo sapien
aaaaatgggttgtgtcatttcttatyacaacaaaagattttcttgatggg

SEQ ID NO: 105385 - DNA, 50 bp, homo sapien
ctgattgccaattctcgtgataggayggggctttcatgccattatgcact

SEQ ID NO: 105386 - DNA, 50 bp, homo sapien
tgatttattcatccagccacttatgyattcgccaagctcttgatgagccc

SEQ ID NO: 105387 - DNA, 50 bp, homo sapien
gatatatcgtttcaggttttccatcrctctattacgattttagaaataat

SEQ ID NO: 105388 - DNA, 50 bp, homo sapien
tgtaattcttcaggaactttttgtakaaagcactattaagatgaacttag

SEQ ID NO: 105389 - DNA, 50 bp, homo sapien
ttgcagtcagtagccgaagaggacartgccacagagaagcagccaaaggc

SEQ ID NO: 105390 - DNA, 50 bp, homo sapien
tctttcttttggtagtagattgataygcagagtaaaatgtataagattct

SEQ ID NO: 105391 - DNA, 50 bp, homo sapien
ataagaacatgcagtaggctacagcragacacatggtcaggagacaaaat

SEQ ID NO: 105392 - DNA, 50 bp, homo sapien
tattttaactgagataacaatttcaytaatataaacaccagagttattac

SEQ ID NO: 105393 - DNA, 50 bp, homo sapien
caaggtgtttagaggctcctgtcaaygcccctcatgcttggaaatgaatg

SEQ ID NO: 105394 - DNA, 50 bp, homo sapien
tgacagtgttgaagaaattgttaggsactgccctttctaccaaaatcctt

SEQ ID NO: 105395 - DNA, 50 bp, homo sapien
aaaagtgtgcagctgcaagcattcamagagttatattgagagtgatcttt

SEQ ID NO: 105396 - DNA, 50 bp, homo sapien
agtagatggaaatcatcatacgatayggttagtggtacaattaatgtaac

SEQ ID NO: 105397 - DNA, 50 bp, homo sapien
cattttgttagccactcttccgatasacaaacaatgactcattaatcaac

SEQ ID NO: 105398 - DNA, 50 bp, homo sapien
caacactggctctttcccacctaaayttgatgattggttgatcataaaga

SEQ ID NO: 105399 - DNA, 50 bp, homo sapien
tcaataaagggcttctaacaagttgyaggaattatgcagagtgaggacaa

SEQ ID NO: 105400 - DNA, 50 bp, homo sapien
agtgccacagccatcatgatgtagasagggtatcaagggagagcaaaaca

SEQ ID NO: 105401 - DNA, 50 bp, homo sapien
taacacatgtaacaattgtcataggraaaatatcttatcttctacattga

SEQ ID NO: 105402 - DNA, 50 bp, homo sapien
gaaataagaaatgtacctgcatggcrctctggtcaaggcatgaaacatag

SEQ ID NO: 105403 - DNA, 50 bp, homo sapien
caataaataacttcactgtttgcttsaagaaactcctgcaaataatttaa

SEQ ID NO: 105404 - DNA, 50 bp, homo sapien
tcgatctattctaatagatatatgaygttaggttgaaagttgatgctaaa

SEQ ID NO: 105405 - DNA, 50 bp, homo sapien
ggtacagtttgcatattaaaagatargccagtacatctctgagatttgcc

SEQ ID NO: 105406 - DNA, 50 bp, homo sapien
atgggaggccctgatgttctctactygccttcataaataagaaccatctt

SEQ ID NO: 105407 - DNA, 50 bp, homo sapien
aaacactaaccatgaagataaggttraaaatttgaactgtgttaaaatta

SEQ ID NO: 105408 - DNA, 50 bp, homo sapien
tgtatgtttttgtttatggaaaaggragatatagcattgagttaggttgt

SEQ ID NO: 105409 - DNA, 50 bp, homo sapien
tgttggggacaactttatagttgtcrtcagtagggaacctaggagtgtgt

SEQ ID NO: 105410 - DNA, 50 bp, homo sapien
gggtccttaagaattatgctaagtcrattctgtctgtgctctataaatgg

SEQ ID NO: 105411 - DNA, 50 bp, homo sapien
atttaaacaaaacaaaacaaaaaaasttgagtgcttactatgtgccagcg

SEQ ID NO: 105412 - DNA, 50 bp, homo sapien
gaacatcatactacactgttgttgamtatctgaaagcagttatttcataa

SEQ ID NO: 105413 - DNA, 50 bp, homo sapien
gcataataatgaaaacctaaaacgayatcatgacttagtgaaagaacatg

SEQ ID NO: 105414 - DNA, 50 bp, homo sapien
agactaatgcaccaggctacctccaraagcattagagagcaatgtggttt

SEQ ID NO: 105415 - DNA, 50 bp, homo sapien
agttgttcataatagtctttgatgawgtttgatttctgtggtgtcagatg

SEQ ID NO: 105416 - DNA, 50 bp, homo sapien
caggccattttcctatttgctaaaamgtttgtttctttcttcacccagtc

SEQ ID NO: 105417 - DNA, 50 bp, homo sapien
gtttatatcaatatatgcctacatcraaaaagtagaatgacttcaaataa

SEQ ID NO: 105418 - DNA, 50 bp, homo sapien
tgacttggccttcttttcttattctstctaatcctgttttggttcatgtt

SEQ ID NO: 105419 - DNA, 50 bp, homo sapien
ggtgcagggtatcagtggtaataggmggtgcatctgagtcatcgtggctt

SEQ ID NO: 105420 - DNA, 50 bp, homo sapien
aatttaatgtctttgtgtcaggaaargcctatttattctgacaaactgat

SEQ ID NO: 105421 - DNA, 50 bp, homo sapien
tttggctaatcagactctgaacacartgaaattccttttttttttttttg

SEQ ID NO: 105422 - DNA, 50 bp, homo sapien
tcaagatattttactcagatacttaygagaagcatctctttggccatttc

SEQ ID NO: 105423 - DNA, 50 bp, homo sapien
tattttggaaaactgctagacaagakattctttgcatactcttccagttc

SEQ ID NO: 105424 - DNA, 50 bp, homo sapien
ctgtattgtggtgtcaacactggctyactttgaaatgactggcctctaat

SEQ ID NO: 105425 - DNA, 50 bp, homo sapien
ttttaaaatctcttataagcatgaaragtatttaaaatcactgtgattta

SEQ ID NO: 105426 - DNA, 50 bp, homo sapien
ctaaaaaactaatgatacaatactgraatttaaaaaacaagatgtaattg

SEQ ID NO: 105427 - DNA, 50 bp, homo sapien
acttttaatttagattttgcataccrattacaactctgcctctgcccccg

SEQ ID NO: 105428 - DNA, 50 bp, homo sapien
acaaaggcatataaactggattgagsataaatattacactttctgaggtc

SEQ ID NO: 105429 - DNA, 50 bp, homo sapien
aaagacaaccaagtggctgttaacamactagaatgaaatatctttaaatc

SEQ ID NO: 105430 - DNA, 50 bp, homo sapien
ctagagaagttgtacttaagctgaargatgagtggatgttattagacatg

SEQ ID NO: 105431 - DNA, 50 bp, homo sapien
taactcccaggtgaccaggctttccrcattttctaccattttgttggccc

SEQ ID NO: 105432 - DNA, 50 bp, homo sapien
gggttctagattttgataatcattgycaggatttgattttattttaagct

SEQ ID NO: 105433 - DNA, 50 bp, homo sapien
tgtcaggatttgattttattttaagstaacatacacaacaggttgcttgt

SEQ ID NO: 105434 - DNA, 50 bp, homo sapien
tttcttcaaatttgatgaaaacttcmaatacatagatctaacaatctcaa

SEQ ID NO: 105435 - DNA, 50 bp, homo sapien
cttctgagcagcaggcagattcgtayaccttctctttcctaccctcccaa

SEQ ID NO: 105436 - DNA, 50 bp, homo sapien
gtgtctcagggttatatacatttcamattttcttggtgtcccaggaccag

SEQ ID NO: 105437 - DNA, 50 bp, homo sapien
attccaaagacttccataaaactgargtagaggctaaggggaaggatatc

SEQ ID NO: 105438 - DNA, 50 bp, homo sapien
cactgagtggtgacactttaccaaakaacagcaatgttaagaaaaagcca

SEQ ID NO: 105439 - DNA, 50 bp, homo sapien
tacaaggattttttggtcaagaatgrattaaaacagcatgaatctttact

SEQ ID NO: 105440 - DNA, 50 bp, homo sapien
aatattttaagttaaaacgttcggargctatgtcagagtcagccaaaatt

SEQ ID NO: 105441 - DNA, 50 bp, homo sapien
cttgaaaatgtggaatatcttgaaaycaggagaagtagaggagtatacaa

SEQ ID NO: 105442 - DNA, 50 bp, homo sapien
tctcatcagtgtttcttcttgcaacrgtaatgacagagaacaatgtttta

SEQ ID NO: 105443 - DNA, 50 bp, homo sapien
aagtggaagagtttatgcattgtccrgataatttcagaataattcttgac

SEQ ID NO: 105444 - DNA, 50 bp, homo sapien
catggactgtggcacagaagacaaaygctggggaggaaaagggggaagca

SEQ ID NO: 105445 - DNA, 50 bp, homo sapien
tcttctgtaagaacatggggttgaawtgcatgctccccaaggtcttttaa

SEQ ID NO: 105446 - DNA, 50 bp, homo sapien
agtgaactcttcatgcattctgctakgtaggtggtactgttgtcaggaga

SEQ ID NO: 105447 - DNA, 50 bp, homo sapien
atgcatcaggcttgatcagaaacgcraggttttatctcagcttgaagcac

SEQ ID NO: 105448 - DNA, 50 bp, homo sapien
tgccccaaggaacgaacccattatasctgggcatccaggacccttctgct

SEQ ID NO: 105449 - DNA, 50 bp, homo sapien
catccaatgacttggagctagtccasacttataacgttgttcattggttg

SEQ ID NO: 105450 - DNA, 50 bp, homo sapien
atatttcagtatcttaacttgaacaygactcattttgtgaatttttttat

SEQ ID NO: 105451 - DNA, 50 bp, homo sapien
atgtccttcctctaccacttacttayggcgtgcctttggcaattttctta

SEQ ID NO: 105452 - DNA, 50 bp, homo sapien
taatttttggtattgtgggcttcacrcagagtaaatacattcagcaaaat

SEQ ID NO: 105453 - DNA, 50 bp, homo sapien
ttacaacaatctggctaaacgtacarcactgaatcatctaatcaaagaac

SEQ ID NO: 105454 - DNA, 50 bp, homo sapien
aaaccacaagtgaacgaaataatgtsaaactgaaaatgttctttgattag

SEQ ID NO: 105455 - DNA, 50 bp, homo sapien
catctagctctcaactttcactttasagagcactttattaaaaatgaaca

SEQ ID NO: 105456 - DNA, 50 bp, homo sapien
atagaaggctgaaacttgaagagacygaagataatatctagtttcttttt

SEQ ID NO: 105457 - DNA, 50 bp, homo sapien
tttgccagtgcaatactcgatggtgycaaggatacgtaaactcgacacaa

SEQ ID NO: 105458 - DNA, 50 bp, homo sapien
tttctttgaaggacaaaatcaaccartgagggcaaacacactgtctttga

SEQ ID NO: 105459 - DNA, 50 bp, homo sapien
cccagcaatgagggggtgtaactccrgaaacaatcagaaatttaaaaaat

SEQ ID NO: 105460 - DNA, 50 bp, homo sapien
ttctgtttgtaacacctagaaattawcatgacttatataactggctcaac

SEQ ID NO: 105461 - DNA, 50 bp, homo sapien
ataaaccagaacattcttaaatttcyacttattgcatgttgatggagctt

SEQ ID NO: 105462 - DNA, 50 bp, homo sapien
gagtactaagggctttgttgtactcygaacaagaggtattatcagtttgc

SEQ ID NO: 105463 - DNA, 50 bp, homo sapien
acaagttctgcctgagctcttagttycaagaaccgtagtaaaccccacac

SEQ ID NO: 105464 - DNA, 50 bp, homo sapien
tggaaactcacatctttttggggatyagttaattgattggagatatgaac

SEQ ID NO: 105465 - DNA, 50 bp, homo sapien
tgcaatgaaatgtgaatttcctcacmaaagaatagaaaagtagaaataat

SEQ ID NO: 105466 - DNA, 50 bp, homo sapien
atataccaagaaaaaaattgcaatayggttaaaattcctaagatgggtcc

SEQ ID NO: 105467 - DNA, 50 bp, homo sapien
gctgactggtctcatttaaaaacaaytaccctacatctcaagaaggcacc

SEQ ID NO: 105468 - DNA, 50 bp, homo sapien
ttttatttctgaagtgttttgagackgtctattatgaaagttcttatata

SEQ ID NO: 105469 - DNA, 50 bp, homo sapien
gcagcctgcgcccggatgcagcgggyacttcttctccatatggccctggg

SEQ ID NO: 105470 - DNA, 50 bp, homo sapien
gaacatgtgtgtctattgcaaacaaraatattttcagtttagaaatactt

SEQ ID NO: 105471 - DNA, 50 bp, homo sapien
ggacatgtcttcgtattgacacccaytcactaccctgtcaaaatgctgga

SEQ ID NO: 105472 - DNA, 32 bp, homo sapien
ttatgtcagtggctgargtgtggttttaatct

SEQ ID NO: 105473 - DNA, 50 bp, homo sapien
acttgtatctgtctctcttttcaccyatatctcagctattttactttcac

SEQ ID NO: 105474 - DNA, 50 bp, homo sapien
ctacacaccaactgactcttaaactsacagatttccctgggaggagaaga

SEQ ID NO: 105475 - DNA, 50 bp, homo sapien
cttgtaccaggtttactgtcttatarcggcaggatggtagctacacctat

SEQ ID NO: 105476 - DNA, 50 bp, homo sapien
taatataccttacatacttatagcayatcagagtctttaataagagcact

SEQ ID NO: 105477 - DNA, 50 bp, homo sapien
tgccttttttaaatctatcacactcrataaacgaaactgtaccaggatga

SEQ ID NO: 105478 - DNA, 50 bp, homo sapien
gtgacaatgttgctagaagcctccasgagtcgcaacatatgaaacagaaa

SEQ ID NO: 105479 - DNA, 50 bp, homo sapien
ggagtcctggggtatcacagtataaytaggagaatttctttacatttggc

SEQ ID NO: 105480 - DNA, 50 bp, homo sapien
tgcagagttgttaggaggatcaactragggaccaactgaggttccttgca

SEQ ID NO: 105481 - DNA, 50 bp, homo sapien
ggagctcttctctggttaaatgaaaycttctagctgtttcttgggcattg

SEQ ID NO: 105482 - DNA, 50 bp, homo sapien
gacaatatagggcctccatcatagamcctgagacaaagaaataaccatga

SEQ ID NO: 105483 - DNA, 50 bp, homo sapien
ttgcatcatctatccctggcaataaycaaacaattatgtttattttcttt

SEQ ID NO: 105484 - DNA, 50 bp, homo sapien
gggtggtttccaaaacaagaagaaargagaagtggtttggaaatgaaatt

SEQ ID NO: 105485 - DNA, 50 bp, homo sapien
aaagtttgcaaagatatagaagaccygagaattggctctaattagtgaat

SEQ ID NO: 105486 - DNA, 50 bp, homo sapien
gccagatcatttagactcactacagkaaatattttcactgaactaatcat

SEQ ID NO: 105487 - DNA, 50 bp, homo sapien
atcaagtagaggcagttcagagtcaytaagtcaaccactaagtcagaaaa

SEQ ID NO: 105488 - DNA, 50 bp, homo sapien
ctgcccaaccagaaaacaggttagayaacacgagctctgctgtgccttca

SEQ ID NO: 105489 - DNA, 50 bp, homo sapien
cagaactgaagtcgtagctgatcgcragagaggaatggccattatagtaa

SEQ ID NO: 105490 - DNA, 50 bp, homo sapien
aatgatacctagacccaaagagcaaygttttataaatgctgcagtcaaga

SEQ ID NO: 105491 - DNA, 50 bp, homo sapien
ttctcaatatcatctatagtaatcawttttatgtatatgttatcaataag

SEQ ID NO: 105492 - DNA, 50 bp, homo sapien
acctagatgtcctccaaagggctaasagtcaaaccatggtatattccata

SEQ ID NO: 105493 - DNA, 50 bp, homo sapien
ccatctgttaagtggagattaaaatmgtacctacctcataaaggaaaaat

SEQ ID NO: 105494 - DNA, 50 bp, homo sapien
ggtttgtgtttccacagtcaagatamaaaatagttgcattactgcaagag

SEQ ID NO: 105495 - DNA, 50 bp, homo sapien
cattcatttcctgattttgatacaaygtacgactggttttgtaggagaaa

SEQ ID NO: 105496 - DNA, 50 bp, homo sapien
gagcaacaaatgaaaataaatatgcragaaccagatccacgtgctatttt

SEQ ID NO: 105497 - DNA, 50 bp, homo sapien
tatgtatatgtgtaaatatatatgaygtttacaccaactctcttttactg

SEQ ID NO: 105498 - DNA, 50 bp, homo sapien
gatccatacagatggtttctcaggcytaatgatttactgtcattgagaca

SEQ ID NO: 105499 - DNA, 50 bp, homo sapien
agtataaacattaggcttgagtccasatcttcctagaaaattttaacaca

SEQ ID NO: 105500 - DNA, 50 bp, homo sapien
tttataatggatttctttgtaaccaygagaaaaatcactgagaataagga

SEQ ID NO: 105501 - DNA, 50 bp, homo sapien
tgtcattcatcatgagatataccatmaattttaaaatagttttgaaaaaa

SEQ ID NO: 105502 - DNA, 50 bp, homo sapien
aggtttggtgcactgcggttcaccamcagagactggacaatgcacctgct

SEQ ID NO: 105503 - DNA, 50 bp, homo sapien
ggatacagtctgtatttctttaaaaytgtaagcagtctcctaaaatcctt

SEQ ID NO: 105504 - DNA, 50 bp, homo sapien
ttctagaaactggaagatgttttgcyagatgctccttttcgtcaggatgt

SEQ ID NO: 105505 - DNA, 50 bp, homo sapien
atggaaaattcaaacatactcaaaarcaaatagtctaatgaaaccccagg

SEQ ID NO: 105506 - DNA, 50 bp, homo sapien
actgagtttaatttattttaggccayctttgatttgtttgaagcctgtat

SEQ ID NO: 105507 - DNA, 50 bp, homo sapien
ggacaaagtaagctccaaggatatayagaagctttaagaaaatgttctta

SEQ ID NO: 105508 - DNA, 50 bp, homo sapien
ttacacaggacaacatagtaagaggwcattgttaacattaagtcttatat

SEQ ID NO: 105509 - DNA, 50 bp, homo sapien
ctcttaaaacagaaatgacatataawtcgacttgcacaccaatttgggcc

SEQ ID NO: 105510 - DNA, 50 bp, homo sapien
tgaccgcaaacctttcaacagtgacrggctttaaacctgtggggcaattt

SEQ ID NO: 105511 - DNA, 50 bp, homo sapien
catttttattgagtatttaccgccaracactgtgctggatgatttagctc

SEQ ID NO: 105512 - DNA, 50 bp, homo sapien
gatggatcagtcatcatcatgaacaycagctatttcacgatggtgctctg

SEQ ID NO: 105513 - DNA, 50 bp, homo sapien
ataaaatatgattattctggtatatraagcttgttaacttttcaagtaat

SEQ ID NO: 105514 - DNA, 50 bp, homo sapien
tattaaatgtctatcttctaaaatakagcaaaattgccttttttgatgga

SEQ ID NO: 105515 - DNA, 50 bp, homo sapien
tgaacatactaattcaaaaaagagarcattatatggaagaaaaatacact

SEQ ID NO: 105516 - DNA, 50 bp, homo sapien
aatagcaaagcacaaagttctttggwaaaaacaatcatcaatctatattt

SEQ ID NO: 105517 - DNA, 50 bp, homo sapien
ttgctcatttaatcaatccaagagartatgatgatgaaatcaaagacaag

SEQ ID NO: 105518 - DNA, 50 bp, homo sapien
aaaaaaaaacattttaagaacgacartgaataagtgacactcattcttaa

SEQ ID NO: 105519 - DNA, 50 bp, homo sapien
ctaggaaaatgttttgcagtatctaytaaaactatacagatcataaccca

SEQ ID NO: 105520 - DNA, 50 bp, homo sapien
caaccacatccgacagctaggaaccygaattggcactgctcagctcattg

SEQ ID NO: 105521 - DNA, 50 bp, homo sapien
ataaataatccagttactccaataamcaagttgaaagaaaaaaaggagag

SEQ ID NO: 105522 - DNA, 50 bp, homo sapien
ttcttacataagtggtttaagtcagraaataaataacttattcaactggg

SEQ ID NO: 105523 - DNA, 50 bp, homo sapien
atgccaggatgtctatactagtcacrctaatgtcaagcattcaattaaaa

SEQ ID NO: 105524 - DNA, 50 bp, homo sapien
agacagctctggagttatagagacamtgatttggatgaagttgttgtgaa

SEQ ID NO: 105525 - DNA, 50 bp, homo sapien
attcctctctcccccaaagaataacwgtaatgagaataaaaagatcttaa

SEQ ID NO: 105526 - DNA, 50 bp, homo sapien
ttttttaacatttatcttcataaagyattcacgtgctcattcagtcttct

SEQ ID NO: 105527 - DNA, 50 bp, homo sapien
aattgtttcatttcatatgtggaaaytgatattaatatttataggcctct

SEQ ID NO: 105528 - DNA, 50 bp, homo sapien
acgtgtgacagctcagtctttccaayagtgaggacaggcttttccctacg

SEQ ID NO: 105529 - DNA, 50 bp, homo sapien
accaattacttcttcccaaaacaatyacttctcagcagttttgcaaacaa

SEQ ID NO: 105530 - DNA, 50 bp, homo sapien
ctttagcttaatatcaatacagcacratatgatttcagaggatgctttgc

SEQ ID NO: 105531 - DNA, 50 bp, homo sapien
gaacgagtaaataagtggaacagaarggatttttaggatgatgaaactat

SEQ ID NO: 105532 - DNA, 50 bp, homo sapien
ttatcagaaatgtcagttctgtgctyacaaatgtatttccttctcaacac

SEQ ID NO: 105533 - DNA, 50 bp, homo sapien
gtccaactgtgacatgcctggtgcckcacttgctgggttttagagattct

SEQ ID NO: 105534 - DNA, 50 bp, homo sapien
tagactaggtgtggcggcacgcacamctgtggtctcagctacctgggagg

SEQ ID NO: 105535 - DNA, 50 bp, homo sapien
cagaaaacaaagaaatttagtaagaytataacgcttcccatacaaggctg

SEQ ID NO: 105536 - DNA, 50 bp, homo sapien
ttcatccaaatttatgatatataacraaacaagaaaggcattttactttt

SEQ ID NO: 105537 - DNA, 50 bp, homo sapien
ttggtgacctcaattgaaactgaacycttaaaaatgatttgtctcaaaac

SEQ ID NO: 105538 - DNA, 50 bp, homo sapien
agagttttaatatcattaaattcacyaggacaatcaaactttttactaac

SEQ ID NO: 105539 - DNA, 50 bp, homo sapien
ctccatttcctaacactagacgtctyaacaatatattccaaaatatttac

SEQ ID NO: 105540 - DNA, 50 bp, homo sapien
gcattctgcaccacagtaagatgackatagttaacaataatatattatta

SEQ ID NO: 105541 - DNA, 50 bp, homo sapien
gtgttcacttttattttcatctgaargtgacaaaattgaacacaactccg

SEQ ID NO: 105542 - DNA, 50 bp, homo sapien
gactgggggttctgcggaccagaackcatggttggatttggtggtttggg

SEQ ID NO: 105543 - DNA, 50 bp, homo sapien
gcgtgtcaagacacttcaatgaggaragaatcgtttctattatggtgatg

SEQ ID NO: 105544 - DNA, 50 bp, homo sapien
tgaagtagcacagctcttaagtgatmaatcagggagtcaaaacccatctc

SEQ ID NO: 105545 - DNA, 50 bp, homo sapien
attgtaaatatatctgagccataaaygggattgaaaagaaaaacaagggc

SEQ ID NO: 105546 - DNA, 50 bp, homo sapien
attatgatggctgcaacatcaacaaygtgactaggtgataggaatattgc

SEQ ID NO: 105547 - DNA, 50 bp, homo sapien
ctataaaatattaagtggcttgttamaaagcacattggcatacttataat

SEQ ID NO: 105548 - DNA, 50 bp, homo sapien
agctagtgagtgaaccagtacaaaargtagaggtttctatctgtacatct

SEQ ID NO: 105549 - DNA, 50 bp, homo sapien
gtttgctctccctctccagaggtaaycatcatcttgcgtttagtattttt

SEQ ID NO: 105550 - DNA, 50 bp, homo sapien
ggaattctgcccagcaagttccagcsttatttttatagccctcacccaag

SEQ ID NO: 105551 - DNA, 50 bp, homo sapien
ctagtttgcttttgggaacatataargactagttcagccatgctgtgttt

SEQ ID NO: 105552 - DNA, 50 bp, homo sapien
tctaaatctacctctactatgaagaytccctagaccaaatggaaatgagc

SEQ ID NO: 105553 - DNA, 50 bp, homo sapien
ttttagataatgtatggttagaagastcatcacaaacaaaaaagcaaaaa

SEQ ID NO: 105554 - DNA, 50 bp, homo sapien
ataattaaaggaaccttattaggacmatgtggctttattgttacagctgt

SEQ ID NO: 105555 - DNA, 50 bp, homo sapien
gtgctgctgccatggcaacttagaayattgaaggcttggaagtcttttct

SEQ ID NO: 105556 - DNA, 50 bp, homo sapien
tatgaaatatttttaaactgcttagrcaatgtcatttggccatgctttct

SEQ ID NO: 105557 - DNA, 50 bp, homo sapien
ctttttacaaagatatcctacattarccagtcattttccctaatctgcat

SEQ ID NO: 105558 - DNA, 50 bp, homo sapien
caaacacactttctgagtaatgaagwattgagccaatccttggaataaaa

SEQ ID NO: 105559 - DNA, 50 bp, homo sapien
actggggagacagcaataaacatgaygaagttcccactgtcttgtgcctt

SEQ ID NO: 105560 - DNA, 50 bp, homo sapien
cttttgttatttggaaaataaacttyaagcaacactaagaaaataacatt

SEQ ID NO: 105561 - DNA, 50 bp, homo sapien
attaattaatttaccatggaatttasaagctaatgttagaacggcgtctc

SEQ ID NO: 105562 - DNA, 50 bp, homo sapien
gtttcagccaatattcaatatcagaygctgttggagccactagcctataa

SEQ ID NO: 105563 - DNA, 50 bp, homo sapien
aaataaaagtgaattaaatatgttcyggaccccaagaaaattagataatt

SEQ ID NO: 105564 - DNA, 50 bp, homo sapien
tgggcctgggtctcctggaggtccastaattccctgctccaggatgaaaa

SEQ ID NO: 105565 - DNA, 50 bp, homo sapien
aagagcaacttgtggccactttaaamgactaatcctgagactttaatcag

SEQ ID NO: 105566 - DNA, 50 bp, homo sapien
ctctagtttcaatcacgggattccaytgagcactgattgctggaaaagtt

SEQ ID NO: 105567 - DNA, 50 bp, homo sapien
taagatttctagaggtattagaatgmagaaaattgagttgttgaagagtt

SEQ ID NO: 105568 - DNA, 50 bp, homo sapien
gcttctggactgtgaagagtcatcaycttaggaaacgtcatagcattggt

SEQ ID NO: 105569 - DNA, 50 bp, homo sapien
gtgtttccagagactggtaatttccrgagagttatcatgggaggtgagcg

SEQ ID NO: 105570 - DNA, 50 bp, homo sapien
gttctgtaatgaaagtgtatctttamctcattatttatttattttattga

SEQ ID NO: 105571 - DNA, 50 bp, homo sapien
gaatcaacagaaaacctgcagctacmattaggtattctttttaatggata

SEQ ID NO: 105572 - DNA, 50 bp, homo sapien
aaggcctattggagttataaaccaasaatcatggatgaaaaccaatatat

SEQ ID NO: 105573 - DNA, 50 bp, homo sapien
gtcatattgtcttatcgtagaaatayacctactataagaaagcataggac

SEQ ID NO: 105574 - DNA, 50 bp, homo sapien
cacctacgcttgaagatccatatacraactatgaaattctcatgaagaat

SEQ ID NO: 105575 - DNA, 50 bp, homo sapien
gtatttctacgataagacaatatgamgttagaaagttgtatcacgttttt

SEQ ID NO: 105576 - DNA, 50 bp, homo sapien
tcacaaacagcgtccttcctaggacsacgctcagaccacccagaagaacg

SEQ ID NO: 105577 - DNA, 50 bp, homo sapien
cccttacattgccaaataatattcayaagtcttttatcacacacaaaccc

SEQ ID NO: 105578 - DNA, 50 bp, homo sapien
acatctgtttggggaggaattgctaygttataatcctctacgactttgag

SEQ ID NO: 105579 - DNA, 50 bp, homo sapien
aatgacagtgtgtgatttaccaggcyactttgaattggcaaattaaaata

SEQ ID NO: 105580 - DNA, 50 bp, homo sapien
atggaagagaaagacaaatgaaatartaagtctgtggtattgaattctag

SEQ ID NO: 105581 - DNA, 50 bp, homo sapien
ataagagagctaaagggagaatttamaatagatgacagaattaagaccaa

SEQ ID NO: 105582 - DNA, 50 bp, homo sapien
gtgcccctaaatcagtgttgaactcrgtatgtttaatttcaggatcagtt

SEQ ID NO: 105583 - DNA, 50 bp, homo sapien
ttttaagtcagaccatatatacatcraacattatgtacatttttcattta

SEQ ID NO: 105584 - DNA, 50 bp, homo sapien
tcccttcgggggatggatttgcaccrgatttggaatatatatgtaaatga

SEQ ID NO: 105585 - DNA, 50 bp, homo sapien
agatgtttcccactgtaaagcattawatgaagcagctggtgcaaccgtcc

SEQ ID NO: 105586 - DNA, 50 bp, homo sapien
ataaagaactattcctgaaattagaktacctaatgaattgtagatttgaa

SEQ ID NO: 105587 - DNA, 50 bp, homo sapien
tggaaaccgatctcttactgggataygtgagtcatgacctagcaggagca

SEQ ID NO: 105588 - DNA, 50 bp, homo sapien
ccaaaactagcaacactgttacatgraaatcaaagaacagggctctgaag

SEQ ID NO: 105589 - DNA, 50 bp, homo sapien
atagctcaactctctgaaaaatatayagtcggtttgaagtcttttgtgaa

SEQ ID NO: 105590 - DNA, 50 bp, homo sapien
attaacatgatgaaattgttgatcaytacacactcatctcaaggatattt

SEQ ID NO: 105591 - DNA, 50 bp, homo sapien
ttaaagcttcccaagtgattttgacsatcagttaagtttagaaaccactg

SEQ ID NO: 105592 - DNA, 50 bp, homo sapien
ggggatacatctgtgttagctgttcycttaaacttttataactggtttcc

SEQ ID NO: 105593 - DNA, 50 bp, homo sapien
ttataaggaaagctcactttagcaayagagctgacacagtagtagcaggt

SEQ ID NO: 105594 - DNA, 50 bp, homo sapien
gggtctgtgggagtttctcatttacrgtccttttgcatctccagtgtttt

SEQ ID NO: 105595 - DNA, 50 bp, homo sapien
ggctttttattgactctataaagtcwacaaaacataagggttagctatgt

SEQ ID NO: 105596 - DNA, 50 bp, homo sapien
taattactcaaaatcaatcactgtcratttgtaacaagagttaggaaata

SEQ ID NO: 105597 - DNA, 50 bp, homo sapien
ccctttctctccaactttaattagcmcaagtactgttttgcatgcatttc

SEQ ID NO: 105598 - DNA, 50 bp, homo sapien
tcagggttcaatttcttttcaagatkagcagataaaatcaatccagcaac

SEQ ID NO: 105599 - DNA, 50 bp, homo sapien
agaatactgaactcaacaaagctcasgtaaatggttatctagatcactgg

SEQ ID NO: 105600 - DNA, 50 bp, homo sapien
ccccatccaaagtgctcagtaactgygtgtgactaatggctcctatactg

SEQ ID NO: 105601 - DNA, 50 bp, homo sapien
gctttttatttcctctgaaagctcarggttgttctttgccaaaagagagt

SEQ ID NO: 105602 - DNA, 50 bp, homo sapien
tttctagttgtgaaacccaagtgaayggcagataatgtgaacataattgc

SEQ ID NO: 105603 - DNA, 50 bp, homo sapien
acaggacagggctggtcaaactgccrcctcagggcaaatgcggtctgctg

SEQ ID NO: 105604 - DNA, 50 bp, homo sapien
aacaaaaaaatcaattcttccttcaktaatgcctcagaaaaagtgtgttt

SEQ ID NO: 105605 - DNA, 50 bp, homo sapien
cttgttttcctgaaaaagtactcaasgcttaattcctcaatccagaaaaa

SEQ ID NO: 105606 - DNA, 50 bp, homo sapien
tatattcttctaatactcaaatgctygtaagaatatgacaacaacagaac

SEQ ID NO: 105607 - DNA, 50 bp, homo sapien
tttaaagccttgttcttaagcatcakaattggttttaagaacaattttgt

SEQ ID NO: 105608 - DNA, 50 bp, homo sapien
gtaggaaccagtgactgtgtgtgtakccccaaaggccttggggtgggggt

SEQ ID NO: 105609 - DNA, 50 bp, homo sapien
ttgctttattcttcagtttttagaayggtcgcttgtacccaagcccagtc

SEQ ID NO: 105610 - DNA, 50 bp, homo sapien
tcctttgagtctttgagtatactgcmcttactgtcacaattaaaataata

SEQ ID NO: 105611 - DNA, 50 bp, homo sapien
ttctgtagtatggccacttgctattsaaacttttatctcagtgctcacag

SEQ ID NO: 105612 - DNA, 50 bp, homo sapien
ccacattgttgaagagtgcatacacrggagataaaactactggaaaggat

SEQ ID NO: 105613 - DNA, 50 bp, homo sapien
gctgaaatcgtttagccaatttatartaccattactggcatccaaatcca

SEQ ID NO: 105614 - DNA, 50 bp, homo sapien
tcacaaatacataaaacctagagaaygtctttgcataaataacttggttt

SEQ ID NO: 105615 - DNA, 50 bp, homo sapien
ttttatttcggatataattggtttcragtacagagtgtcttgtctgccat

SEQ ID NO: 105616 - DNA, 50 bp, homo sapien
agaaggatttgttgcaaaaactaccrgattggacataaaacatggtttcc

SEQ ID NO: 105617 - DNA, 50 bp, homo sapien
cgtagtttgttactgagtaatgaaayggcaaataatcagttcctggaagc

SEQ ID NO: 105618 - DNA, 50 bp, homo sapien
gaatacgatggacctgtttaacaacrgcgattgtgaaacagatggagtgt

SEQ ID NO: 105619 - DNA, 50 bp, homo sapien
agttcaaagtggatccaactaagctmaaatcatggcgtcagtaaagctgc

SEQ ID NO: 105620 - DNA, 50 bp, homo sapien
aggtttacagcagtaatgtaagaaayaggtaattaataaaaatagtaaac

SEQ ID NO: 105621 - DNA, 50 bp, homo sapien
ggcagtgcacacttataatgcatgawtgtaaggtatgaatccaattaact

SEQ ID NO: 105622 - DNA, 50 bp, homo sapien
aaataagtttttgatgtcttctataratatttcaacagtcttacaaggta

SEQ ID NO: 105623 - DNA, 50 bp, homo sapien
catgaaaatatgtggaaattttcatyagtgaggattaggtttaggtgcat

SEQ ID NO: 105624 - DNA, 50 bp, homo sapien
tctctttcccaaaagcagtgctccaygaagattgccacctctaacctctt

SEQ ID NO: 105625 - DNA, 50 bp, homo sapien
aaagcctgagataggaaagggcttawcatcatcaagagacagaacggcag

SEQ ID NO: 105626 - DNA, 50 bp, homo sapien
ttctccagcagagttaaagaacttaygtccacgttgtacatctgttatac

SEQ ID NO: 105627 - DNA, 50 bp, homo sapien
gaggaaatcttttaaaggtctgcaargtatcttttttcaaattattaggt

SEQ ID NO: 105628 - DNA, 50 bp, homo sapien
aaggtgagttttttttccccatttckacacttgatgaacaaatttataaa

SEQ ID NO: 105629 - DNA, 50 bp, homo sapien
gagactgggaagagcagagtgctccrattctgtcaacatagatgcatgct

SEQ ID NO: 105630 - DNA, 50 bp, homo sapien
tagggtcttccttccagatactcgaygtgttccaatttcagggtagtctc

SEQ ID NO: 105631 - DNA, 50 bp, homo sapien
gggaacaagatcctttctgctcttaygcttaaacctcttctccctcacca

SEQ ID NO: 105632 - DNA, 50 bp, homo sapien
ggcttgtaggcacagacggtcaatarcgtggattaactaggattaaagta

SEQ ID NO: 105633 - DNA, 50 bp, homo sapien
agccatgaatgtttccataagaaacragaaaaatagaaagaatgtgtgtt

SEQ ID NO: 105634 - DNA, 50 bp, homo sapien
gcttctgtcatatagaatttttgaarggagcttgtttcttaactagcttt

SEQ ID NO: 105635 - DNA, 50 bp, homo sapien
ttagaggggatgatattaaaggaaayagttataatggctagtgtgagtac

SEQ ID NO: 105636 - DNA, 50 bp, homo sapien
aacaggcagctccttacaaagctcamagttaaattaccatgtgaccctgg

SEQ ID NO: 105637 - DNA, 50 bp, homo sapien
ctagacatgaagccatattctcgtcrctagcctggaaataatgaactatt

SEQ ID NO: 105638 - DNA, 50 bp, homo sapien
ctagtggacttcactcgccagcataygggcaatgtaaactctgcccttcc

SEQ ID NO: 105639 - DNA, 50 bp, homo sapien
caattacattatgagatactagcaakaattcctaaggataatgttctcct

SEQ ID NO: 105640 - DNA, 50 bp, homo sapien
acaattctcatttcatttctgataaygaaagtgatgaagaaactgaagct

SEQ ID NO: 105641 - DNA, 50 bp, homo sapien
ccttcactgtataccataggaatacyggcactgcctaagtgcaaggccat

SEQ ID NO: 105642 - DNA, 50 bp, homo sapien
atgcctgttcactgacagctctaaaygtggtattctgtgatagggacagg

SEQ ID NO: 105643 - DNA, 50 bp, homo sapien
tagaaaaacttgtatttaaaaattaygaaggcaactcgagggagaatata

SEQ ID NO: 105644 - DNA, 50 bp, homo sapien
tcttctgcctgcttttattctagtcrtgattgcagctgattagaggatgc

SEQ ID NO: 105645 - DNA, 50 bp, homo sapien
taataaaaccttgcaaaaagaacaayggattatgatcatgactagttttt

SEQ ID NO: 105646 - DNA, 50 bp, homo sapien
accacacctgggtcactagcacatcytgaatgacaaggtttctgttctgc

SEQ ID NO: 105647 - DNA, 50 bp, homo sapien
gaatctgctatttcttagtgccgaargatgcagcccaaatcccatttgca

SEQ ID NO: 105648 - DNA, 50 bp, homo sapien
acgtaatgtgttccatatggatagasgattttaaatgatgttttatatga

SEQ ID NO: 105649 - DNA, 50 bp, homo sapien
atagctatatctctcctgaagtcttyttgcagttactaattaaggcagta

SEQ ID NO: 105650 - DNA, 50 bp, homo sapien
cttctatagaaattacctattttgcytgatgagatttacttagaaaggga

SEQ ID NO: 105651 - DNA, 50 bp, homo sapien
gatgacattggcacacatttcttcasctaattttcagaacaagtctatga

SEQ ID NO: 105652 - DNA, 50 bp, homo sapien
aagaatgaaaatcagatttacacgasatttctcacaagaagagtgagaaa

SEQ ID NO: 105653 - DNA, 50 bp, homo sapien
attttgtctcattcattctaagtccyatctatgttttggtgagaaattat

SEQ ID NO: 105654 - DNA, 50 bp, homo sapien
agtcactatatggggtcacaatacastccttcttacaaggaagcagacaa

SEQ ID NO: 105655 - DNA, 50 bp, homo sapien
aaatttatttctgttagctgaattarcatgcattgtccttaaacatgtct

SEQ ID NO: 105656 - DNA, 50 bp, homo sapien
ttggtcaggctagtctctgttttctwaataaactacttataaggctcact

SEQ ID NO: 105657 - DNA, 50 bp, homo sapien
atttttctgagcatgattattttctraaacagtcagtgtctagagcagaa

SEQ ID NO: 105658 - DNA, 50 bp, homo sapien
aattaatgtgctatgaatctcttagrataagcaaacaccccaaggttgag

SEQ ID NO: 105659 - DNA, 50 bp, homo sapien
aacatttgaaataatacattaattcrctaatctagctgatgatcaagaaa

SEQ ID NO: 105660 - DNA, 50 bp, homo sapien
aggcaacagtgaagtttgccggttcrattgaccatttcatgcacttattt

SEQ ID NO: 105661 - DNA, 50 bp, homo sapien
ctagtcagacgttaatttgaaccacrcacagtctaagtctagaacttgtg

SEQ ID NO: 105662 - DNA, 50 bp, homo sapien
taggaggagagaaaataaaagacaartagcgtaagagaaacagctttgtt

SEQ ID NO: 105663 - DNA, 50 bp, homo sapien
atgcacattatttataactttgtaaytaagacaaatctacaatttaaaaa

SEQ ID NO: 105664 - DNA, 50 bp, homo sapien
ttagagtctccttgctattcttgagraggactctctcctgaggtactccc

SEQ ID NO: 105665 - DNA, 50 bp, homo sapien
atttactcagaatttgaaacatgtcrcagccataaacgtagaggtttaac

SEQ ID NO: 105666 - DNA, 50 bp, homo sapien
ccctctcttccttttcaggcaagcayattacatgagtttcactctcaggt

SEQ ID NO: 105667 - DNA, 50 bp, homo sapien
ttctactagctaaggatggacagacrgaaatggagctcctaaccgaaagt

SEQ ID NO: 105668 - DNA, 50 bp, homo sapien
ttgctcacaaccctaataacctaaayaagtacagtcatatggggaagaga

SEQ ID NO: 105669 - DNA, 50 bp, homo sapien
tcttaaaacacagagtactttaccarcattgactgcagaatagtccatag

SEQ ID NO: 105670 - DNA, 50 bp, homo sapien
taggtgttcttcaggcactatcatayaacacaatctgtttggtcctcttc

SEQ ID NO: 105671 - DNA, 50 bp, homo sapien
ttactgggtaatatggtaagtattawgttaaacttcaaaagacactgtcc

SEQ ID NO: 105672 - DNA, 50 bp, homo sapien
attttgacaatgtagaagtaggtacraagcaagaagggtcacagaaatac

SEQ ID NO: 105673 - DNA, 50 bp, homo sapien
tttttataatgccatccttctatgcrctctggagaatgttacattttccc

SEQ ID NO: 105674 - DNA, 50 bp, homo sapien
agaagatcaaactcctattttttgcracagtctcttttcttagctcccat

SEQ ID NO: 105675 - DNA, 50 bp, homo sapien
tttgcaacaattattacatattcagsaagcaactaagatacacattagtg

SEQ ID NO: 105676 - DNA, 50 bp, homo sapien
aaaatactggaacctttacctctacygagtgtcacaatgtctttgtaact

SEQ ID NO: 105677 - DNA, 50 bp, homo sapien
aaatatgagtctaaggatttgattcycttggttaaattattggggctgtc

SEQ ID NO: 105678 - DNA, 50 bp, homo sapien
aatacaattatcgattgcttgctatwagaagaacgtgtaaaatgagtcaa

SEQ ID NO: 105679 - DNA, 50 bp, homo sapien
tgtcacaatgtctttgtaactatgawgagttttgtgacatttcctctcca

SEQ ID NO: 105680 - DNA, 50 bp, homo sapien
accacagttctaaagcacagtctgcragaataaactttgtaaaaaagaaa

SEQ ID NO: 105681 - DNA, 50 bp, homo sapien
aacatttacattaacagggatttcawagaagttgattctggcccttatga

SEQ ID NO: 105682 - DNA, 50 bp, homo sapien
gcactatattcacattcagattgttkgtaagaggaattccaaaaagtctt

SEQ ID NO: 105683 - DNA, 50 bp, homo sapien
aaataaaaagttcatgaagacattcrcgacattaattccatattctgcca

SEQ ID NO: 105684 - DNA, 50 bp, homo sapien
tgcaacctcagttctacaggataacrcttatcatatgaaaagagaattct

SEQ ID NO: 105685 - DNA, 50 bp, homo sapien
actgtggaaacttgggttctgagacrtactggtttcaggagagactcagc

SEQ ID NO: 105686 - DNA, 50 bp, homo sapien
agatacagattcttattaatctacartaatggtttagtaatggttgtgtg

SEQ ID NO: 105687 - DNA, 50 bp, homo sapien
ttctagaacaagtttgcttacctctsctttacatcattaacttgatcctg

SEQ ID NO: 105688 - DNA, 50 bp, homo sapien
ttcattctataaatcttttctaaacrcttatcaattgcccggtttggaac

SEQ ID NO: 105689 - DNA, 50 bp, homo sapien
tactattttatctaacaattattcayattacagctacagcaacttcattc

SEQ ID NO: 105690 - DNA, 50 bp, homo sapien
caaagaattttatttaatgcttgagwcagcttggttgcaatggattaagt

SEQ ID NO: 105691 - DNA, 50 bp, homo sapien
atacattttcaatttatgtcatagakagttgctgttctaaggaaaataca

SEQ ID NO: 105692 - DNA, 50 bp, homo sapien
caacacataacatctcatttgcatasaaagaagaaaggattttaaaatca

SEQ ID NO: 105693 - DNA, 50 bp, homo sapien
aggtatatggaaacttaacacatgasagagctggattgaattctagataa

SEQ ID NO: 105694 - DNA, 50 bp, homo sapien
aaacaaccccattcatgaggattagsacttggtatagaacatgtatttcc

SEQ ID NO: 105695 - DNA, 50 bp, homo sapien
cgttcacagttggccaggagcccaaytactgagagatcttctttaccaac

SEQ ID NO: 105696 - DNA, 50 bp, homo sapien
ccaaacacatattttggattactccrggaagtataatgccttatacctat

SEQ ID NO: 105697 - DNA, 50 bp, homo sapien
atctggttgtcaaaatgggtatatgyagtgtgtaaaaattattaaacccc

SEQ ID NO: 105698 - DNA, 50 bp, homo sapien
atagacaattgtgactatcatagaamgtattggttcaaagctgctttgtt

SEQ ID NO: 105699 - DNA, 50 bp, homo sapien
agtttactgactcctggtatggacawatagattgataaaagtcatgaagt

SEQ ID NO: 105700 - DNA, 50 bp, homo sapien
tcctttctgccttacgttacaaggaracacctatatattcttcaacacca

SEQ ID NO: 105701 - DNA, 50 bp, homo sapien
agttcctggttgggtgatactaaccwctcaaaaaatgttagctattaata

SEQ ID NO: 105702 - DNA, 50 bp, homo sapien
ctgactattggggtaatctttttcaygacagatgtcccttgctttttgtc

SEQ ID NO: 105703 - DNA, 50 bp, homo sapien
ccatggttacatattaggattatcaytagccctttgcagagatccctgga

SEQ ID NO: 105704 - DNA, 50 bp, homo sapien
ggcaataaaaggtagtcaaatatackgaaactcttcttagccaaagcaaa

SEQ ID NO: 105705 - DNA, 50 bp, homo sapien
caccaggatataaaaccctttagacyaagaatcatgtatatatctttgca

SEQ ID NO: 105706 - DNA, 50 bp, homo sapien
atgttcagctatgatgtcgatcatayctaatttttgtaacagccctccaa

SEQ ID NO: 105707 - DNA, 50 bp, homo sapien
gctacctcagaatgcatatatggtawgaatataacttttaagcaattctt

SEQ ID NO: 105708 - DNA, 50 bp, homo sapien
tggtttaaaaaataacaaccgacagwcaagccaaaagcaaggcaatttgc

SEQ ID NO: 105709 - DNA, 50 bp, homo sapien
acgcagagcgttatttctttacaatwagaatttagtgggtgcaattaagt

SEQ ID NO: 105710 - DNA, 50 bp, homo sapien
tcaaacccctcaagcagtactttgcrctgggagatacaaaaacttctggt

SEQ ID NO: 105711 - DNA, 50 bp, homo sapien
cctgacctatatgagtgggaacaaasgcttgtattcagtgtgtgtgtgtt

SEQ ID NO: 105712 - DNA, 50 bp, homo sapien
acacaggaagtgtactaagtgaacaytcaatttttttcataggccataca

SEQ ID NO: 105713 - DNA, 50 bp, homo sapien
cagtaaataagtagaaacataatacrgactcctaaaataaagttaagcag

SEQ ID NO: 105714 - DNA, 50 bp, homo sapien
taggagagtacagaagattgaaccasgctagaaacagcagtctcttagac

SEQ ID NO: 105715 - DNA, 50 bp, homo sapien
tgctctataccagtacacctcagackatctgtggagaagaacatgttggc

SEQ ID NO: 105716 - DNA, 50 bp, homo sapien
cattctaaatctctttccatcaaacrtaataaatccacagcttacactga

SEQ ID NO: 105717 - DNA, 50 bp, homo sapien
ctatatattttgaacaatataaaacrattcaaaaatgtatgtgtgagatg

SEQ ID NO: 105718 - DNA, 50 bp, homo sapien
atctgacatgagacttgctatcaaaytggactggtgtctttctcgtcgaa

SEQ ID NO: 105719 - DNA, 50 bp, homo sapien
ttttccccaaaaagctttcaagtaartctagtctattcaagagcagattc

SEQ ID NO: 105720 - DNA, 50 bp, homo sapien
aacgaatccagcagattaatttggaycaataaaggattgagtctttaaag

SEQ ID NO: 105721 - DNA, 50 bp, homo sapien
gattgataatgatttcatagggtcastcagtatctgttaaatgttagtgt

SEQ ID NO: 105722 - DNA, 50 bp, homo sapien
aggagagttaaaattgttataattasaatgcaaaaagaatcagtagctgt

SEQ ID NO: 105723 - DNA, 50 bp, homo sapien
gagttctgtgacacagttataataaytaaaagggcaactgtttccttagt

SEQ ID NO: 105724 - DNA, 50 bp, homo sapien
ttgcaaatcaatggctttggtctagygtcctatagagcttggtgttcctg

SEQ ID NO: 105725 - DNA, 50 bp, homo sapien
tgagtggtaacgaataccctttatgwaatagaaccacctttctcacctta

SEQ ID NO: 105726 - DNA, 50 bp, homo sapien
gttctgtgtttttgtaattgtcttaygtttgtattacatacgctttttct

SEQ ID NO: 105727 - DNA, 50 bp, homo sapien
ccttttgtttgttgttcatgggatayggtgttatttatttatttttagtt

SEQ ID NO: 105728 - DNA, 50 bp, homo sapien
aaatggtggtatatcattgctcataratttgtatgcttatttctgtctag

SEQ ID NO: 105729 - DNA, 50 bp, homo sapien
ccaggttgagtgtgtttctgtaaaaytgcactgataggatcctgaatcac

SEQ ID NO: 105730 - DNA, 50 bp, homo sapien
tgttgtcattcaaagggcataagcamatgtcaaataattgaatcattgag

SEQ ID NO: 105731 - DNA, 50 bp, homo sapien
tgtgtcttttaaattcatgatggcarcattaatcctttcagtcttccagt

SEQ ID NO: 105732 - DNA, 50 bp, homo sapien
atgtctccccatcagctattttcccyatgacaaaagctgtgctccaaatt

SEQ ID NO: 105733 - DNA, 50 bp, homo sapien
gaagcaaatacagtaaaatgttacartctgaaaaatctaggtgtgacttt

SEQ ID NO: 105734 - DNA, 50 bp, homo sapien
ttttttagctgcagaaactctcacaygctggaaaccagagctctgcaggc

SEQ ID NO: 105735 - DNA, 50 bp, homo sapien
tcttagtctccagattcttcctatawaatgaaatatctacaaaaagtgca

SEQ ID NO: 105736 - DNA, 50 bp, homo sapien
tgcaacagttaatggaaaatagatayaccctaatgctttttgatataaaa

SEQ ID NO: 105737 - DNA, 50 bp, homo sapien
acggggtgacccacatatctttttaycctgggaccagcagggtctctggt

SEQ ID NO: 105738 - DNA, 50 bp, homo sapien
gaacagtcttctccacagtctctcaygcttcctagtcccaatcaaaagct

SEQ ID NO: 105739 - DNA, 50 bp, homo sapien
cctaaagaaataagtttcagaaggaytagaactcagaacatgaaaaaaca

SEQ ID NO: 105740 - DNA, 50 bp, homo sapien
tcttccctccccagtccaaactctaygtatgacacagttacctgtccaaa

SEQ ID NO: 105741 - DNA, 50 bp, homo sapien
aactgtcttgctcactgagaagcctsaaactattagaaaataaacacatt

SEQ ID NO: 105742 - DNA, 50 bp, homo sapien
tctaccccataatatggcataaagaragtttttaccaggaaaaaatgaat

SEQ ID NO: 105743 - DNA, 50 bp, homo sapien
gagagctttctcatgtataaaatcayatcttcacaagaaaaaaattgaca

SEQ ID NO: 105744 - DNA, 50 bp, homo sapien
ccccatgacactgtacacacgaatgmacttgttagttaaatgaattataa

SEQ ID NO: 105745 - DNA, 50 bp, homo sapien
ttggaggagacaagtctgtattcttyaacactgagagctgagggattgcc

SEQ ID NO: 105746 - DNA, 50 bp, homo sapien
ggtattctgtattctaaaatcagtgsatgtaaatctgataccttaacact

SEQ ID NO: 105747 - DNA, 50 bp, homo sapien
catattttttgtgttaggcagatcartcaaacaaacttcagctggcaatc

SEQ ID NO: 105748 - DNA, 50 bp, homo sapien
cacacatgcacatgcgattgaaagcyctgactttaaaataattctatctg

SEQ ID NO: 105749 - DNA, 50 bp, homo sapien
ttcaaggctatcaattatctgccatyacaaactaagcaattacatggatc

SEQ ID NO: 105750 - DNA, 50 bp, homo sapien
tcaggcttttagaacagcctggcaaygcttcctctaatacagctttttcc

SEQ ID NO: 105751 - DNA, 50 bp, homo sapien
catcaattcagctgcagtatcttcakttcttacagtggggaagccagaat

SEQ ID NO: 105752 - DNA, 50 bp, homo sapien
aacaatgtcaaatgagtggttggcayatatgattcaaatgtcaccaacag

SEQ ID NO: 105753 - DNA, 50 bp, homo sapien
taagatatatgcataaattaatcacraagaaaagattaactatgcacaaa

SEQ ID NO: 105754 - DNA, 50 bp, homo sapien
gagcccttaaccatggtggaaaacaktaccaaattatttctctggtaaca

SEQ ID NO: 105755 - DNA, 50 bp, homo sapien
aacagcacaactagtttattattcaytcaccttgtaaaattaggtcgtta

SEQ ID NO: 105756 - DNA, 50 bp, homo sapien
ataatgtcagattattattctaaaaygaagccaacttgcaattatttgga

SEQ ID NO: 105757 - DNA, 50 bp, homo sapien
tgccctgtagaaagccaagcccaaaygctataactccttccaaataattg

SEQ ID NO: 105758 - DNA, 50 bp, homo sapien
gtagacattgatgtgaatcatacaawataaagtagaatgttctataatag

SEQ ID NO: 105759 - DNA, 50 bp, homo sapien
agcactggtttttatccttggctacrcattagatttactgaggaagttct

SEQ ID NO: 105760 - DNA, 50 bp, homo sapien
gggggattgctgttattagaatgaamagtaaaatggcctagaaaagaaca

SEQ ID NO: 105761 - DNA, 50 bp, homo sapien
aagaggatgagatcaataagggtagwatgtactttctcagaaactaagtc

SEQ ID NO: 105762 - DNA, 50 bp, homo sapien
atcatattccagaataagatacatgsattcctttcaacagggtacacatt

SEQ ID NO: 105763 - DNA, 50 bp, homo sapien
attgttaagttttcatcactgctcaraccaagcctaaggccatttgaaaa

SEQ ID NO: 105764 - DNA, 50 bp, homo sapien
ccccttccaacagcaaaaactgatayaactggtgtggttggcaggtcttc

SEQ ID NO: 105765 - DNA, 50 bp, homo sapien
accatatcatggactgatagtcttayctatgaaattataaatccaaatat

SEQ ID NO: 105766 - DNA, 50 bp, homo sapien
gaatattaatagaacaaataataagsctaatttggatggtaaatgttctt

SEQ ID NO: 105767 - DNA, 50 bp, homo sapien
aggaggttgaggaaggcttgcctcayggttgaacacagatttttaaaaaa

SEQ ID NO: 105768 - DNA, 50 bp, homo sapien
ccagcatacatagaaattctatttamaatttgagtgacctgaacacagaa

SEQ ID NO: 105769 - DNA, 50 bp, homo sapien
tcttgtctctaaaataatggtaaaaytaacgaataatcccaaagtcaaag

SEQ ID NO: 105770 - DNA, 50 bp, homo sapien
gaataaagtttcctatacctaaggckagtacagaattctaacacagatga

SEQ ID NO: 105771 - DNA, 50 bp, homo sapien
ggactatgtctgccaatatcttctaygtgcccagaaatcatagttgctta

SEQ ID NO: 105772 - DNA, 50 bp, homo sapien
taatctgaatgatggattctcaagcrgatcaattttagaaaagagtacat

SEQ ID NO: 105773 - DNA, 50 bp, homo sapien
cctcgaagaaattgtattcaattccraagacgatttttttaagtaaatac

SEQ ID NO: 105774 - DNA, 50 bp, homo sapien
gccactgccgggcacaagggtcacastggtttataattcttccagaagag

SEQ ID NO: 105775 - DNA, 50 bp, homo sapien
tgtacacagcagcactgcatcatcaracagaaatggtatatacataataa

SEQ ID NO: 105776 - DNA, 50 bp, homo sapien
gatacatcttggctagaacaactgaygaaatttttatgtaacaccttcaa

SEQ ID NO: 105777 - DNA, 50 bp, homo sapien
cgtattaatacctatcctattcccayggaaaaaagcacactggacattga

SEQ ID NO: 105778 - DNA, 50 bp, homo sapien
gtagaatctcattggcttcactctaytactaactcaaatttttttcactg

SEQ ID NO: 105779 - DNA, 50 bp, homo sapien
tgtaatagaaaccattgttatattgmactatctttttaacaaatattgtt

SEQ ID NO: 105780 - DNA, 50 bp, homo sapien
gtgtgcaaccaatcaccatattttgrattaaggttagcaccacactagct

SEQ ID NO: 105781 - DNA, 50 bp, homo sapien
cagctaaaacatgttttatattggcmctaaaaaggaagaaaaacaattca

SEQ ID NO: 105782 - DNA, 50 bp, homo sapien
tcttgagagtaagactgctttaaaaraattgctttatgattgacatataa

SEQ ID NO: 105783 - DNA, 50 bp, homo sapien
gcattgatagtgatgatggttttaarggtatatagttatctccaaacact

SEQ ID NO: 105784 - DNA, 50 bp, homo sapien
gacctttgaatcagtcaagtgtggayctcagtacataaagtcaattagca

SEQ ID NO: 105785 - DNA, 50 bp, homo sapien
cacatgaatgatatgaaaaaacacaygcttattatcacaatcaaattaat

SEQ ID NO: 105786 - DNA, 50 bp, homo sapien
gttttttcatatcattcatgtgtagkattttgttaactagaccatgaact

SEQ ID NO: 105787 - DNA, 50 bp, homo sapien
tacatgtaattaaatttatctacaamagtaactgcaatgccacaggtgta

SEQ ID NO: 105788 - DNA, 50 bp, homo sapien
cttttaaaaaagctagtttgaccaarggaaactacagttgagatccctga

SEQ ID NO: 105789 - DNA, 50 bp, homo sapien
ttttcttccattcttggaatacactragagagaagatggaacatcaggtg

SEQ ID NO: 105790 - DNA, 50 bp, homo sapien
ctgcagaaatctgcaaaatggtttcrcagttggaaattcacagcaataga

SEQ ID NO: 105791 - DNA, 50 bp, homo sapien
atattctgcaattcttggtttttacycaacattatctgtagagtccatat

SEQ ID NO: 105792 - DNA, 50 bp, homo sapien
tataaaaatagaagaaaagctaatayaaatctcacaagtgcattttaatg

SEQ ID NO: 105793 - DNA, 50 bp, homo sapien
gattttttaaaaaccaaactatgaaytgttctatgaattagaagaaccag

SEQ ID NO: 105794 - DNA, 50 bp, homo sapien
tctttaaatgtcaactcagactaaasgaacctagaatagtaggcaaagca

SEQ ID NO: 105795 - DNA, 50 bp, homo sapien
agatctgttcatctaatgtggttatsagtccgaaatcttccaaaaggata

SEQ ID NO: 105796 - DNA, 50 bp, homo sapien
tggtagaggaagcagttggaaatgargaatatgagacaagtagaacattc

SEQ ID NO: 105797 - DNA, 50 bp, homo sapien
taatgtttctttacccacttacctaygctggcagtattattctaattaaa

SEQ ID NO: 105798 - DNA, 50 bp, homo sapien
ctcttgcaatatcccaaacaatccaygcttattatcatgcctgcttagac

SEQ ID NO: 105799 - DNA, 50 bp, homo sapien
gctctagaaaaggagactttagaccrgaatgttctacttgtctcatattc

SEQ ID NO: 105800 - DNA, 50 bp, homo sapien
tcttcaaagaaacatatttaatgatyaaggccatatctgttccactcatt

SEQ ID NO: 105801 - DNA, 50 bp, homo sapien
atagtgtaaaaaaaactatgtttcaratgtaaattaagtacacacacaca

SEQ ID NO: 105802 - DNA, 50 bp, homo sapien
tacactgtgtgaaataatgatgtcaygtcaataaatgataaaacattcac

SEQ ID NO: 105803 - DNA, 50 bp, homo sapien
aattattcttgttactgttatttcayctatatctagcatagtataactga

SEQ ID NO: 105804 - DNA, 50 bp, homo sapien
aattttttaattattctattggaaaycctttaacaataataaccaaaatt

SEQ ID NO: 105805 - DNA, 50 bp, homo sapien
ttcatgatatctttcctaaactaaayaatgttgtaatactatgtaaataa

SEQ ID NO: 105806 - DNA, 50 bp, homo sapien
gcacagtatttcttgtcatgcattcragtgctctagggcctcccgaaagt

SEQ ID NO: 105807 - DNA, 50 bp, homo sapien
attttaattttctcatttttaaagtracggatcaaactatataatttata

SEQ ID NO: 105808 - DNA, 50 bp, homo sapien
gaactatagttagtgaaaggcataamaaaatatttagggaaagtgacaag

SEQ ID NO: 105809 - DNA, 50 bp, homo sapien
atgaattagaattgacttccttataycttccagctatatttttgtcctaa

SEQ ID NO: 105810 - DNA, 50 bp, homo sapien
gggtgaagagaggtatagactgatawacgacaaagcaattatggtaaaaa

SEQ ID NO: 105811 - DNA, 50 bp, homo sapien
cattgttgctgttaataaatgccaaraacaaccaacagaataaccaaaac

SEQ ID NO: 105812 - DNA, 50 bp, homo sapien
taaaaagagtatactaatattactayaattctgtactttatatttttcac

SEQ ID NO: 105813 - DNA, 50 bp, homo sapien
gataggaggctattgcagtggcccayggtaaatgataatgaaggactgaa

SEQ ID NO: 105814 - DNA, 50 bp, homo sapien
gtttatcaccatattcaagatgaagsccaaactatttagcttgtctttca

SEQ ID NO: 105815 - DNA, 50 bp, homo sapien
ataaactagatactcatatgcttgaytaaggtgctctggattttgaaaaa

SEQ ID NO: 105816 - DNA, 50 bp, homo sapien
tgtcgtcagaactgagtatctaaggracttgtgtatatgtgtaaaattag

SEQ ID NO: 105817 - DNA, 50 bp, homo sapien
tactgtcacttagttttcaagtaacrcagaatatgtaaataaagtggtac

SEQ ID NO: 105818 - DNA, 50 bp, homo sapien
aaatcactgtgttaatagttgtggasaagttttattcatgtcctttgccc

SEQ ID NO: 105819 - DNA, 50 bp, homo sapien
tgagagagtaaattcaccattcctcwatctttttgttctatccagacccc

SEQ ID NO: 105820 - DNA, 50 bp, homo sapien
ggacatggaaagacagtctcatacaygcaattgtgtgaagaacaagttca

SEQ ID NO: 105821 - DNA, 50 bp, homo sapien
ctatgaaaagtattggcttactagamagtgagttttgatagagaaacaaa

SEQ ID NO: 105822 - DNA, 50 bp, homo sapien
ctactgaaaattagctgggaactgaygttaatttcagggactcgctgtgg

SEQ ID NO: 105823 - DNA, 50 bp, homo sapien
acagtgattaacactgatagtcatasagaaatcaacaataatattaatga

SEQ ID NO: 105824 - DNA, 50 bp, homo sapien
ttattccgtgtccataatcggtccarctactataaggagaaaattgatgt

SEQ ID NO: 105825 - DNA, 50 bp, homo sapien
ttaggacattgtggtaagtgatactraaaagtaggtggaaacagattctg

SEQ ID NO: 105826 - DNA, 50 bp, homo sapien
tggataaaggatttcacagagcttcycaaaaatctctttataggtcatct

SEQ ID NO: 105827 - DNA, 50 bp, homo sapien
atatgatacttacaactaattaggakatctctattttacttattccatga

SEQ ID NO: 105828 - DNA, 50 bp, homo sapien
atgtttgttgttttatagttttcaasagtgagcatgtaccatattttgct

SEQ ID NO: 105829 - DNA, 50 bp, homo sapien
taactccttatagtacattataatasacaagaaaattacttacttttttt

SEQ ID NO: 105830 - DNA, 50 bp, homo sapien
gaaaccttaatatcagtcaaaatcartataaataacattcatttgataag

SEQ ID NO: 105831 - DNA, 50 bp, homo sapien
agaacaaaagttgtaatatcccatgygtacttgcctaattttccttcaat

SEQ ID NO: 105832 - DNA, 50 bp, homo sapien
taattttatactgtggatatgagagmatttaagagattattaggagaaag

SEQ ID NO: 105833 - DNA, 50 bp, homo sapien
tcactggccattttagggaattatasagaaaggtccatatgtctatgccc

SEQ ID NO: 105834 - DNA, 50 bp, homo sapien
ggaaataattcttggataataacaarttggacctctgaaatgaataagag

SEQ ID NO: 105835 - DNA, 50 bp, homo sapien
actggcgtatttaggtaattagcgaygggtatggtcaaaagtgatctcca

SEQ ID NO: 105836 - DNA, 50 bp, homo sapien
ctctatgatgttagctcttgaaacayggagaacttattaggtggttttgc

SEQ ID NO: 105837 - DNA, 50 bp, homo sapien
ggatactgaatagtcctgccaagtakggtcttcttatttaaactcaggtt

SEQ ID NO: 105838 - DNA, 50 bp, homo sapien
agagagaatagtagcagtttatatayaggcttatggtttatatatatata

SEQ ID NO: 105839 - DNA, 50 bp, homo sapien
gtgaattcttcccggaagatttttcrctaactttgcccacatccatcaaa

SEQ ID NO: 105840 - DNA, 50 bp, homo sapien
taaacaggggtacactgtacattcawtgttttttggggtttcagaaaatt

SEQ ID NO: 105841 - DNA, 50 bp, homo sapien
gatattatgaactgaatataataatmaggaggctatcactcaaatccaga

SEQ ID NO: 105842 - DNA, 50 bp, homo sapien
ctttattctccatgctgttactttgmatatccaggatgtcagctaccctg

SEQ ID NO: 105843 - DNA, 50 bp, homo sapien
tccttggaagttgcttagactagttsaaataaatatgaatagttaaaata

SEQ ID NO: 105844 - DNA, 50 bp, homo sapien
ttgccttctataccattttctctcaratagatctcttccctattattatt

SEQ ID NO: 105845 - DNA, 50 bp, homo sapien
ttcagtgagaatctctattcattcawgaggaaaatcatcagtagataaca

SEQ ID NO: 105846 - DNA, 50 bp, homo sapien
aaattcctctacaaacccaccttccracttcaggtatttctcaactcaga

SEQ ID NO: 105847 - DNA, 50 bp, homo sapien
gaagtaaattaaacattacagacaartatattctgaccactcatttctaa

SEQ ID NO: 105848 - DNA, 50 bp, homo sapien
gggtttaaaatatgttagagtgaacycaaaagtacgtgttaaacaaaatg

SEQ ID NO: 105849 - DNA, 50 bp, homo sapien
ttctgtgagggatgagtgagggaacmatgaaccctacgacctgaccagaa

SEQ ID NO: 105850 - DNA, 50 bp, homo sapien
attcaacagttgacagttaaaattaygaagccaatgttccaaaatattaa

SEQ ID NO: 105851 - DNA, 50 bp, homo sapien
ctggaggccaaaatctgtcatcaaaktgagtattatcttggagacctcag

SEQ ID NO: 105852 - DNA, 50 bp, homo sapien
ggcctaaagacagctcttctaagacrattttcaatatatactctcttcta

SEQ ID NO: 105853 - DNA, 50 bp, homo sapien
atttttactgggcatatggcatacaktacatgctcaaaaagactgaattt

SEQ ID NO: 105854 - DNA, 50 bp, homo sapien
agggaatgaactaaaacagtaggcaygataagaaaggggagatttaacag

SEQ ID NO: 105855 - DNA, 50 bp, homo sapien
aagaaaggggagatttaacagcaagmaataacagaagttagtactggatg

SEQ ID NO: 105856 - DNA, 50 bp, homo sapien
ttatttatatgtttactatttataaygggccatgatatgctttatactct

SEQ ID NO: 105857 - DNA, 50 bp, homo sapien
cttgaaaatgtttggttttacagatyaacagccagacacttcataaatat

SEQ ID NO: 105858 - DNA, 50 bp, homo sapien
cccaaactcagcttctcactgtggcragtagggtatagacctcatatgta

SEQ ID NO: 105859 - DNA, 50 bp, homo sapien
gtggcttgttaatttttaatgatcartagagttctatcacaagggagaat

SEQ ID NO: 105860 - DNA, 50 bp, homo sapien
tataaaataccttaatagaaggctaygcaaaggcaaggataattgagttt

SEQ ID NO: 105861 - DNA, 50 bp, homo sapien
aggcaatcagtgcctctactagcaasacatgtagaaacacaggaaacaca

SEQ ID NO: 105862 - DNA, 50 bp, homo sapien
tttcaagactttctgatgtgatctaygttgaaacaaacaaacaaaaaata

SEQ ID NO: 105863 - DNA, 50 bp, homo sapien
ttatttagaaggtaatttttgttcartataaatcatctcataagtatcgt

SEQ ID NO: 105864 - DNA, 50 bp, homo sapien
aaaataaagtgtagaaccagcagatwacattgaaaagttttatttgtgtg

SEQ ID NO: 105865 - DNA, 50 bp, homo sapien
gcccagaaagctcctgaaagcatcawctcgggcagggaggaatttgctcc

SEQ ID NO: 105866 - DNA, 50 bp, homo sapien
gagtgcagaaacatgagtgtttgcgrcagccagctagctagattctatgt

SEQ ID NO: 105867 - DNA, 50 bp, homo sapien
aatcttcacccttcagccccttcgaygattatgtaagtacctcatcccct

SEQ ID NO: 105868 - DNA, 50 bp, homo sapien
aaatgacaaccttaactagtctctcyattgaaaagcctcataaatgtcta

SEQ ID NO: 105869 - DNA, 50 bp, homo sapien
aacagtttcttttgtaaactaaatgyacttgcaatcatatattagcatgt

SEQ ID NO: 105870 - DNA, 50 bp, homo sapien
ctgatgaaacctccattgtctcttaygttctcaagtatataaaaatactt

SEQ ID NO: 105871 - DNA, 50 bp, homo sapien
agacctttatttgctctgcttttaastattatatatatttagctattaac

SEQ ID NO: 105872 - DNA, 50 bp, homo sapien
atgatgtgtgatatcaaataagtggractgacaataagggtgattaaaat

SEQ ID NO: 105873 - DNA, 50 bp, homo sapien
tctaagctcatgttgaaaataatcayaattacagtgttgcaatataccac

SEQ ID NO: 105874 - DNA, 50 bp, homo sapien
tgtatgtcaagtaagaaaatgaagamgtctcaaacgttccacacattatg

SEQ ID NO: 105875 - DNA, 50 bp, homo sapien
gtatcttatttctactttctaagtcratttttgagaaattatcaatagct

SEQ ID NO: 105876 - DNA, 50 bp, homo sapien
gttaacttcagtccaatgatgaataragttcaaaatctttttagaaatag

SEQ ID NO: 105877 - DNA, 50 bp, homo sapien
gtgaactctccttgttattttcttcygacctcatatctcactacttgtct

SEQ ID NO: 105878 - DNA, 50 bp, homo sapien
ggtgtcccaggggcccctcctagacmaggccagtggtgaaaattactcag

SEQ ID NO: 105879 - DNA, 50 bp, homo sapien
ttccaataacaaagtttaaatacacygaattgataacatcatctaagcag

SEQ ID NO: 105880 - DNA, 50 bp, homo sapien
gtgcccaataattgggaattgggtawacagttcttaggagtcagtccaga

SEQ ID NO: 105881 - DNA, 50 bp, homo sapien
ttaagttatttataaagctgttgttraaatactaaaatgtccggtcacat

SEQ ID NO: 105882 - DNA, 50 bp, homo sapien
acattttatttatttttaatagacaytctgtggtgctgtctatggcttat

SEQ ID NO: 105883 - DNA, 50 bp, homo sapien
atacggtggcacaaaaatagattaayagaattgaatataaagttagacaa

SEQ ID NO: 105884 - DNA, 50 bp, homo sapien
ccaccctttagaggactcggttaagyactgtctagtgttctcctctaaga

SEQ ID NO: 105885 - DNA, 50 bp, homo sapien
agtctctcttatggtagcatatttgraatggagtcaacctgagtctccta

SEQ ID NO: 105886 - DNA, 50 bp, homo sapien
acaagccataaaaatcttagctcaayatgcaaggattacacatgcatata

SEQ ID NO: 105887 - DNA, 50 bp, homo sapien
tacctcaagccaactctctattccaygtgaccagccactgacctaccaat

SEQ ID NO: 105888 - DNA, 50 bp, homo sapien
gaagagggtgactagaggactgtgartatcccatcagagagaggctagtt

SEQ ID NO: 105889 - DNA, 50 bp, homo sapien
gcagttactggtttaggttttgccartgagaaactcgtgtgtgagacttg

SEQ ID NO: 105890 - DNA, 50 bp, homo sapien
gcaatttaagggaaactttggagcayatgttagagatccttgtacagccc

SEQ ID NO: 105891 - DNA, 50 bp, homo sapien
attacagcttgtgctaaaaatactasactctctcagcaaagtccacagct

SEQ ID NO: 105892 - DNA, 50 bp, homo sapien
ataggaggattctttcttcaactcawtaagtatggttttctttcaaatat

SEQ ID NO: 105893 - DNA, 50 bp, homo sapien
taaattaccttacatcttcctacaarctcatttaatattccttcgaagtg

SEQ ID NO: 105894 - DNA, 50 bp, homo sapien
tgcatttatgcatatgaaagcttagrcctctttactgcatggaatcttct

SEQ ID NO: 105895 - DNA, 50 bp, homo sapien
gtacatgtaaaatagtaagtgctcaragatatttcctgtaatcagcagca

SEQ ID NO: 105896 - DNA, 50 bp, homo sapien
ggcagcattcatatatgattgcttakgtaaggtatgtatgtgaatattta

SEQ ID NO: 105897 - DNA, 50 bp, homo sapien
tctctctgtgaggatgcaagctcaaygagggaaaaagttatggtctgttt

SEQ ID NO: 105898 - DNA, 50 bp, homo sapien
ggcaaacctgaaaatgaaaggataarttagtaagaaaaagagaaacatcc

SEQ ID NO: 105899 - DNA, 50 bp, homo sapien
ccagaagatatttttgaggtacaacrattctcaagtccctattttaagat

SEQ ID NO: 105900 - DNA, 50 bp, homo sapien
atttatttgttttctactagcagaaytgagttattcaaattgacagtctc

SEQ ID NO: 105901 - DNA, 50 bp, homo sapien
aggaggggctaagtcaacaggaagaraactgtgccctgaccaagtccaga

SEQ ID NO: 105902 - DNA, 50 bp, homo sapien
ttgttctccttaccctgtaggtgcayatcatggagacaatctgactggta

SEQ ID NO: 105903 - DNA, 50 bp, homo sapien
gtccactcccataaaacatattatcrgagaagagtgcaaaactgaagtag

SEQ ID NO: 105904 - DNA, 50 bp, homo sapien
aacatgaactgcaaggcttaatttcmaaacagtcattagaaatgaaagtt

SEQ ID NO: 105905 - DNA, 50 bp, homo sapien
tcatgtgggtaagccctgaataacckacatttctttaagctatcagcacc

SEQ ID NO: 105906 - DNA, 50 bp, homo sapien
gtcggctttcttctctccatgtttcrgagtcatcgtatgctagttttata

SEQ ID NO: 105907 - DNA, 50 bp, homo sapien
tccctttcctgctctttggttacatkaactgacttttgttgaaatttctt

SEQ ID NO: 105908 - DNA, 50 bp, homo sapien
tgttcgttttaattttttctcagcgsccgtcatttggtttacttcatttc

SEQ ID NO: 105909 - DNA, 50 bp, homo sapien
tttaaactgtatctcccactttataygtgtgccaacttttaacctaaatt

SEQ ID NO: 105910 - DNA, 50 bp, homo sapien
aactgaggcaacaagaggttaaacaraataatcacacaggtcctcagtgg

SEQ ID NO: 105911 - DNA, 50 bp, homo sapien
atacatctccttacctctaactatayatatgtctacctatctacatcaaa

SEQ ID NO: 105912 - DNA, 50 bp, homo sapien
tggtcagaatttttgaggatgttaayattttgactatcacccctggatat

SEQ ID NO: 105913 - DNA, 50 bp, homo sapien
ttacctttgaaaagtgccctcttaaycatgagcacttttgtaagcttgaa

SEQ ID NO: 105914 - DNA, 50 bp, homo sapien
aacctacactcagtgtgcagtaggtsaccaaaatatattgctcataacat

SEQ ID NO: 105915 - DNA, 50 bp, homo sapien
atagcagaagtctctttctttagcartacactctaagtgatgatgctgtg

SEQ ID NO: 105916 - DNA, 50 bp, homo sapien
agactgatatcaatcttgggttgctyacattggttattttgccatggatt

SEQ ID NO: 105917 - DNA, 50 bp, homo sapien
attacattaattgatattcatatgtkaaaccggtcttgcatatcttggat

SEQ ID NO: 105918 - DNA, 50 bp, homo sapien
tatgcagagcatttggtatcagacaygaattacaaggaaatattagaaaa

SEQ ID NO: 105919 - DNA, 50 bp, homo sapien
aacataaatgagaaacagtgagaaaygtactttctgaagacatctcttgt

SEQ ID NO: 105920 - DNA, 50 bp, homo sapien
gggtttcctaattatacttctcagtsacagttaaggcgacagcatggctg

SEQ ID NO: 105921 - DNA, 50 bp, homo sapien
tgattaattgaatgacttcaggagarcattttttctcaatttcttacact

SEQ ID NO: 105922 - DNA, 50 bp, homo sapien
actctgatgtcttctgcattcaaaartaatttccttccaccatgtggtag

SEQ ID NO: 105923 - DNA, 50 bp, homo sapien
agagacaatcttaaagcaactagaargaatacatcaaaacagaccaacaa

SEQ ID NO: 105924 - DNA, 50 bp, homo sapien
ttcacaacggatacttggtatcaacragaatgagttttcatccctctttg

SEQ ID NO: 105925 - DNA, 50 bp, homo sapien
cttgtattcagtgaggatttagacaygatttcttggcccaaatttctaat

SEQ ID NO: 105926 - DNA, 50 bp, homo sapien
tttttaaagtttagacccaaaggccrtagttataaaagattcattttgag

SEQ ID NO: 105927 - DNA, 50 bp, homo sapien
gcaggaggcagaaacagagtaaccayaaagatataacgagaactctaaca

SEQ ID NO: 105928 - DNA, 50 bp, homo sapien
ggcaaattccacatcaagtatgtaayataagaatggaagagttggggatt

SEQ ID NO: 105929 - DNA, 50 bp, homo sapien
ggaatctgagctctatcatagttcasatgtatgacttctgctttaccaca

SEQ ID NO: 105930 - DNA, 50 bp, homo sapien
ttcacttgacattttcttaaacactsaacaaatcttttttctactagtta

SEQ ID NO: 105931 - DNA, 50 bp, homo sapien
atgttttctcgcaattttacataggwagacaggacatgatctaaatgttc

SEQ ID NO: 105932 - DNA, 50 bp, homo sapien
tatttggataaggtttggcaaagcawctagtaagattaactgaatgagtt

SEQ ID NO: 105933 - DNA, 50 bp, homo sapien
gtgaataactgaatccttagaaaaastgagggaagacaatcaggaagaaa

SEQ ID NO: 105934 - DNA, 50 bp, homo sapien
atttccctaaaatgatctaattatawgcattgcaagttattttatgtctc

SEQ ID NO: 105935 - DNA, 50 bp, homo sapien
ttatttatatttatgttgtcacaagraagaattaaatttcaatgatcaaa

SEQ ID NO: 105936 - DNA, 50 bp, homo sapien
tagatattgccgaatggcgtcttcaygagtaggttgatttctcgcctaat

SEQ ID NO: 105937 - DNA, 50 bp, homo sapien
aatcccactctgatgagactagaatsaattaactccagtgcctaatacac

SEQ ID NO: 105938 - DNA, 50 bp, homo sapien
tttagtagctgaggaaatctctaaamtgagcctggaagagtatgtggtat

SEQ ID NO: 105939 - DNA, 50 bp, homo sapien
aagtgatatttacaaaataatggtayctctgagtggctcaaagtaaattt

SEQ ID NO: 105940 - DNA, 50 bp, homo sapien
ggcccaaatttctaatttatctgackaagaaactttatctctgaccagat

SEQ ID NO: 105941 - DNA, 50 bp, homo sapien
aaatctccaatcaagaatacttcacyatttaatgtgttttataacactgg

SEQ ID NO: 105942 - DNA, 50 bp, homo sapien
tcacaatgagaatttttgattcttayatttgtctacaagctctagcagta

SEQ ID NO: 105943 - DNA, 50 bp, homo sapien
ttttgttagcatcaggatgaaaaagsatgttatttatatgcaaaaacatt

SEQ ID NO: 105944 - DNA, 50 bp, homo sapien
agttacctctagatagggaatcccayggccttatctgtgcattgagttcc

SEQ ID NO: 105945 - DNA, 50 bp, homo sapien
atgatatctatatgagagatttaatraagtgttaaggtatgctgggttca

SEQ ID NO: 105946 - DNA, 50 bp, homo sapien
aaatagtaattttaaaaatacagaakagtcttgtcactgtccacatatgt

SEQ ID NO: 105947 - DNA, 50 bp, homo sapien
aacaaataaataatgctacagacatraatatagatacacgtgttcatata

SEQ ID NO: 105948 - DNA, 50 bp, homo sapien
cggtaagtttttttaaaacacttcaractcggtgacactcactaagtttg

SEQ ID NO: 105949 - DNA, 50 bp, homo sapien
caggagagaaaaaaaggcaaatatasgacaagcaggatatacttttgtcc

SEQ ID NO: 105950 - DNA, 50 bp, homo sapien
acagccaaaccatatcaatatggaastagcaccatgagtcatggattgag

SEQ ID NO: 105951 - DNA, 50 bp, homo sapien
actacatttattaacaaaggctagamtacaaaatattaagtcaaaaataa

SEQ ID NO: 105952 - DNA, 50 bp, homo sapien
ggaaagaggggattcaaatccaatcsaaaagctgaacattgaccagcacc

SEQ ID NO: 105953 - DNA, 50 bp, homo sapien
gaaatctaaaatgaagaaaattgtamagagcatacaatcagcaactgaat

SEQ ID NO: 105954 - DNA, 50 bp, homo sapien
cttaaaagatacaatgtaattcttcyggtgaatttaactgaattaggata

SEQ ID NO: 105955 - DNA, 50 bp, homo sapien
ctaagttgaccaggtcatgctaaatyaaagaaagttaagtggtgtttttg

SEQ ID NO: 105956 - DNA, 50 bp, homo sapien
agaaagattcagttatcaaaaagatsaatcaacaggatgtttaacaagca

SEQ ID NO: 105957 - DNA, 50 bp, homo sapien
ggtgacagggagaataaaatgcaagmagtggaaaggagaaaaagaaccaa

SEQ ID NO: 105958 - DNA, 50 bp, homo sapien
ctggtaagataacccaacgcgcgacsaaaaggagaggttgcaaaaggact

SEQ ID NO: 105959 - DNA, 50 bp, homo sapien
tgtgagtgatagtattcgctattacyatcacatctatcttcatgttctaa

SEQ ID NO: 105960 - DNA, 50 bp, homo sapien
acccggaattaaagcagaatctttcraagcttaacacctaatatgttatg

SEQ ID NO: 105961 - DNA, 50 bp, homo sapien
actgtgtttttactgttgtagctccraaggatagcacagtgcttgcacag

SEQ ID NO: 105962 - DNA, 50 bp, homo sapien
ttcccatcattctacacctatgccargtttcaagattggctttgatgtgt

SEQ ID NO: 105963 - DNA, 50 bp, homo sapien
gttagaagaattttattagtaatacycttattcatgcttcttatcttttt

SEQ ID NO: 105964 - DNA, 50 bp, homo sapien
gagggaaagagttatatagagaaaayggccttgggaggaaaagacatcca

SEQ ID NO: 105965 - DNA, 50 bp, homo sapien
atgagaccttgtggattttccaaaawatataccgtgccagtggcagctta

SEQ ID NO: 105966 - DNA, 50 bp, homo sapien
tcttgatgtgttatatttctaaagaycgcacatacaatcttaaatagata

SEQ ID NO: 105967 - DNA, 50 bp, homo sapien
aatgatgaatgtgacacaatccatgsaaatgcaatagtcagcaatatatt

SEQ ID NO: 105968 - DNA, 50 bp, homo sapien
aatattgccatctgggtagaaatcaycgtacattctgaatttttcttgtg

SEQ ID NO: 105969 - DNA, 50 bp, homo sapien
cagcaaatgatgattaggctatgaastgcccaaagcttaaataattacag

SEQ ID NO: 105970 - DNA, 50 bp, homo sapien
aagtcttaatttgttttaataccaastcaaaaatctaaaacccagagtct

SEQ ID NO: 105971 - DNA, 50 bp, homo sapien
tttcatatacatgtatatttgtaggkatcagaaatggtttttcttctaga

SEQ ID NO: 105972 - DNA, 50 bp, homo sapien
ttcttcaaactgtattataatgtgcraccagattaagctatctctagaat

SEQ ID NO: 105973 - DNA, 50 bp, homo sapien
tctgtctctgagtgtttcaaagatayggaagcatgtttgatgaaagatca

SEQ ID NO: 105974 - DNA, 50 bp, homo sapien
gcagatagttatattagccattcaarttattttaagctagtgatcacatt

SEQ ID NO: 105975 - DNA, 50 bp, homo sapien
tctatataactttttgcattcagcartaacataccctggacatttttcta

SEQ ID NO: 105976 - DNA, 50 bp, homo sapien
gcatttaaggtttgacttcctttctyaacttgtgaattctttatgttgta

SEQ ID NO: 105977 - DNA, 50 bp, homo sapien
tggatgaactggttggcaaagatgastaaatcatgttccatctgcaagaa

SEQ ID NO: 105978 - DNA, 50 bp, homo sapien
tatcaagcattgtttttatttactaracttcactaggcattttaggaacc

SEQ ID NO: 105979 - DNA, 50 bp, homo sapien
gatcgtatcatgtttcaaggtgaaamtacattcaacaaagcagcatataa

SEQ ID NO: 105980 - DNA, 50 bp, homo sapien
tttaaaatttctcatcaacatttccraagaagatatcaagaatacgaata

SEQ ID NO: 105981 - DNA, 50 bp, homo sapien
atgataatataagaagctgagagaawaatttcaactaagaagttgaagaa

SEQ ID NO: 105982 - DNA, 50 bp, homo sapien
agaaggagaaatcaagcaggctctcrcagactcagtcacagtgacgttta

SEQ ID NO: 105983 - DNA, 50 bp, homo sapien
atggcatcagcttcactgttggcaaragtatgagaacagggaagaagctg

SEQ ID NO: 105984 - DNA, 50 bp, homo sapien
ggtacactgaggaaaataatacttayggctgattgtctgaagaacaaggt

SEQ ID NO: 105985 - DNA, 50 bp, homo sapien
gagaacccagagtgtctattaagaastgaaagggtgtcaagaaaaatagg

SEQ ID NO: 105986 - DNA, 50 bp, homo sapien
agctttttgttgtttcagcacctcaytaatttctgttttggttattattg

SEQ ID NO: 105987 - DNA, 50 bp, homo sapien
ctgtttcctatgatcacttgtccaayaaaatacctgcaagcaagtcttag

SEQ ID NO: 105988 - DNA, 50 bp, homo sapien
agattaaagatagccataaattgtcrctctaaaaaatcaagaaatggagt

SEQ ID NO: 105989 - DNA, 50 bp, homo sapien
aattttatcttatatctgtaaaagayggagtaatattgcctatttttctg

SEQ ID NO: 105990 - DNA, 50 bp, homo sapien
tgcaagctgattgaactcatgtcaastcctgaggatatattatatttgac

SEQ ID NO: 105991 - DNA, 50 bp, homo sapien
atattttttagctgcgaagaggctarcatatttcaaacaagaagtctgaa

SEQ ID NO: 105992 - DNA, 50 bp, homo sapien
atcatcttctgaaacagtagcatctsaaaatcagtgaaatattgacagca

SEQ ID NO: 105993 - DNA, 50 bp, homo sapien
gttggccaacagcactgattccctcrgaaccatataaccaaatcaccatg

SEQ ID NO: 105994 - DNA, 50 bp, homo sapien
aacctttcttctcgtattgagtctaygttaaagtgccataaatcttgttg

SEQ ID NO: 105995 - DNA, 50 bp, homo sapien
gggttaattttttatacaactcatcygaagacttcatgcaaggctgggca

SEQ ID NO: 105996 - DNA, 50 bp, homo sapien
aggaaagagagaactcttggattaaraaaaattccaaagtgtaatatagt

SEQ ID NO: 105997 - DNA, 50 bp, homo sapien
tttttgttttaaaggcatttttgtawgactgaaaacagtaggtattattc

SEQ ID NO: 105998 - DNA, 50 bp, homo sapien
ttaaatttttactagttggccactayaaaaagatatgcatcagtgttaaa

SEQ ID NO: 105999 - DNA, 50 bp, homo sapien
agctgcagagtgaactgttggggaastattctttggtgcacacagaaaat

SEQ ID NO: 106000 - DNA, 50 bp, homo sapien
tctctgatttagatatattaagcatsatcagttttagatatttggtgaaa

SEQ ID NO: 106001 - DNA, 50 bp, homo sapien
gtcaatctgttcttgtagtatgtctyaattttattgtgataaaaataatg

SEQ ID NO: 106002 - DNA, 50 bp, homo sapien
gcctatataacattctgatattacamaattaatgcaaagaaattgttcac

SEQ ID NO: 106003 - DNA, 50 bp, homo sapien
catactgtatttactgctacaaataygcagtaaaatttatggtcatgcta

SEQ ID NO: 106004 - DNA, 50 bp, homo sapien
tgtctaattactataaactctgatamtagttactgaattattgcttgctt

SEQ ID NO: 106005 - DNA, 50 bp, homo sapien
gtccagccacgggaagaaatgaaagkattctccatcagccagatggtgtg

SEQ ID NO: 106006 - DNA, 50 bp, homo sapien
acatctcctttctttggcttggacckacctcatgggtgtccctttccaca

SEQ ID NO: 106007 - DNA, 50 bp, homo sapien
tttgtctttcccaccttgttaggctkcttctttgcctttctgcctggcaa

SEQ ID NO: 106008 - DNA, 50 bp, homo sapien
tgagaataatcattctaccataacamatattaactgtgaaagttaaggga

SEQ ID NO: 106009 - DNA, 50 bp, homo sapien
gtttttcatatgtcaattaagactgmactccggagaccattaaggaaaag

SEQ ID NO: 106010 - DNA, 50 bp, homo sapien
gttagagcactaggatgcaccattcsatagaacaatagtaaaactggcag

SEQ ID NO: 106011 - DNA, 50 bp, homo sapien
aaattttatttatctccgtgacttayagagttctaacaaacctagcaaat

SEQ ID NO: 106012 - DNA, 50 bp, homo sapien
gtaaatacatttacctatttcagccrcatataggacaaaagataccatgt

SEQ ID NO: 106013 - DNA, 50 bp, homo sapien
tatttatctctcagtctgttggagargattccactttcctaatcttcatg

SEQ ID NO: 106014 - DNA, 50 bp, homo sapien
gcatttaccaaatgccaaccatgatraaaatcatttagaacaacttagaa

SEQ ID NO: 106015 - DNA, 50 bp, homo sapien
gaatttccaattcattaagttttacygcatagctattaaaatcaatagaa

SEQ ID NO: 106016 - DNA, 50 bp, homo sapien
caagaggaagaagatagcttcaatamagtataaacaccagagagattaat

SEQ ID NO: 106017 - DNA, 50 bp, homo sapien
ttgaaaatagatgtgaaagggtggamaaatcatttgaggacaactgagaa

SEQ ID NO: 106018 - DNA, 50 bp, homo sapien
ctcaaggcaatggtcatgttccctgmaattgtgtccactctgcagaaaca

SEQ ID NO: 106019 - DNA, 50 bp, homo sapien
tcatgaagcagtttgtctcctgaacrcagccatgctgagaagttctaaac

SEQ ID NO: 106020 - DNA, 50 bp, homo sapien
tttttgtttctttaaccttctggaamagtggcacgttaaacattttgtga

SEQ ID NO: 106021 - DNA, 50 bp, homo sapien
tctctagcctagaacttctactttayggtcactttaattcatcaataatc

SEQ ID NO: 106022 - DNA, 50 bp, homo sapien
tatgcatcaacttagagtgccagaartcctaatataccaaagctgataaa

SEQ ID NO: 106023 - DNA, 50 bp, homo sapien
gttgtaaggacacaataggcaaactsagtcatccaaaaatgagaaataaa

SEQ ID NO: 106024 - DNA, 50 bp, homo sapien
aaccaaattcaaagatcacttactayacaaacctactggtagaccatgaa

SEQ ID NO: 106025 - DNA, 50 bp, homo sapien
ttccatgaatgcttcatttgtagtargaaagttattgattcaaagatcat

SEQ ID NO: 106026 - DNA, 50 bp, homo sapien
ttcagtaaagtcctctgtaaaaatayacttgcattctaccaagaaagtta

SEQ ID NO: 106027 - DNA, 50 bp, homo sapien
tatccatccttcttggactagtgccrcagacaaagaatgggatggggaaa

SEQ ID NO: 106028 - DNA, 50 bp, homo sapien
tatgtttagtaagatgttttcttggratgagagggtataaagattaatgt

SEQ ID NO: 106029 - DNA, 50 bp, homo sapien
aggacctagaaactagctatgtgccrggaagaaatctatgaacaaaacca

SEQ ID NO: 106030 - DNA, 50 bp, homo sapien
catagtaggttcttactacatgtgamgtgcaagaataggattaaacggaa

SEQ ID NO: 106031 - DNA, 50 bp, homo sapien
aaagagtataatgaaagataagatcraaaatgaataaatctaggacattg

SEQ ID NO: 106032 - DNA, 50 bp, homo sapien
tctcccagtaatggagaaagtagaamattgttaaagacatatttactgac

SEQ ID NO: 106033 - DNA, 50 bp, homo sapien
tgctagagaacttctcaagtgattgkaaagtagccatgtgtccaaatggc

SEQ ID NO: 106034 - DNA, 50 bp, homo sapien
atttattcgtgcaaaccattgtgcaygtattctataggttattccagccc

SEQ ID NO: 106035 - DNA, 50 bp, homo sapien
ttgagtctgttttgtctcaatgtaasagcagaatagtggaattcgtatgg

SEQ ID NO: 106036 - DNA, 50 bp, homo sapien
aacaagaaagacaaaacaaacaatayaaggttgcattactgagttggcca

SEQ ID NO: 106037 - DNA, 50 bp, homo sapien
atgtaatttttattctgtgcctagakaggtaagcaattattttctcttct

SEQ ID NO: 106038 - DNA, 50 bp, homo sapien
tatcccaaacaataataaattgaaaycacagtttggtattacatatgtat

SEQ ID NO: 106039 - DNA, 50 bp, homo sapien
agaataaatatgagttgaaaacatamataaataatgatacatttcataca

SEQ ID NO: 106040 - DNA, 50 bp, homo sapien
acattgtattatttattgtagtatgycaagtagtacttttgaaaatatgt

SEQ ID NO: 106041 - DNA, 50 bp, homo sapien
ctttaaaatgttatattgcctacagmatcgggttgagagtatagcctagg

SEQ ID NO: 106042 - DNA, 50 bp, homo sapien
aattaaataattgttacttggatatraaatagtagagctctaccttatca

SEQ ID NO: 106043 - DNA, 50 bp, homo sapien
ttgcaccaaaataaacttgtactaaygttatgacatgtcttaacaggatc

SEQ ID NO: 106044 - DNA, 50 bp, homo sapien
ataaatttgtcagtggagccctgtcrtccttaaagatctctgtgatcact

SEQ ID NO: 106045 - DNA, 50 bp, homo sapien
ccatagtggtactggcatctctgccwctatagttataaaagattggcctt

SEQ ID NO: 106046 - DNA, 50 bp, homo sapien
acagacaaataagctgtaataactcyctgttgtaaaatgaaaacaaataa

SEQ ID NO: 106047 - DNA, 50 bp, homo sapien
acacacatctctaatggaactgagawattttattacactttgactttcca

SEQ ID NO: 106048 - DNA, 50 bp, homo sapien
acaacatggaggcaacttgtgacatyaatttaaaaatcttgggaaagtga

SEQ ID NO: 106049 - DNA, 50 bp, homo sapien
taatgatcttacattgattgagatasccctaggatgtcccttaagcagtg

SEQ ID NO: 106050 - DNA, 50 bp, homo sapien
atcacaattatcaaaaagattggtcraagagggatatcagtgagcaagtg

SEQ ID NO: 106051 - DNA, 50 bp, homo sapien
gaaaaaagtcatcattatgttaaaawcacatcatcattattaaacatgtc

SEQ ID NO: 106052 - DNA, 50 bp, homo sapien
attttgttataaatatttagtggaaycaaaaagactttatcatgtaaatt

SEQ ID NO: 106053 - DNA, 50 bp, homo sapien
ttaaataggacagttaaggttagtawctctggatggtgagacctagagct

SEQ ID NO: 106054 - DNA, 50 bp, homo sapien
tattgaaaataggaattcaaagaaargatttcagccaactgaaagaaaac

SEQ ID NO: 106055 - DNA, 50 bp, homo sapien
ggatagaatttcacttaataatcaartaatgggtatagcattaacctccg

SEQ ID NO: 106056 - DNA, 50 bp, homo sapien
atacattaatataaattgtgtttggkcacttcagagtaaattgtgtatca

SEQ ID NO: 106057 - DNA, 50 bp, homo sapien
cattggttcattcactcaaggagtaygcattaggccctgggcatatgact

SEQ ID NO: 106058 - DNA, 50 bp, homo sapien
aggaagatgaagtgtcagcggtgtakagatccaggagaaaggaagagtcg

SEQ ID NO: 106059 - DNA, 50 bp, homo sapien
cccaggagcagaaatgagagaatagyactaccgcttcagagagattagtg

SEQ ID NO: 106060 - DNA, 50 bp, homo sapien
cacaggtccaagcatcctggtgctaygccattttcttctttcagttccct

SEQ ID NO: 106061 - DNA, 50 bp, homo sapien
ggtggagttgtttcaggagcaaaaayagtatgtgcacagccctgaggcaa

SEQ ID NO: 106062 - DNA, 50 bp, homo sapien
taagaaataattaattgtataataaytgtgcttgtataataattaagaaa

SEQ ID NO: 106063 - DNA, 50 bp, homo sapien
ttgataaggactttgtagtcttgtamcatttctctcctttccatctccag

SEQ ID NO: 106064 - DNA, 50 bp, homo sapien
gttttcctcttcatgctaatcttcaygttagtttgtgcttgatttcagca

SEQ ID NO: 106065 - DNA, 50 bp, homo sapien
ttaatgaagggtagttatctcctaawgatgttggaattcagcaatcattt

SEQ ID NO: 106066 - DNA, 50 bp, homo sapien
ctggccctttatagaaaagtctgtgragccctgatctacagcatgttgga

SEQ ID NO: 106067 - DNA, 50 bp, homo sapien
atcctaggcaggagttaaagcatgamaacaaagaagaaaggattttagaa

SEQ ID NO: 106068 - DNA, 50 bp, homo sapien
aggaataatattcccaggatgaaaaygtccataaataagctattacctga

SEQ ID NO: 106069 - DNA, 50 bp, homo sapien
actgtctgaatcaccttgttggaacyaatgtgattttttggtctaagaca

SEQ ID NO: 106070 - DNA, 50 bp, homo sapien
atgttggcacagcccaactgactcaygtttatgtcccgcagttgagaata

SEQ ID NO: 106071 - DNA, 50 bp, homo sapien
catcccgaatttttcctgtatagcaytcactgtatttataattacattgt

SEQ ID NO: 106072 - DNA, 50 bp, homo sapien
tctacagtcattaattctaaatcctsagcttcttagtcaccgcctctccc

SEQ ID NO: 106073 - DNA, 50 bp, homo sapien
taaaggcagtgttaataaatcttgaygaaaactttctaatgattttgcag

SEQ ID NO: 106074 - DNA, 50 bp, homo sapien
ctcagacttgcagtgctttttataamcattgtgaaacttcatttgaggta

SEQ ID NO: 106075 - DNA, 50 bp, homo sapien
cttaatatgcaagtgaaaattgaacracagtattagatggttgatactgc

SEQ ID NO: 106076 - DNA, 50 bp, homo sapien
gtgcaagtctttgtgagtatgtacawgatattttaaaacccagagtttat

SEQ ID NO: 106077 - DNA, 50 bp, homo sapien
tagtagggagttgcctagtacatggyatgaaatttgcatttttcctaggc

SEQ ID NO: 106078 - DNA, 50 bp, homo sapien
ttaaccacagtttctctcattaaacrgtctcatggctttgaaattcttcc

SEQ ID NO: 106079 - DNA, 50 bp, homo sapien
tacggatgatgctttctcatttgacrataaaaatctggtttgcagtgctt

SEQ ID NO: 106080 - DNA, 50 bp, homo sapien
attgcttcttcctttttagccttcgwattccatgtatttaaccagtcccc

SEQ ID NO: 106081 - DNA, 50 bp, homo sapien
accaatgtgattttttggtctaagayatgaatgctacccttcatcctgac

SEQ ID NO: 106082 - DNA, 50 bp, homo sapien
tccatcttccatgctggctgcagttwacacaggaaaaccggggttcaggg

SEQ ID NO: 106083 - DNA, 50 bp, homo sapien
aggaatccttagttgatgaaacaacmattctcaaaggcctcatcttctct

SEQ ID NO: 106084 - DNA, 50 bp, homo sapien
ctttttgttttttaagaaaagcaacrtaagcaacaaaagcttccctgcct

SEQ ID NO: 106085 - DNA, 50 bp, homo sapien
attttaacaagatccccaagtgaccratttgcacagtaaggtatgaaaag

SEQ ID NO: 106086 - DNA, 50 bp, homo sapien
taattaataataggtgacaaaagaawttcatagtgactattaaaggaata

SEQ ID NO: 106087 - DNA, 50 bp, homo sapien
gggttaggcaggtacatagtatcccrattttacggatgagaaaaatgaag

SEQ ID NO: 106088 - DNA, 50 bp, homo sapien
acctactctggggtatttggggtggycaacattaaacacagcagcccagc

SEQ ID NO: 106089 - DNA, 50 bp, homo sapien
cctgatccttatccccaggaggatckaagactcacatgttatcgacagac

SEQ ID NO: 106090 - DNA, 50 bp, homo sapien
ggctgtactcccatgaaatttagccrcccatagctggccaacttagcatt

SEQ ID NO: 106091 - DNA, 50 bp, homo sapien
attggattcagatgagaatggaagcraggcattagagacaaatacagaca

SEQ ID NO: 106092 - DNA, 50 bp, homo sapien
cactcatcgttacttctgacttccawcaaataaagtgagtagttgttaca

SEQ ID NO: 106093 - DNA, 50 bp, homo sapien
ttcacaatgtaattactatcataaamaattcaaaggacacattttaaaga

SEQ ID NO: 106094 - DNA, 50 bp, homo sapien
tatcttgttgataagcaaatcaaaayctgactgtcttttatttttgtttt

SEQ ID NO: 106095 - DNA, 50 bp, homo sapien
taaagctaaccaatatgatggtaacmagtttggtgttaaatgtgagtaaa

SEQ ID NO: 106096 - DNA, 50 bp, homo sapien
ggggcaaggtcttagtggccctcaayattagtaattaggaggtgcttatt

SEQ ID NO: 106097 - DNA, 50 bp, homo sapien
ccccaaaaccctcataaaaggtccartcaggatatcaggaagttacagag

SEQ ID NO: 106098 - DNA, 50 bp, homo sapien
ataagtatcttactcttttgtaaaawttgaggcgtatatatagcttgctc

SEQ ID NO: 106099 - DNA, 50 bp, homo sapien
gctaggtactattgactatctaagamgattacacccacgtccatatctgt

SEQ ID NO: 106100 - DNA, 50 bp, homo sapien
aatggggatagtaactccctcttaartgagacagtgatcttaaagagcag

SEQ ID NO: 106101 - DNA, 50 bp, homo sapien
gcatgtaaatgctacagatgatgtcyacattaaagaactacattgacctg

SEQ ID NO: 106102 - DNA, 50 bp, homo sapien
tatctcaaaatatccagcttctcaaygtgttacttgtctcatgtcggtct

SEQ ID NO: 106103 - DNA, 50 bp, homo sapien
gtttttgttggtgaaactagttatayaccttgctaacttgagtaatgaaa

SEQ ID NO: 106104 - DNA, 50 bp, homo sapien
tcctagcattaggtcaccttttgacyaacagcattcaaagatatgattgg

SEQ ID NO: 106105 - DNA, 50 bp, homo sapien
aaacactggtgaaaactgagacttaygagattcgcttggaaaattgggtt

SEQ ID NO: 106106 - DNA, 50 bp, homo sapien
taactgagtattaaatgaattaataygtataaagctatcattttgttaat

SEQ ID NO: 106107 - DNA, 50 bp, homo sapien
ctaaggctttcttggagattcatccyagtaaaaaagaagcttgttgagtc

SEQ ID NO: 106108 - DNA, 50 bp, homo sapien
gtcactaaaagaaaatgattattacrgagttcaagaaaaattattcaaaa

SEQ ID NO: 106109 - DNA, 50 bp, homo sapien
ttacaatttttctaaagatgttttamagtagatactaacagtacagcccc

SEQ ID NO: 106110 - DNA, 50 bp, homo sapien
cacaaacacaatgactttcactgccracaacattcagtgcttgacttaac

SEQ ID NO: 106111 - DNA, 50 bp, homo sapien
tgcaatgaaggtttcaaggtgaagamcaactccagtaaagagcttggtgg

SEQ ID NO: 106112 - DNA, 50 bp, homo sapien
gagataaactgatataaacactaatyattagactggtgaatctttattta

SEQ ID NO: 106113 - DNA, 50 bp, homo sapien
ttcagagaaagtggtaattcaatgcrtaacatattttcaaatgtttctta

SEQ ID NO: 106114 - DNA, 50 bp, homo sapien
tgtaagtcatacagttttcttcataytagatgtttgaataggatggagct

SEQ ID NO: 106115 - DNA, 50 bp, homo sapien
tgtcaaacccattcattcagtcagaygtattgtttgattttattgaatca

SEQ ID NO: 106116 - DNA, 50 bp, homo sapien
caagttcacatagttgtcacaatacrgaaatgtttaccaagttggtttaa

SEQ ID NO: 106117 - DNA, 50 bp, homo sapien
cttttacttaactgacataaaatcartatttaagtggcactctaaaatgt

SEQ ID NO: 106118 - DNA, 50 bp, homo sapien
aggtgagaacctttgaaaacaggtasaaatcgtgcatgggcaccacagac

SEQ ID NO: 106119 - DNA, 50 bp, homo sapien
tgctttttagaaaaatatcaggaacrctatactatgaaattgctatagaa

SEQ ID NO: 106120 - DNA, 50 bp, homo sapien
aaagtatccagtccagcctctaacaygcaataaattttggctattattac

SEQ ID NO: 106121 - DNA, 50 bp, homo sapien
cctattagtcatagtatacacagtartaatagccaaaatttattgcgtgt

SEQ ID NO: 106122 - DNA, 50 bp, homo sapien
aacacttaagttacactatgaatacracccaaaaatttgcaattgagaaa

SEQ ID NO: 106123 - DNA, 50 bp, homo sapien
gggcttgggggaataagcagaaagarctgttttacagtacctcaaagacc

SEQ ID NO: 106124 - DNA, 50 bp, homo sapien
tttggagatttccaatcattctgcakgtagatttttatttcaattgaact

SEQ ID NO: 106125 - DNA, 50 bp, homo sapien
caatttttacagtgcaattttgtaayctttcttatttcagtataaattag

SEQ ID NO: 106126 - DNA, 50 bp, homo sapien
attaatttatgccagtgcataaaaarcttcctcattattttctttagcag

SEQ ID NO: 106127 - DNA, 50 bp, homo sapien
atgaagattcttctatgcctttcccragaggtccccagatgttgaatata

SEQ ID NO: 106128 - DNA, 50 bp, homo sapien
cttcttttttcatgttggatgagaartagagaaaagggatgatttgtgaa

SEQ ID NO: 106129 - DNA, 50 bp, homo sapien
atttacaaggaaacttgtcagaaaayggataggctggtaagggagatgtg

SEQ ID NO: 106130 - DNA, 50 bp, homo sapien
tgtaactgttgtaatttggagttacraaaaatgctctttttttagtgatg

SEQ ID NO: 106131 - DNA, 50 bp, homo sapien
tccagttctaatccctaatttcttawgctgtacatagatttgcctacgta

SEQ ID NO: 106132 - DNA, 50 bp, homo sapien
cacaaatagaagatttaagattagakaagtaatggcataattctagagga

SEQ ID NO: 106133 - DNA, 50 bp, homo sapien
agaaacaaaaaaaagacaagttggasataagagttagaaaaaaaacagag

SEQ ID NO: 106134 - DNA, 50 bp, homo sapien
ctaaatgctaggcaataatgatatgyaggataaaatagaatatgtaggac

SEQ ID NO: 106135 - DNA, 50 bp, homo sapien
ctttgccaattttgcttcttataccmaattaaatgttgaatgttttagtc

SEQ ID NO: 106136 - DNA, 50 bp, homo sapien
agtggtatcaattgttaaacttacaytgattttaaagataacataggaat

SEQ ID NO: 106137 - DNA, 50 bp, homo sapien
tttattaacactgtcaagttacagaycacagctggttcatggaaaaacta

SEQ ID NO: 106138 - DNA, 50 bp, homo sapien
tatcttaacctattttatacaggaartgcttcaaaataaaaacctaaaat

SEQ ID NO: 106139 - DNA, 50 bp, homo sapien
aatcaaaacctaactagatacatacyattcaggaacaacgaaaacaaaaa

SEQ ID NO: 106140 - DNA, 50 bp, homo sapien
actgttttaagaatgccgtgcccctraacagtttcacttgtgcagctgca

SEQ ID NO: 106141 - DNA, 50 bp, homo sapien
gtgggaattaaaagccctgtgataartgtataatgagaaaactgaatact

SEQ ID NO: 106142 - DNA, 50 bp, homo sapien
agtattcaaaaaacatttagaactaygtaaatacttgttgaaaagtgaaa

SEQ ID NO: 106143 - DNA, 50 bp, homo sapien
caataagctgaaagctcacacggcartattcctttaggtggacgtgggga

SEQ ID NO: 106144 - DNA, 50 bp, homo sapien
tttatggatttttctaaaaggaacamtagtatcattctcatagctttagt

SEQ ID NO: 106145 - DNA, 50 bp, homo sapien
catggctatttccatggaactatgaygctgagaacctctgccaagaaggc

SEQ ID NO: 106146 - DNA, 50 bp, homo sapien
aaagctgtttttcatttaattcaatraccactcaagaatcatgcatttta

SEQ ID NO: 106147 - DNA, 50 bp, homo sapien
gatggtgctacaattctggccacagyctaaagtaaaagtagagtccgggt

SEQ ID NO: 106148 - DNA, 50 bp, homo sapien
cttaggaaaatagcatgcagttgaamatttatattcaggtgtgtaaatgc

SEQ ID NO: 106149 - DNA, 50 bp, homo sapien
agagaccctgtctcaataataataayagttccaacggccaacatttgcaa

SEQ ID NO: 106150 - DNA, 50 bp, homo sapien
attgcatcttgaggatacaccattarctgaacatatccataacttttgct

SEQ ID NO: 106151 - DNA, 50 bp, homo sapien
gaagtctacatttatttcttcttatyactcattttggaatggatgctaca

SEQ ID NO: 106152 - DNA, 50 bp, homo sapien
acaaaaaaaaaaaaactcaaacatgrtataaacagtgaataatgtattga

SEQ ID NO: 106153 - DNA, 50 bp, homo sapien
tttgcatattttattcatggactaamatccttgtctgactttcacaacta

SEQ ID NO: 106154 - DNA, 50 bp, homo sapien
tcccagagctcattcccttttgtagygcaaatcagtagttggtagcaaat

SEQ ID NO: 106155 - DNA, 50 bp, homo sapien
ctgaaggaatttgctatgtatcctcraagtatagctgtatcactgtgatt

SEQ ID NO: 106156 - DNA, 50 bp, homo sapien
cacccagttgagaatagagaatttcsatgcacactacagagaacatatta

SEQ ID NO: 106157 - DNA, 50 bp, homo sapien
aatgaagagcttcctctccaatgaayagatatatgtaaatgggtaaagaa

SEQ ID NO: 106158 - DNA, 50 bp, homo sapien
atcaatccctttaactagttctgacraagagtcttgttacaacctttccc

SEQ ID NO: 106159 - DNA, 50 bp, homo sapien
ttatatatataggtataatctcaaasaggcaggtttgctctggaggaacg

SEQ ID NO: 106160 - DNA, 50 bp, homo sapien
aaattttatgttacagtgcatttgartaatacaacctaatggaatctggc

SEQ ID NO: 106161 - DNA, 50 bp, homo sapien
attcattttcttcgaacttttactcraagccatgtttttctagagtgggc

SEQ ID NO: 106162 - DNA, 50 bp, homo sapien
cctgtcagctttcctgtgtcttagakatttagtttttggagttcctggta

SEQ ID NO: 106163 - DNA, 50 bp, homo sapien
aactcattatataatttaattgctaygtgttgttataagagaaaagtaat

SEQ ID NO: 106164 - DNA, 50 bp, homo sapien
aaaagcaattaccttatgaagtgtakagtaaaatctcagttttgttatat

SEQ ID NO: 106165 - DNA, 50 bp, homo sapien
aattgtgtctgagagacttgaaaacyaactgtattatcaaaaatggcaac

SEQ ID NO: 106166 - DNA, 50 bp, homo sapien
caatattctacaaggagtgcttgaamctttacatctattatataccatgt

SEQ ID NO: 106167 - DNA, 50 bp, homo sapien
ctatttgttgaattcattttttaagwctcctggaatcaccagaagtataa

SEQ ID NO: 106168 - DNA, 50 bp, homo sapien
gcaggtgcaaagttcagaggtaaaayttgtagacccatgttcatagcagc

SEQ ID NO: 106169 - DNA, 50 bp, homo sapien
aataggatcagataggatttcctaargctatttgttgaattcatttttta

SEQ ID NO: 106170 - DNA, 50 bp, homo sapien
actctagtaaaatcactaaaccaagkcctacagtaacctgttaactaacc

SEQ ID NO: 106171 - DNA, 50 bp, homo sapien
aaaattaccaaagaaacaatgtccasaaaccttcaaaatttggcaagaga

SEQ ID NO: 106172 - DNA, 50 bp, homo sapien
aattgaaattacccaatctgagtgaraaagagcaaattggctgaccataa

SEQ ID NO: 106173 - DNA, 50 bp, homo sapien
acggcttcacagttaataaaatgcartcagacaaaacaactgtgttaacc

SEQ ID NO: 106174 - DNA, 50 bp, homo sapien
tgagtttgctgtaattgaatacatayagcaataagagccatggggatggg

SEQ ID NO: 106175 - DNA, 50 bp, homo sapien
agtgtacattctgaaaacagaaaaarcctctcacatttcaaaggggagca

SEQ ID NO: 106176 - DNA, 50 bp, homo sapien
aatttatagtatctctcttctcatakccctagctctcagtagaggtggca

SEQ ID NO: 106177 - DNA, 50 bp, homo sapien
gctgggttgattttatagttatctcygaacttactgtcttcagctccctg

SEQ ID NO: 106178 - DNA, 50 bp, homo sapien
tgtaatgtccttcaatgataagtatsaatataactgaagcagattataca

SEQ ID NO: 106179 - DNA, 50 bp, homo sapien
atttcttcccctgcctattgccctayggaaaatgttatttgatgcacaag

SEQ ID NO: 106180 - DNA, 50 bp, homo sapien
ttcactttagtagaaggaatacatasgtgtttttacttgcccatccaaat

SEQ ID NO: 106181 - DNA, 50 bp, homo sapien
acagacgcatctgtagcagagtggawcttgtactaacttatgatagaatg

SEQ ID NO: 106182 - DNA, 50 bp, homo sapien
agggatatctttccatagcagtacaygtagaactttttctttttaactgc

SEQ ID NO: 106183 - DNA, 50 bp, homo sapien
aagaaacgggtacacgtagctctctracacttattttataagggattttg

SEQ ID NO: 106184 - DNA, 50 bp, homo sapien
ctacatctccataaacctgtgtacasaaaaagttgaaaataaaccacatg

SEQ ID NO: 106185 - DNA, 50 bp, homo sapien
ttgtaaaaggtcaccagataaataaytgccttctgaattgggatgattcc

SEQ ID NO: 106186 - DNA, 50 bp, homo sapien
aaaggtgcttttatgtattgatctgwaatgtctctgtgatttccaagcac

SEQ ID NO: 106187 - DNA, 50 bp, homo sapien
aaaaacttaagtcaatgtgtcaaaayagtaaatagttgcatgtgtttttt

SEQ ID NO: 106188 - DNA, 50 bp, homo sapien
gtgtcaacaaagccttagctgaaaaytgaggtgagatttggaagctcctg

SEQ ID NO: 106189 - DNA, 50 bp, homo sapien
agctcactcctgcagagggatgtatraaaatcctatgggagcagccccgt

SEQ ID NO: 106190 - DNA, 50 bp, homo sapien
aggcagcctaaatatgtttaagatayatgatgttcgtggtagctatttta

SEQ ID NO: 106191 - DNA, 50 bp, homo sapien
atatgaaatgagtgatgaactcctgmggcagaagtattaccatttggtgc

SEQ ID NO: 106192 - DNA, 50 bp, homo sapien
acctctgataagataattagagtcaygtaggaacagggaagacatgaact

SEQ ID NO: 106193 - DNA, 50 bp, homo sapien
cttactctctaagtgatgttcctcayagtaatgactgtttctcaggaaga

SEQ ID NO: 106194 - DNA, 50 bp, homo sapien
cttctaataaagactctggtctaccrcaatagtaagtcttgattccaaat

SEQ ID NO: 106195 - DNA, 50 bp, homo sapien
gcactcttgactgtagctgttggaaytcccaagtctaatctagaagcttt

SEQ ID NO: 106196 - DNA, 50 bp, homo sapien
atgaaccaaactgttaatgctgatayagcctcccctacctactacaggta

SEQ ID NO: 106197 - DNA, 50 bp, homo sapien
tgagttcaggataactatgatacaaygacatcacaacaattatatttagc

SEQ ID NO: 106198 - DNA, 50 bp, homo sapien
atttgagtgtacctatattaaaataygtcaagtgcggaacatttctagaa

SEQ ID NO: 106199 - DNA, 50 bp, homo sapien
ttgtcatcccctcccccatccaagaraaacgaacaaaaaatacttacaat

SEQ ID NO: 106200 - DNA, 50 bp, homo sapien
gatgaagtggaaaactggattttgayagtcactatatcatctgggagacc

SEQ ID NO: 106201 - DNA, 50 bp, homo sapien
atgctcagtcctttgaccatagtaaytcattagttttcaactggtctccc

SEQ ID NO: 106202 - DNA, 50 bp, homo sapien
tagtttggacagatatcttaatctawctccaatccttagagaaagcactg

SEQ ID NO: 106203 - DNA, 50 bp, homo sapien
ttcctcctcaaccacttgctgggtcrataattccaagactgccagaaaaa

SEQ ID NO: 106204 - DNA, 50 bp, homo sapien
ttttttgaaaagtggcttctgtatayatctgatctaattcttcatagttt

SEQ ID NO: 106205 - DNA, 50 bp, homo sapien
catagtaagtgattaactagcaaaargtaaagctatttatagcaaatttc

SEQ ID NO: 106206 - DNA, 50 bp, homo sapien
gggcatgtttttatttaagacttgaygagtaccaactcttgttctgagca

SEQ ID NO: 106207 - DNA, 50 bp, homo sapien
acagtaacgtaacaactcatgtttawgtaaggctttacctgttcacaaaa

SEQ ID NO: 106208 - DNA, 50 bp, homo sapien
accccagaaacccactatagtaccayaaaacatctgaaaacacttatgtg

SEQ ID NO: 106209 - DNA, 50 bp, homo sapien
taataactaattaataactaataacyaattattggcactaataactccat

SEQ ID NO: 106210 - DNA, 50 bp, homo sapien
tatctactgtgtgccaggcactttarataaatattgtgtctaatcttcaa

SEQ ID NO: 106211 - DNA, 50 bp, homo sapien
tccttgccccaccgaatactttctakgccttcttcctcaaactcgctgtg

SEQ ID NO: 106212 - DNA, 50 bp, homo sapien
gtcttgtttggaccaaattgccttaycttctctacctgcttgtcttaagc

SEQ ID NO: 106213 - DNA, 50 bp, homo sapien
tgaccaatctgataattaatgaaaayggagcaatttggcaactaataaag

SEQ ID NO: 106214 - DNA, 50 bp, homo sapien
gtcacattcatttagatcttagttgsatgccagttgttctaattaggaat

SEQ ID NO: 106215 - DNA, 50 bp, homo sapien
aaccagccttgtgatcttgggtaaaytccctaccacctctggactccatc

SEQ ID NO: 106216 - DNA, 50 bp, homo sapien
aaaaacagtctttgtaggtgacacaytggcaagtctctctgaggattaca

SEQ ID NO: 106217 - DNA, 50 bp, homo sapien
atatagcacaagcttcagttttaaartaatctgtaatatacactcaactc

SEQ ID NO: 106218 - DNA, 50 bp, homo sapien
ctaggggagaaagggtcacttggaayaagatcatagctggtaccttctta

SEQ ID NO: 106219 - DNA, 50 bp, homo sapien
tatcaaactcaacacagtcactttakaattgaaatccaaataattcatag

SEQ ID NO: 106220 - DNA, 50 bp, homo sapien
caaggcagtcgtggatgataggcaartctatgggctggatttcccaaacc

SEQ ID NO: 106221 - DNA, 50 bp, homo sapien
tcaagctacaatgtctgaactctaascattcaaaattgaaaataaggtgg

SEQ ID NO: 106222 - DNA, 50 bp, homo sapien
atcacaaccagtcctttaagtcttasctattatcttgcagactatattct

SEQ ID NO: 106223 - DNA, 50 bp, homo sapien
ctgagaatccagctgtgttggctcartcagagaatgcaatggaaggttgg

SEQ ID NO: 106224 - DNA, 50 bp, homo sapien
atttataagttccatctatatgacaycaaatcattgggatgaaatatgga

SEQ ID NO: 106225 - DNA, 50 bp, homo sapien
gggttattagtaagtaggggaactawgaaaacactgtgaagtgctaaatg

SEQ ID NO: 106226 - DNA, 50 bp, homo sapien
tttaaagacagcatgttacatttacracaagtttgaggacacataacatc

SEQ ID NO: 106227 - DNA, 50 bp, homo sapien
aaagctggtccaagggtatagccagraagattaatcctgtagcagcattt

SEQ ID NO: 106228 - DNA, 50 bp, homo sapien
catcaaattctccacagattaaaaaycatcatcctaataactgaacccag

SEQ ID NO: 106229 - DNA, 50 bp, homo sapien
caatggagatgttcaaaccaaagaargctaggatctttaaatggcaaatt

SEQ ID NO: 106230 - DNA, 50 bp, homo sapien
tgatttatgttacttgtcatgtctcycgttatgatattttatatccagac

SEQ ID NO: 106231 - DNA, 50 bp, homo sapien
ggttcagtaatacccttggaattaakaaactaacaacataacgaaatacc

SEQ ID NO: 106232 - DNA, 50 bp, homo sapien
atgcaccactccttaaatgtttgtaycatcctgagaaatcagaagaggat

SEQ ID NO: 106233 - DNA, 50 bp, homo sapien
attcttaacacatcacaattgaggamtggaggaactgcttacaaaatgca

SEQ ID NO: 106234 - DNA, 50 bp, homo sapien
tccacaccagtctttaaaattgaaaygatacatcctcatatcaagcctga

SEQ ID NO: 106235 - DNA, 50 bp, homo sapien
agatcactggtctaaaccttactcaragtcagtatcaagctattactagc

SEQ ID NO: 106236 - DNA, 50 bp, homo sapien
aagtcaaggtattttatgagtggaaraacagatttatttatttctttcct

SEQ ID NO: 106237 - DNA, 50 bp, homo sapien
tcagatttaaaggagcactgtgataygggtttttaatttgatgcagtact

SEQ ID NO: 106238 - DNA, 50 bp, homo sapien
ccagttctcttaatcgccaagaaaaytaggtaccacatattttgattatt

SEQ ID NO: 106239 - DNA, 50 bp, homo sapien
tagtttaatttcacaaattctaccayggaaatacacaattgcccacccac

SEQ ID NO: 106240 - DNA, 50 bp, homo sapien
caatactggtgctctaatagggaaarttcaggctgctgtgggagcaaata

SEQ ID NO: 106241 - DNA, 50 bp, homo sapien
atgctatcaatcagagaaaataagasactataatccttttatgtttttgc

SEQ ID NO: 106242 - DNA, 50 bp, homo sapien
tgtatattttgaacaagaagtgaaargagtctagcacagtacatagaaca

SEQ ID NO: 106243 - DNA, 50 bp, homo sapien
taaactcattagcttgtgtccattamaattgaatttgtagttaaaaatat

SEQ ID NO: 106244 - DNA, 50 bp, homo sapien
cactctgaatgatgacttaagtacayttgctttacaggggaaccgcaacc

SEQ ID NO: 106245 - DNA, 50 bp, homo sapien
tatatctgagctctgcataagcaggwacaagaggaaaacactagcatgct

SEQ ID NO: 106246 - DNA, 50 bp, homo sapien
ttttgaagaactcggtttaaactggyagccaaagcagttgcagttaaaac

SEQ ID NO: 106247 - DNA, 50 bp, homo sapien
ggagatcctggaaataagagaaccaytgatgaacggagaaaaactcctca

SEQ ID NO: 106248 - DNA, 50 bp, homo sapien
attttatctggctcactcttatgacyctatcttatgttagtatttatttg

SEQ ID NO: 106249 - DNA, 50 bp, homo sapien
aaagtcattactctgctaatcataaygaggaagaagtgattaaaatatta

SEQ ID NO: 106250 - DNA, 50 bp, homo sapien
gagtgagatcagggctgggaaaatcrccgtcgccttttgaggatttagtt

SEQ ID NO: 106251 - DNA, 50 bp, homo sapien
acttatcaaaattgatatgatgaaaygaggaagcttcgatttcataaatg

SEQ ID NO: 106252 - DNA, 50 bp, homo sapien
ggttgaattctgaagatgcagaggaycaactatgcaggcatgaaagaaag

SEQ ID NO: 106253 - DNA, 50 bp, homo sapien
aaaatattataaaatgtacttctggraacttgtgtttttgtttgtttgtt

SEQ ID NO: 106254 - DNA, 50 bp, homo sapien
ggttcttgttactttatcttggcacrattttagttgcatctaattgtgtg

SEQ ID NO: 106255 - DNA, 50 bp, homo sapien
aaagaattcttaaacaacaaaacaastcattaatgtgcaatttaaaaagc

SEQ ID NO: 106256 - DNA, 50 bp, homo sapien
gttgcagtgtggttgaggccaggaasattgtcattgccttctcttctgct

SEQ ID NO: 106257 - DNA, 50 bp, homo sapien
actgtcattttaacagctggtctaartgaatatcaggttgttgtttaaaa

SEQ ID NO: 106258 - DNA, 50 bp, homo sapien
caaataaaacactgaggctgagacasattaagtaacctgcccaggtccca

SEQ ID NO: 106259 - DNA, 50 bp, homo sapien
cccaatccctgatttcttggtttgcrgatgccctacagagagagattcac

SEQ ID NO: 106260 - DNA, 50 bp, homo sapien
tacatctcagaacatacaagaaggcraattgtacctcccaactccaaatg

SEQ ID NO: 106261 - DNA, 50 bp, homo sapien
agaagcaaaactaactgcaaaggcckgatacagaggttaaaaatatattt

SEQ ID NO: 106262 - DNA, 50 bp, homo sapien
gccccatttcctgttagaagtaggtmaagtatgtacagaacatacataaa

SEQ ID NO: 106263 - DNA, 50 bp, homo sapien
agcagcttctaggtcctgtctatgcyacatgggctccaagagatgaattg

SEQ ID NO: 106264 - DNA, 50 bp, homo sapien
aactgagacttacttaatacagtccrgcaaagcagaactggataaaagcc

SEQ ID NO: 106265 - DNA, 50 bp, homo sapien
agggcacgtgactatctctaaactaycactggcaagagaggcaagattat

SEQ ID NO: 106266 - DNA, 50 bp, homo sapien
aggaagaaatctggaacttatttcayactgtatacaagattctagacaga

SEQ ID NO: 106267 - DNA, 50 bp, homo sapien
gagatcttcattatcagatatcgaayttataaactacaatatttaaggca

SEQ ID NO: 106268 - DNA, 50 bp, homo sapien
agtggcatccttggcaacagaattaycgagagcaccaagaacgctgaaac

SEQ ID NO: 106269 - DNA, 50 bp, homo sapien
atgctgttatgaagagggcagataartaatatgaaccaattgttagttag

SEQ ID NO: 106270 - DNA, 50 bp, homo sapien
caagaattttttcagcaaacattaasttaatactagtagaaataaaaaag

SEQ ID NO: 106271 - DNA, 50 bp, homo sapien
tgaccagttggaagaaggaagcaatktgagttgaaaaaagatgcctcata

SEQ ID NO: 106272 - DNA, 50 bp, homo sapien
gtcagttgtatccaatttgctgcatsaagctaatttgttttcagatataa

SEQ ID NO: 106273 - DNA, 50 bp, homo sapien
gaactgagagacaactgggaggttcygattttgttgtctgggaggatggg

SEQ ID NO: 106274 - DNA, 50 bp, homo sapien
gacatcaggtaggacacatcaccaargactgggcatagtaagtaggtggt

SEQ ID NO: 106275 - DNA, 50 bp, homo sapien
cattgggaaacaactggaaaatttcmgaaaagacacaagagggctctaag

SEQ ID NO: 106276 - DNA, 50 bp, homo sapien
aaatgaccctgtttcttgaacaaatwagtagcatttaaaagaggaaagag

SEQ ID NO: 106277 - DNA, 50 bp, homo sapien
aaacaataattatgagaataattatsacaaaaatgccttgacattgacaa

SEQ ID NO: 106278 - DNA, 50 bp, homo sapien
gaccgcaagccatccatccctttcaytatcccattcactattctggacag

SEQ ID NO: 106279 - DNA, 50 bp, homo sapien
tgctattggctaatatataattatgraccattccgttttattttgctaac

SEQ ID NO: 106280 - DNA, 50 bp, homo sapien
catttgaatcttccttccaattccaraggtttatctgaggccaaagctat

SEQ ID NO: 106281 - DNA, 50 bp, homo sapien
ccttgaactccatgcaattaaaacaktcaataaactgagttccttctatg

SEQ ID NO: 106282 - DNA, 50 bp, homo sapien
gtacacagtgctaaaatacaagtgcmatacatggaagatgtcagcatgac

SEQ ID NO: 106283 - DNA, 50 bp, homo sapien
ttatggcattaaattgctttaaaaawttttcatgacagcttaattctgta

SEQ ID NO: 106284 - DNA, 50 bp, homo sapien
tggctggggcccactgcataatccartcacaaaagaaagagttgggggtg

SEQ ID NO: 106285 - DNA, 50 bp, homo sapien
caatttgctaacgtgcttaagaaaaytgatatggttcataaaacaaggac

SEQ ID NO: 106286 - DNA, 50 bp, homo sapien
taattactcctgcactaacctgttawctttctatatgaaaaaatatttaa

SEQ ID NO: 106287 - DNA, 50 bp, homo sapien
ctgcctggactccaggtagggtgaaratacaatggcttataaaacactgg

SEQ ID NO: 106288 - DNA, 50 bp, homo sapien
tgggattctactagcctgagaaatargtgggttttgactgacagtttgaa

SEQ ID NO: 106289 - DNA, 50 bp, homo sapien
ctttggaacttttacactacataaasagggaagaattaataagtcatctg

SEQ ID NO: 106290 - DNA, 50 bp, homo sapien
caaaacaaaaacaaactcatttttaraattctgttatattatttgcttct

SEQ ID NO: 106291 - DNA, 50 bp, homo sapien
ctgtcctgcaccccagggtctgagtyaaagcaatgaaagcatgtgatttc

SEQ ID NO: 106292 - DNA, 50 bp, homo sapien
aagagtgcaatttatttgaaatagakgcagaattttttcaatgctgagta

SEQ ID NO: 106293 - DNA, 50 bp, homo sapien
gtggctatattcctgttacatttacyatgttcctaagagaggcaaaagat

SEQ ID NO: 106294 - DNA, 50 bp, homo sapien
cgttgcccctgttctatgctgggaawcttctatggaggcaaaaaagacat

SEQ ID NO: 106295 - DNA, 50 bp, homo sapien
tggacggtgtcccatctgctgaacayacattttaatacataaactctatt

SEQ ID NO: 106296 - DNA, 50 bp, homo sapien
acccaaattttcactgcgtgcacacygggctctgcaaattacataagtgg

SEQ ID NO: 106297 - DNA, 50 bp, homo sapien
acttgtcagttttatgatttctcatratgaattcccttaagtgatattta

SEQ ID NO: 106298 - DNA, 50 bp, homo sapien
cagagtcttgcaacatatgtaatatyagtagcaatccatgtgcaattctg

SEQ ID NO: 106299 - DNA, 50 bp, homo sapien
aaagacaatgccttggaagtaataasaaaccagaaacaggttagtcctca

SEQ ID NO: 106300 - DNA, 50 bp, homo sapien
acttttctgtgattattttttgctayatatccattgaaacaaatcaatca

SEQ ID NO: 106301 - DNA, 50 bp, homo sapien
ttatacttgtgaacttcacatccacragctaatggaataaaaattatttg

SEQ ID NO: 106302 - DNA, 50 bp, homo sapien
acatgaaagttgctattatacactaygtgctttcatgaaaatttagagta

SEQ ID NO: 106303 - DNA, 50 bp, homo sapien
atgtgatctaatggggctactgtaartgtattttgggaggtaagcttgat

SEQ ID NO: 106304 - DNA, 50 bp, homo sapien
atagtatatgtgaattatatgacacrgagtccaattatccttctccactc

SEQ ID NO: 106305 - DNA, 50 bp, homo sapien
tgggatctgctagcttcagttagaakatgccatactgtgtgtcttcctca

SEQ ID NO: 106306 - DNA, 50 bp, homo sapien
gcagcagatttaaaactttctggacyatgacttagtttaagaattccatt

SEQ ID NO: 106307 - DNA, 50 bp, homo sapien
gaaactccaatatatccagccacatratagcataaaacttctaacagtga

SEQ ID NO: 106308 - DNA, 50 bp, homo sapien
tggctggccaggtttatcaaggtgartatgtggaaaagagccagagagct

SEQ ID NO: 106309 - DNA, 50 bp, homo sapien
taacagtatgagctaccgaaacttaygtggaaactacatacagaataaag

SEQ ID NO: 106310 - DNA, 50 bp, homo sapien
ttactttaaaccatggaaaaagggcytgacaaatgatgcccttctagaag

SEQ ID NO: 106311 - DNA, 50 bp, homo sapien
tgggaggataaaacaaagagtttgcmgtttgctccttacccaaggtcccc

SEQ ID NO: 106312 - DNA, 50 bp, homo sapien
ctagctcccaaagaagccttctccaygagcattgcaaccaagagagaagc

SEQ ID NO: 106313 - DNA, 50 bp, homo sapien
gaaattaaaagagtctaagagataaytcattctccaaattagtaactcaa

SEQ ID NO: 106314 - DNA, 50 bp, homo sapien
gccctcattagtaaatggggatagcrattccttctttgttgcgttgttgg

SEQ ID NO: 106315 - DNA, 50 bp, homo sapien
aagccacaaagcacaatgcaagttcrataatcactggaaataatatgcct

SEQ ID NO: 106316 - DNA, 50 bp, homo sapien
aaggtagaaaggaggaaaaaggttaygttcacaatgtgaccctacattga

SEQ ID NO: 106317 - DNA, 50 bp, homo sapien
atgctgagaaactgctaaagaaggarcatgttaagaagtagagctcagat

SEQ ID NO: 106318 - DNA, 50 bp, homo sapien
gttatgaaactctggacattatagayagataacagtataccatcagtttt

SEQ ID NO: 106319 - DNA, 50 bp, homo sapien
atgcagattgacagcccttttaataygaaataaatcaggcaggagaagga

SEQ ID NO: 106320 - DNA, 50 bp, homo sapien
attaagttccctattatccacatgcmataaccactattctcattttggag

SEQ ID NO: 106321 - DNA, 50 bp, homo sapien
aggctttgattctccaaaaatattayctcatttcatgaaggtgatactct

SEQ ID NO: 106322 - DNA, 50 bp, homo sapien
aagtttgcctattcatccattatccyatcttcaaggaccagaaccaagga

SEQ ID NO: 106323 - DNA, 50 bp, homo sapien
ggaccaacatcttgactcagagtgaraattcttaggaataacaacagtct

SEQ ID NO: 106324 - DNA, 50 bp, homo sapien
ccagctgcctctactggcctagcccraggaccctcaaactgagcaggtcc

SEQ ID NO: 106325 - DNA, 50 bp, homo sapien
tcccttatctgtaatgccgaatttaygaacagctgtggtatgctctctgt

SEQ ID NO: 106326 - DNA, 50 bp, homo sapien
ataaatgaagaaacgagcttccttgmacaaggttacacaatttgtaacca

SEQ ID NO: 106327 - DNA, 50 bp, homo sapien
aagggtggattttgtttgctccaatraggtagtttcttcagggtaaaatt

SEQ ID NO: 106328 - DNA, 50 bp, homo sapien
gtatggacaagatctgagagtgaaartaaaagggtgtatgtgcgtgtgtg

SEQ ID NO: 106329 - DNA, 50 bp, homo sapien
cgtctctggggacagaagttcgacascgggaaacataccatgagagctgg

SEQ ID NO: 106330 - DNA, 50 bp, homo sapien
attaaggcttctgtctctatgctaayggtacagtacttttctgaaaaaaa

SEQ ID NO: 106331 - DNA, 50 bp, homo sapien
aaaaagttattaaaacatagaaaggwacatgtggagaacatctttataaa

SEQ ID NO: 106332 - DNA, 50 bp, homo sapien
tatcttatcttacctccttgaatacscacgtagtttactatggcacacat

SEQ ID NO: 106333 - DNA, 50 bp, homo sapien
gagtggctgactccaaagcttggacyctttccagtgtcagaaactgagta

SEQ ID NO: 106334 - DNA, 50 bp, homo sapien
atgggaaagatggaagcaaatcgaartaatgaagagggaggtggttttct

SEQ ID NO: 106335 - DNA, 50 bp, homo sapien
agctggaagtagcctttgtggtattkaaacgagcctctacagactaatgc

SEQ ID NO: 106336 - DNA, 50 bp, homo sapien
gtgaccttctccaccagccgatggarcttaaaggatgccaggtccttccc

SEQ ID NO: 106337 - DNA, 50 bp, homo sapien
attactgatttttcagttgctgtaayagatgtaaatgatgtaacaagtat

SEQ ID NO: 106338 - DNA, 50 bp, homo sapien
ttagtgttcagtttcgccctgccaamggtgcaagtattaggtgatcgtta

SEQ ID NO: 106339 - DNA, 50 bp, homo sapien
ccctctagctaatatctgacaggaayggtccaaggattctgactgcaatt

SEQ ID NO: 106340 - DNA, 50 bp, homo sapien
taagactaataaacatttttcatcayagtcttatcttgtgcatgccagat

SEQ ID NO: 106341 - DNA, 50 bp, homo sapien
tggatcaatgcacatgaacttttccmggcttttgatccatctccaacttt

SEQ ID NO: 106342 - DNA, 50 bp, homo sapien
aagcttaacaatcaacgtagagataygactgaatagaagcaattcactga

SEQ ID NO: 106343 - DNA, 50 bp, homo sapien
atcgctcccgccgttgggacagacartagtacttttgggacagacaacag

SEQ ID NO: 106344 - DNA, 50 bp, homo sapien
aggtcctcatagttgatggtttaccyactgatttgaacaaacgaactgtt

SEQ ID NO: 106345 - DNA, 50 bp, homo sapien
ttctctgaaaagtctgacagagcgarctttacctctttctattcctccat

SEQ ID NO: 106346 - DNA, 50 bp, homo sapien
gtacaaaaaatatttgagggctatcrctgatttaatcatttgcatttgtg

SEQ ID NO: 106347 - DNA, 50 bp, homo sapien
taaaacaacgcacattttatttcacrattctgcagattagaagtctgaca

SEQ ID NO: 106348 - DNA, 50 bp, homo sapien
cactcctgtgatgccatgcattaaayacagggctatagttgaagttgctc

SEQ ID NO: 106349 - DNA, 50 bp, homo sapien
taggggttaattcaataatgcatgayaaatggcctgtaaacttgattgag

SEQ ID NO: 106350 - DNA, 50 bp, homo sapien
gagcacctcttccagcaaacacactstcttgacccgaggtgaggacatgc

SEQ ID NO: 106351 - DNA, 50 bp, homo sapien
tgtgtaatcagagagagtatttggaraacgtaagagcaaaaggctttcta

SEQ ID NO: 106352 - DNA, 50 bp, homo sapien
ctgaggagagcttccgatgcaaaatragaggaaaagaaggcagtggggta

SEQ ID NO: 106353 - DNA, 50 bp, homo sapien
tattagccgattaaatggaatatctraagtgattcttgggataaagcttg

SEQ ID NO: 106354 - DNA, 50 bp, homo sapien
ctcttgacattcagaagacttctaayatgctgtagaccatgcaaaatttc

SEQ ID NO: 106355 - DNA, 50 bp, homo sapien
cttatttttgctaaagtggtccacgkacaaaaaatatttgagggctatcg

SEQ ID NO: 106356 - DNA, 50 bp, homo sapien
tggcctcccatatcatatttctttawgcgatcattatcttcacagccagt

SEQ ID NO: 106357 - DNA, 50 bp, homo sapien
ggctggagacaaaacgatttgttcakccaaacctatctggctaccagctg

SEQ ID NO: 106358 - DNA, 50 bp, homo sapien
gtacatggaatgtatgttcaaatacygtatacatgatcctacccaggccg

SEQ ID NO: 106359 - DNA, 50 bp, homo sapien
attcatttaactctcagaagcttaartgctgttaaatcacatttcctgtt

SEQ ID NO: 106360 - DNA, 50 bp, homo sapien
aaaagcagtttaatacttgacatttkaagaaactaggctggcaaaactta

SEQ ID NO: 106361 - DNA, 50 bp, homo sapien
gtagacaaaaatgccttgttgccttraaccttatactttagcccttttta

SEQ ID NO: 106362 - DNA, 50 bp, homo sapien
ctggcagtctaggaagagccctgcawaggtcttaggttttctcttgagga

SEQ ID NO: 106363 - DNA, 50 bp, homo sapien
cttaaaattcagtatattcagactaycttgtggagatgtacagacataag

SEQ ID NO: 106364 - DNA, 50 bp, homo sapien
ctgtttggttcattcacataaagtayctaaaataaagacaggagtgccaa

SEQ ID NO: 106365 - DNA, 50 bp, homo sapien
tgagtgcgacaattcaaagtacaaaygaatagaataggagcactgtaact

SEQ ID NO: 106366 - DNA, 50 bp, homo sapien
taagcttgtctcttgttaattgatayaaaattttcttgttcatggggcct

SEQ ID NO: 106367 - DNA, 50 bp, homo sapien
agaaccactgctttagaaatgtaacrcgggaatgtagaagacagactgaa

SEQ ID NO: 106368 - DNA, 50 bp, homo sapien
atttactctgctacataaaattctamagatggaattgtgtactatgctct

SEQ ID NO: 106369 - DNA, 50 bp, homo sapien
atagttttatgaatagccaataaatyagttacggatgcatagggaaatcc

SEQ ID NO: 106370 - DNA, 50 bp, homo sapien
tctataatcatttcttgaaaccaaasaggtcattatcgtcaactacatct

SEQ ID NO: 106371 - DNA, 50 bp, homo sapien
ggatcaaatgctgctaatggtctatsaagagtggaatagaaaccagcaac

SEQ ID NO: 106372 - DNA, 50 bp, homo sapien
tattttgtttagttctttgtgaacartaaagctcttggtgacacggaaat

SEQ ID NO: 106373 - DNA, 50 bp, homo sapien
agactgtcacacacaattcctcatayagctgataaaataaaacttagctc

SEQ ID NO: 106374 - DNA, 50 bp, homo sapien
gatccctattgcaagctattcatcarctaagaatgtatctgttcttgaga

SEQ ID NO: 106375 - DNA, 50 bp, homo sapien
tgccccctcccagcctttatgtgcayggtagcagtgtgtaatctttctaa

SEQ ID NO: 106376 - DNA, 50 bp, homo sapien
ttttaaagtcaagatggtaactgacracctgtacttcacattataaatag

SEQ ID NO: 106377 - DNA, 50 bp, homo sapien
agtcccttaagttttggtttcctcaygaataaactctgggtatacttaat

SEQ ID NO: 106378 - DNA, 50 bp, homo sapien
agacattttaggtagaggattttcartattattgcaggagactaatacat

SEQ ID NO: 106379 - DNA, 50 bp, homo sapien
taagaatgaccaattcaggatattawattagggtgttgttagtgtctaat

SEQ ID NO: 106380 - DNA, 50 bp, homo sapien
tgcattttactatatcctttactatyctcttagtcttctttgcatatata

SEQ ID NO: 106381 - DNA, 50 bp, homo sapien
gggctgttgactgaagatccacatcrctctcctaattggatgcttctaga

SEQ ID NO: 106382 - DNA, 50 bp, homo sapien
gcatgtaagatgtggcccacatatgraaattcaaatgcacttttcactga

SEQ ID NO: 106383 - DNA, 50 bp, homo sapien
tctaagttctagatttgtgcactcaytatagttcttttagtgctgttggg

SEQ ID NO: 106384 - DNA, 50 bp, homo sapien
tctcgtaacttcaaagagtctcaaamgtgtcaagatcctaagacaggaaa

SEQ ID NO: 106385 - DNA, 50 bp, homo sapien
tatttgtattcagtttgtttcaaacygagcaaaacagtgcaacttttact

SEQ ID NO: 106386 - DNA, 50 bp, homo sapien
gggttataatcaattactagcattaygcattttgatgctcaaattgttcc

SEQ ID NO: 106387 - DNA, 50 bp, homo sapien
attcccactgtgacagaaagctctaygggacagtgttgcctgcaatataa

SEQ ID NO: 106388 - DNA, 50 bp, homo sapien
tctaatcctagaagatagtttccatyaatcacaataggttatctatctag

SEQ ID NO: 106389 - DNA, 50 bp, homo sapien
ggaacaggattgggggaaatctgatraaaaaatcactgagcatgtatttg

SEQ ID NO: 106390 - DNA, 50 bp, homo sapien
atttcatgtttgagttactatgtaawgcttaaagaaaaaaaaaatcacct

SEQ ID NO: 106391 - DNA, 50 bp, homo sapien
atagtagtttccattgtaataaatgyggacagactaggtattttggggac

SEQ ID NO: 106392 - DNA, 50 bp, homo sapien
ctgggcagattggtcacaccaagaaygaaagggacgatatttttcttccc

SEQ ID NO: 106393 - DNA, 50 bp, homo sapien
aactgttccagtgaacttcaagacaygggtaccataaatataagctggtc

SEQ ID NO: 106394 - DNA, 50 bp, homo sapien
agtaaaaagctctttcctctcaaaasgtcattaatactctaaagtagtga

SEQ ID NO: 106395 - DNA, 50 bp, homo sapien
tctgtcattcaggagttaatgtaaayatgtctgaatccatctgtagtttc

SEQ ID NO: 106396 - DNA, 50 bp, homo sapien
tttattctttttattgagaagagttwggaaataaagttacttagaccttt

SEQ ID NO: 106397 - DNA, 50 bp, homo sapien
aaaagcctctgctgagatctagtgamcgccagaaaacagattttagcaag

SEQ ID NO: 106398 - DNA, 50 bp, homo sapien
aaaaatgtttctccctcaaatggaartgcctcctggagaccaaagttccc

SEQ ID NO: 106399 - DNA, 50 bp, homo sapien
ttcttgaacaaatagatgggaattamagccagaactagaaaccagttttc

SEQ ID NO: 106400 - DNA, 50 bp, homo sapien
ggactattcttatcctccctttcaasttaaactataaactaaattccttc

SEQ ID NO: 106401 - DNA, 50 bp, homo sapien
ggaagggctacatttcttttcaactrtgtgtttaaatctggaatcaagat

SEQ ID NO: 106402 - DNA, 50 bp, homo sapien
cctctggccatataactcctgagcargaaaggattataaaaactgtgctt

SEQ ID NO: 106403 - DNA, 50 bp, homo sapien
ctaagtcaattttcctaagacttcaratagattgtatcctggcaagctct

SEQ ID NO: 106404 - DNA, 50 bp, homo sapien
ccctgctgtggtcttttatcaacccrctcataaccccaaggtgtccccaa

SEQ ID NO: 106405 - DNA, 50 bp, homo sapien
aaaatttttttagcataaagaataaycagttagagtaaacatatttagtt

SEQ ID NO: 106406 - DNA, 50 bp, homo sapien
ggagatctgggctgagagttgttcartctaacacagaagagaagtaagtg

SEQ ID NO: 106407 - DNA, 50 bp, homo sapien
ggttcaattgaggtcctttgattgcrctgctatatattttttccatgcat

SEQ ID NO: 106408 - DNA, 50 bp, homo sapien
tcatacaactagtaagtgacctacaytggagtcctgaatccaaatcccgt

SEQ ID NO: 106409 - DNA, 50 bp, homo sapien
ttttggttttgtagggggaaatggcrcatttagacagtggtctcgggaac

SEQ ID NO: 106410 - DNA, 50 bp, homo sapien
ttcttatcttaagggtatatcttagrcatttcaattagacaaatatttct

SEQ ID NO: 106411 - DNA, 50 bp, homo sapien
ctttatgtaggtttaccttttccacrgaggtatggcagcacttccattca

SEQ ID NO: 106412 - DNA, 50 bp, homo sapien
aacaaaatgagttagatttgctggawtatttacctttcaaacttctaagt

SEQ ID NO: 106413 - DNA, 50 bp, homo sapien
aaagtagggaatttgtgcagaaaatygtaagtagctgaatttagaacaaa

SEQ ID NO: 106414 - DNA, 50 bp, homo sapien
ataggtgcccagtaaacaatggctaygttgatgtataaatgaggcctctc

SEQ ID NO: 106415 - DNA, 50 bp, homo sapien
aagaatatattattaaatggcttaaygaaagaatgaagagaaaatacaaa

SEQ ID NO: 106416 - DNA, 50 bp, homo sapien
ttaaattcagttgctatgaaacccarctggtatgaaacacaggcgattac

SEQ ID NO: 106417 - DNA, 50 bp, homo sapien
caaagtaagcttcacgtgagcccagracacaactgcagttcagatagtgg

SEQ ID NO: 106418 - DNA, 50 bp, homo sapien
gtatgttattcacgaattcagtgaaraccttgggaggaatgggttagcaa

SEQ ID NO: 106419 - DNA, 50 bp, homo sapien
aattttttgcatttttagtaaagccragttttcatcatgttggccaggat

SEQ ID NO: 106420 - DNA, 50 bp, homo sapien
tactaattttaagacgaaggcaatayggctaagtttacacacatacacag

SEQ ID NO: 106421 - DNA, 50 bp, homo sapien
gaggcgactcccagagatgatttgarcagccatgccaattagccatgacc

SEQ ID NO: 106422 - DNA, 50 bp, homo sapien
aactgatttactagttaggatactaygcagaagaggaatccttactagtt

SEQ ID NO: 106423 - DNA, 50 bp, homo sapien
cgagttgtgatttttcagtagcgtckccattgtcatttacctatggctgc

SEQ ID NO: 106424 - DNA, 50 bp, homo sapien
taaggcctaagggttcctgacctgcmataaagggtctaggtctctgggaa

SEQ ID NO: 106425 - DNA, 50 bp, homo sapien
catggttttgctccaagcaagctctygtattccaggcatatcttttcaat

SEQ ID NO: 106426 - DNA, 50 bp, homo sapien
gagcagatagttcatttttatcaccrcttttgttatctgagtcccagtcc

SEQ ID NO: 106427 - DNA, 50 bp, homo sapien
ctcaggccatagtgtattaaggataygtttataaatttcaaagtttcact

SEQ ID NO: 106428 - DNA, 50 bp, homo sapien
tgaataacagagtctttgtccttacrgagtttgtggtctagttagggaga

SEQ ID NO: 106429 - DNA, 50 bp, homo sapien
gagttgaactaagcagaataaaacawctttaccacaataataattgcaac

SEQ ID NO: 106430 - DNA, 50 bp, homo sapien
gagtattttttaaaataacttagtakgaatgatgtcaaaatcacttgttt

SEQ ID NO: 106431 - DNA, 50 bp, homo sapien
agtagttagctacccagagaaatcartactaggtacaactgcatgattga

SEQ ID NO: 106432 - DNA, 50 bp, homo sapien
aacctacctacctgttcttttatagyagagagcgtatgcttaaaaaaaat

SEQ ID NO: 106433 - DNA, 50 bp, homo sapien
cactttaacttcattacctttgtgargaccgtatctccaagatggtcata

SEQ ID NO: 106434 - DNA, 50 bp, homo sapien
cttaagacctctgcactccagtatakgaatttattttttagtttatcttt

SEQ ID NO: 106435 - DNA, 50 bp, homo sapien
gctcctttggcaagagcaaaaaggaygcgaagaagagaggaaagaagtct

SEQ ID NO: 106436 - DNA, 50 bp, homo sapien
accagctcagcacttgagtctcggargcaactttgccagcaaatgagaat

SEQ ID NO: 106437 - DNA, 50 bp, homo sapien
agcttcctttgtttatctgatggaarccttggaatctctcctgttaggta

SEQ ID NO: 106438 - DNA, 50 bp, homo sapien
tgtccatcttatcaatatttttcaayacccatggattccttatgtgtgtg

SEQ ID NO: 106439 - DNA, 50 bp, homo sapien
tccaacttttctctcagcatacatasgattcatttatttatgttggttct

SEQ ID NO: 106440 - DNA, 50 bp, homo sapien
caggagagcctgttatacaataatcyaatctgctaaagtcatcattaaaa

SEQ ID NO: 106441 - DNA, 50 bp, homo sapien
caaaagaccagtggacttccttaaamtggtcaaatggagccccctaaaca

SEQ ID NO: 106442 - DNA, 50 bp, homo sapien
caattgcacaattagatcatagaaayggatgtatttttactttagcaaaa

SEQ ID NO: 106443 - DNA, 50 bp, homo sapien
aatgattgtaataagatatttcctcyacaatcatttttacacagtgaatt

SEQ ID NO: 106444 - DNA, 50 bp, homo sapien
ctccaactgttctggaaccataggarcatgtaaaactagtctaaagttta

SEQ ID NO: 106445 - DNA, 50 bp, homo sapien
ataattggccaacttgctactgccayggaaagaaatagtatgtggggaag

SEQ ID NO: 106446 - DNA, 50 bp, homo sapien
tattgtgaaatcacagaagtgttaasagccagttccttttttgatcatat

SEQ ID NO: 106447 - DNA, 50 bp, homo sapien
cagtgtcttcatctttgaaacagaarcagtagtgccactttcccagtgtt

SEQ ID NO: 106448 - DNA, 50 bp, homo sapien
gtcacaaggcagaagtggtcaaaagyagaatttaaaagaaccaaaacaaa

SEQ ID NO: 106449 - DNA, 50 bp, homo sapien
ttaagagttaccatctgtccagtaawtgaaagttgtccggtttaatcata

SEQ ID NO: 106450 - DNA, 50 bp, homo sapien
atgtgaccttgtgcataaaaataaayggttgagccacatgactcaggatt

SEQ ID NO: 106451 - DNA, 50 bp, homo sapien
gagatatgtgacctttcagagagagrgtattcaaaatagctgtgttgagg

SEQ ID NO: 106452 - DNA, 50 bp, homo sapien
cgtcattttaacaggaaagaggcaaygtagagtttcaaaagcagggggat

SEQ ID NO: 106453 - DNA, 50 bp, homo sapien
cttttgtaacacaacacatagtagarcagttgctagagggactgtatggc

SEQ ID NO: 106454 - DNA, 50 bp, homo sapien
atagcagaacagtttagattcatagracacagtttgcagaccccaagtga

SEQ ID NO: 106455 - DNA, 50 bp, homo sapien
aaattccaagatgaagaaaatgtcargattttaaatatggaccagacact

SEQ ID NO: 106456 - DNA, 50 bp, homo sapien
tgggaaaaaaacaggcctagtggaaygcatgagcgagtaatcaaggtagc

SEQ ID NO: 106457 - DNA, 50 bp, homo sapien
aaacaatataagtaaactacttatgragattatagtgtactcccagggtg

SEQ ID NO: 106458 - DNA, 50 bp, homo sapien
aaactttacagttagcatttcatcaycttttcagtgcagtttgacatcct

SEQ ID NO: 106459 - DNA, 50 bp, homo sapien
tgtcggtttccctcaaacgacaccasaagcttaggagacaagaggtgata

SEQ ID NO: 106460 - DNA, 50 bp, homo sapien
aaaaagtgtttatttcattgccaaartaagtggtatttatatttcataaa

SEQ ID NO: 106461 - DNA, 50 bp, homo sapien
cttttgtctaagcaatgtgctgtaayatactcactaaatattcctcatca

SEQ ID NO: 106462 - DNA, 50 bp, homo sapien
gtgcttcaccctggcttgactttaaytgggctttttctcctcttccctgc

SEQ ID NO: 106463 - DNA, 50 bp, homo sapien
agccaccacctcatacaaactctcayaacagccatgacgacaggagttac

SEQ ID NO: 106464 - DNA, 50 bp, homo sapien
tctttactgattcttttattctctayattctgtaatcattggcatttggt

SEQ ID NO: 106465 - DNA, 50 bp, homo sapien
catcacaacaaccctaggaagcatgmactataatttccattttacaaagg

SEQ ID NO: 106466 - DNA, 50 bp, homo sapien
ttaataccagttacaattatgcaaamgcactataaattactcaaattatt

SEQ ID NO: 106467 - DNA, 50 bp, homo sapien
ccctttatatgtcctaaccctctcartaagtcatatttaacactttctgg

SEQ ID NO: 106468 - DNA, 50 bp, homo sapien
atccatatttattgcaaaagcaacartatcaaagaatgctttaaaatgca

SEQ ID NO: 106469 - DNA, 50 bp, homo sapien
ttaatatagataaactataagtaatragattgttttcattataatatagg

SEQ ID NO: 106470 - DNA, 50 bp, homo sapien
tcattttactcagattttccttaacrgatgactgctactcacctgagttc

SEQ ID NO: 106471 - DNA, 50 bp, homo sapien
gaaatgcaattataaaacattatcartctcctcggaatcattcagtaaac

SEQ ID NO: 106472 - DNA, 50 bp, homo sapien
tctcaacacaaagtttcttgctagayaatatcatgtgtcaaaagtcagca

SEQ ID NO: 106473 - DNA, 50 bp, homo sapien
ctccaatgaccttgctcaaggggaaragcttgtatcatgatgataataaa

SEQ ID NO: 106474 - DNA, 50 bp, homo sapien
acataatctttcaaaactaacattcyaaggatggttccaatttcatgaat

SEQ ID NO: 106475 - DNA, 50 bp, homo sapien
acactaacatttacacatgaatttamaaaaatcacagacccctgaaacta

SEQ ID NO: 106476 - DNA, 50 bp, homo sapien
agaagtttctctgtcagtcaaaaggycctaagaggaaagtggggtttttt

SEQ ID NO: 106477 - DNA, 50 bp, homo sapien
agaattacttctggacatcgacctgracccactactaaccatcctttttc

SEQ ID NO: 106478 - DNA, 32 bp, homo sapien
aacacaatacaaaagaytagccaaatgaaaag

SEQ ID NO: 106479 - DNA, 50 bp, homo sapien
gggaaacatgcatttaatttggagastcccactgatctttcatatacagt

SEQ ID NO: 106480 - DNA, 50 bp, homo sapien
taatagaaggctattttgtctacatyaacaatcatttgcttagaacagcc

SEQ ID NO: 106481 - DNA, 50 bp, homo sapien
tatcacactgttcaaaggtatccagyacttaagttccacacagaattttg

SEQ ID NO: 106482 - DNA, 50 bp, homo sapien
tacctgttttaactgtgaactctgaygatgtatacaacttccaaagagcc

SEQ ID NO: 106483 - DNA, 50 bp, homo sapien
cctttcctattttatgggattgctaygttcaaacagataaagctgaaaac

SEQ ID NO: 106484 - DNA, 50 bp, homo sapien
atagggtagaatattatatagtcatraaaaaatacctgtatcaaaaaata

SEQ ID NO: 106485 - DNA, 50 bp, homo sapien
agtttgttctgtttttactaaagcaygtaggaacagggattatgtaaccg

SEQ ID NO: 106486 - DNA, 50 bp, homo sapien
ttcacagcaaccctgagagataggcragggtaaggtttccatctaatgtg

SEQ ID NO: 106487 - DNA, 50 bp, homo sapien
ttgaagactggttaatgaataatccrcaggaaaatgaacctgtatcagta

SEQ ID NO: 106488 - DNA, 50 bp, homo sapien
catacacaactagtcaagtctattayagtttttgcattgacatctgcagt

SEQ ID NO: 106489 - DNA, 50 bp, homo sapien
gattccccatctacttccaagtcctrtcttcttttcacttcattcttcaa

SEQ ID NO: 106490 - DNA, 50 bp, homo sapien
actgatcgttggcatcgtacatatcmatagaggaacaaagcttgctattt

SEQ ID NO: 106491 - DNA, 50 bp, homo sapien
tattttctagactattttgttaacartctggatcaaacagatgtcagtat

SEQ ID NO: 106492 - DNA, 50 bp, homo sapien
gcaggactggatgatcacagagaccmaataggatccagacccaacctcga

SEQ ID NO: 106493 - DNA, 50 bp, homo sapien
gatccagggtacccaaaccaatgtgraatgtatagttcagatgatccagc

SEQ ID NO: 106494 - DNA, 50 bp, homo sapien
aactgttaaattgtaaatgttgacayatgaatgcctgttttggtttggat

SEQ ID NO: 106495 - DNA, 50 bp, homo sapien
tctaaaaccaagaaggacagtcatcrcgttttaaagctccaaaataatcc

SEQ ID NO: 106496 - DNA, 50 bp, homo sapien
aggaatcaggcctatgtagaaaatayaggtaagaaaattaaggagaaccg

SEQ ID NO: 106497 - DNA, 50 bp, homo sapien
agttaattatcttttctcacacttaygggttatttgcactgtttttcttt

SEQ ID NO: 106498 - DNA, 50 bp, homo sapien
gctagggaatgggtgctctgattaastgggatcttctggttaatagaggt

SEQ ID NO: 106499 - DNA, 50 bp, homo sapien
agaactcaacttcactgtgtcataamttagattttcctcacactgaatta

SEQ ID NO: 106500 - DNA, 50 bp, homo sapien
tttataatgtacagcaaagtatatasgataagactacagaccataggagc

SEQ ID NO: 106501 - DNA, 50 bp, homo sapien
cttaaaacatgggtataccaaaagaytacaagcaaaaggataggaaaaga

SEQ ID NO: 106502 - DNA, 50 bp, homo sapien
gagcaagggaaggagataatctgacrctcattttaaaaaattcattctgt

SEQ ID NO: 106503 - DNA, 50 bp, homo sapien
cccctgccttgctctcaacactcacracatcactgtgcacattctattca

SEQ ID NO: 106504 - DNA, 50 bp, homo sapien
atagaaataagaacagtacagataarctagtgcaaaagtatttagaaata

SEQ ID NO: 106505 - DNA, 50 bp, homo sapien
ctattagaagcccatgaaatagatayacaaagcctgtggcacgctacctg

SEQ ID NO: 106506 - DNA, 50 bp, homo sapien
acatagattaagttcttcatcatgcrccaggtagcgtgccacaggctttg

SEQ ID NO: 106507 - DNA, 50 bp, homo sapien
cctccctgaagtgtctacttggaggrccaaactttaaaccaatgcatttt

SEQ ID NO: 106508 - DNA, 50 bp, homo sapien
ttactgtttcaacctcccaacttgasctgcaaatttctctacatcggtat

SEQ ID NO: 106509 - DNA, 50 bp, homo sapien
ttctcccaaacatatggtctactggyggtatcctttcctgttccccaagg

SEQ ID NO: 106510 - DNA, 50 bp, homo sapien
agggctccacctgtcttggagccaaycaaatagtgaagacagagagacct

SEQ ID NO: 106511 - DNA, 50 bp, homo sapien
aatgttttttgctgaacaaaatgtaygccaaactaagctctgacttcggg

SEQ ID NO: 106512 - DNA, 50 bp, homo sapien
tgagtagaacaacatacacaaaaacrctctgggcactgtgatgagaaaat

SEQ ID NO: 106513 - DNA, 50 bp, homo sapien
ggcctgcctcggtgcatggggctgcragatgagagactcctgagtcaggg

SEQ ID NO: 106514 - DNA, 50 bp, homo sapien
ttcataataaaagtgaaattggttawctctgtctgggtgggttgagtgat

SEQ ID NO: 106515 - DNA, 50 bp, homo sapien
gtatcctccttaaaataggttgagamatgaagcacttcaataaagtcact

SEQ ID NO: 106516 - DNA, 50 bp, homo sapien
aaacagaatcttactgattaagttayattatacgtccacactgtatcttg

SEQ ID NO: 106517 - DNA, 50 bp, homo sapien
tttgatgtaacacccttctattaagsacgctatcttgcaatgttttttgt

SEQ ID NO: 106518 - DNA, 50 bp, homo sapien
ataaatgtttgtttctcacttatatsaccgttcaatgaggattggtggta

SEQ ID NO: 106519 - DNA, 50 bp, homo sapien
caaaagacaattaacagatgacaacwctaagattatatggaagttaacat

SEQ ID NO: 106520 - DNA, 50 bp, homo sapien
gcaggacataaatgcctacctcaaargtattgtaggaatgaaacggaaca

SEQ ID NO: 106521 - DNA, 50 bp, homo sapien
aaatacaaagaccaaacatggactasctttcagtttacctctctcacacc

SEQ ID NO: 106522 - DNA, 50 bp, homo sapien
ttaattttgaattaaattgtcacatwatcagtcaaatagctgtgttccct

SEQ ID NO: 106523 - DNA, 50 bp, homo sapien
gcctgtagctttgcctattaatttaygacccagcagagttaaacagttaa

SEQ ID NO: 106524 - DNA, 50 bp, homo sapien
atctagagaagtagcatatggaaaaytataatgtgtcttttttacaatga

SEQ ID NO: 106525 - DNA, 50 bp, homo sapien
ggaggattgttggccacaccactctygtaaaagtattcctgctaagacca

SEQ ID NO: 106526 - DNA, 50 bp, homo sapien
gagacagagtgagacatgcacatacrcagagaaggaaagatgaataaaga

SEQ ID NO: 106527 - DNA, 50 bp, homo sapien
taatctgtgcaaaaccaaagagtgartaatacatataccaggctacataa

SEQ ID NO: 106528 - DNA, 50 bp, homo sapien
aaccagtgggagtctttggtccttarggaatttgctgctaatgctgcttt

SEQ ID NO: 106529 - DNA, 50 bp, homo sapien
tgaaataatgaacaattaaatgatcrcttttatcagaaacaaaaatttca

SEQ ID NO: 106530 - DNA, 50 bp, homo sapien
aatgcaataacacacagtccctagawaatgatgacatgctgtctctatgc

SEQ ID NO: 106531 - DNA, 50 bp, homo sapien
tatctcgtggtcatgttggggccttraaactacttctggccaatgaactc

SEQ ID NO: 106532 - DNA, 50 bp, homo sapien
taatgaatagtcattttgtctttcayaattgcctagaaaccacttgactg

SEQ ID NO: 106533 - DNA, 50 bp, homo sapien
gccgtgtggacacagtgagtcaaatsaagttgtctcaagcccaaatattt

SEQ ID NO: 106534 - DNA, 50 bp, homo sapien
atcaaacctttcatataatccacaayggaatctggaattcaggtcataga

SEQ ID NO: 106535 - DNA, 50 bp, homo sapien
gcacatcagcagaggctggcaacagrttgtgaacatgccagtggaatcat

SEQ ID NO: 106536 - DNA, 50 bp, homo sapien
gaagatcgatttctttgttctgcctraattgtctcactaaagccaaagtc

SEQ ID NO: 106537 - DNA, 50 bp, homo sapien
caaatttgataaaatatgagcatcaraaaagatggactgttgtggtttgt

SEQ ID NO: 106538 - DNA, 50 bp, homo sapien
gtgagagcctgcttcctggttggcaytcattgctgtcggtgagttcagtt

SEQ ID NO: 106539 - DNA, 50 bp, homo sapien
agtcagcctgagtggaaagcactgaratgccctggctctgagattctcag

SEQ ID NO: 106540 - DNA, 50 bp, homo sapien
acaggcgggccttgaggacattccawctgttagacaataaatagtttgtt

SEQ ID NO: 106541 - DNA, 50 bp, homo sapien
acaccctcaaaaacctataaggccaygtgatttcacaggcgggccttgag

SEQ ID NO: 106542 - DNA, 50 bp, homo sapien
gttatttctaggtcttctttgataayatgtcaaggagttacatttgacat

SEQ ID NO: 106543 - DNA, 50 bp, homo sapien
ggctttatatagtgtatccactttcrcatgcccacatctctaaacttttt

SEQ ID NO: 106544 - DNA, 50 bp, homo sapien
ttgcattgggttagagtttataaacraagagttgataataggcgatatat

SEQ ID NO: 106545 - DNA, 50 bp, homo sapien
ccagaatgacgttccgggagagaacygagaggcatgagatgcagattctg

SEQ ID NO: 106546 - DNA, 50 bp, homo sapien
tttcaattctggagctctgcacatcsaaagagaattctgcacattcaaaa

SEQ ID NO: 106547 - DNA, 50 bp, homo sapien
ttctgctcttagacatgcttaactayctggcctctggtaacaaactggcc

SEQ ID NO: 106548 - DNA, 50 bp, homo sapien
cttatgaaatcaaatgactgcaagcractagctgtaaaagctaaacccct

SEQ ID NO: 106549 - DNA, 50 bp, homo sapien
agttgagtttggtggcttggagcaarcataaaggttttcaagtcacagtg

SEQ ID NO: 106550 - DNA, 50 bp, homo sapien
gtctgactgagaaccagctctttackccattctctgtcattcttacctct

SEQ ID NO: 106551 - DNA, 50 bp, homo sapien
attgctattgaattttgcctgggaaraagtcttggaagcacatagatttt

SEQ ID NO: 106552 - DNA, 50 bp, homo sapien
attcagaggaaaacaatcttctctcrgacttagctagaaaggaactcaga

SEQ ID NO: 106553 - DNA, 50 bp, homo sapien
gtatttgcttgattaaaatctcttakgctactctttgcagctgacctata

SEQ ID NO: 106554 - DNA, 50 bp, homo sapien
tgatcttctaagttttcagaaagcaktaccttttccataagcatctgttt

SEQ ID NO: 106555 - DNA, 50 bp, homo sapien
aattgctattgtcatatgaagtaaargaagttataaatacctctatatct

SEQ ID NO: 106556 - DNA, 50 bp, homo sapien
atttgctctcattagaaacagttacrattttaatatttggaatattgcgt

SEQ ID NO: 106557 - DNA, 50 bp, homo sapien
tggcttggtgtcttcaaaatgacacrgagggtatgatcttaaaaaaacag

SEQ ID NO: 106558 - DNA, 50 bp, homo sapien
ggcatccagtcaccaagatccaacargttacctgcctaagaaagatgatt

SEQ ID NO: 106559 - DNA, 50 bp, homo sapien
agacatgttgaagatattgcctccgratgcctagtatcacaacctggaag

SEQ ID NO: 106560 - DNA, 50 bp, homo sapien
ggatattataaacaaactttgtcaayaaatttggacactttgataaaatg

SEQ ID NO: 106561 - DNA, 50 bp, homo sapien
agctgaaatcatgcacaactgcagakaatcaagtcgggttaaacatacat

SEQ ID NO: 106562 - DNA, 50 bp, homo sapien
tcacagataactcagcttctcttacrgatttttcttcaggggaaggaatt

SEQ ID NO: 106563 - DNA, 50 bp, homo sapien
agctaataaaagtaaattctttcccracttgttcctacttcaaaagaaat

SEQ ID NO: 106564 - DNA, 50 bp, homo sapien
tgagctgtggtgtcttctaccatgayataaaaagcctcatgcagtccctc

SEQ ID NO: 106565 - DNA, 50 bp, homo sapien
ttgtatttgggaagttatagcaaagyaccattttagtagtgtgcaaaaca

SEQ ID NO: 106566 - DNA, 50 bp, homo sapien
attcctgggatcagagagcatgtgcygaacctctccatcacgctgcctct

SEQ ID NO: 106567 - DNA, 50 bp, homo sapien
tgctattctcacggccaagataaaaratcccaggccctggacacttactg

SEQ ID NO: 106568 - DNA, 50 bp, homo sapien
gacaaggtaaccagatcctgcatcaytgaacaacaaaggaaacattgatc

SEQ ID NO: 106569 - DNA, 50 bp, homo sapien
ttttagattattagaggttaaatagwcaagtattcccaaaatgtttaaag

SEQ ID NO: 106570 - DNA, 50 bp, homo sapien
atgggcagtagctctctgtgcgacartgtaatcagtgcaatggtgaagtg

SEQ ID NO: 106571 - DNA, 50 bp, homo sapien
agaactgacttttaagagaatattcrctcaacaactccccaaagtattca

SEQ ID NO: 106572 - DNA, 50 bp, homo sapien
ttaagtggaaaaggtcaataaacaaytggatgtatggatctagagcttgg

SEQ ID NO: 106573 - DNA, 50 bp, homo sapien
ttacagaaatatatgcattaataaartagaagtcctaatcccagtagctg

SEQ ID NO: 106574 - DNA, 50 bp, homo sapien
acactgtttactgtacttcaaagcayctttaatattaggaaacagctctg

SEQ ID NO: 106575 - DNA, 50 bp, homo sapien
gaagtctgcattatttctcctatcayacactttggtcccaagtattattg

SEQ ID NO: 106576 - DNA, 50 bp, homo sapien
attttaactttgtggaacatgactckgaattgggtagtagactggggctt

SEQ ID NO: 106577 - DNA, 50 bp, homo sapien
acactctgaaaccacttagaataaaygactcttagggtttgagccaaccc

SEQ ID NO: 106578 - DNA, 50 bp, homo sapien
tttgtacactttatttttgattaacrgtgagaaaaaatgcaatagtgtca

SEQ ID NO: 106579 - DNA, 50 bp, homo sapien
gaaaaggctctgcctccaatagtacrcttaatctacatcagaaagaatct

SEQ ID NO: 106580 - DNA, 50 bp, homo sapien
gtaccttactcttatatgtgatagaktagtgaagaatttaagacaaataa

SEQ ID NO: 106581 - DNA, 50 bp, homo sapien
tgcagtaataaaaagctgaacttagraactgtacatttacatgatggaag

SEQ ID NO: 106582 - DNA, 50 bp, homo sapien
agatgaagttggccaagtaagtagamgaaggattatcaagagctatgccc

SEQ ID NO: 106583 - DNA, 50 bp, homo sapien
aggctaggatagaaattgggatcatyaaaggagagaaaaaaagggaaaga

SEQ ID NO: 106584 - DNA, 50 bp, homo sapien
ctctcccacatgattagcactaagargaaaatgtagtagacattgggtaa

SEQ ID NO: 106585 - DNA, 50 bp, homo sapien
gggggtggggagagagaaaaaaaaaktgaggactgctgcctgccactctt

SEQ ID NO: 106586 - DNA, 50 bp, homo sapien
tatattttgcacccttgcttttagayattaattggcatttgttaaaactg

SEQ ID NO: 106587 - DNA, 50 bp, homo sapien
atagtgtattaggtaggacagcatartagagtacttacaatgaattatta

SEQ ID NO: 106588 - DNA, 50 bp, homo sapien
acaactataggactactgtgaagctscaacagtcccaacttagacatcaa

SEQ ID NO: 106589 - DNA, 50 bp, homo sapien
tattgagttactgtgacaattaaacragttgccattacgaaatcactcag

SEQ ID NO: 106590 - DNA, 50 bp, homo sapien
gatatgccttacctcatctttctacyatcaagctacagtggagacaatct

SEQ ID NO: 106591 - DNA, 50 bp, homo sapien
attgaacacatttaaagttgctttgmataagtaaatatgtgtaataaata

SEQ ID NO: 106592 - DNA, 50 bp, homo sapien
ataaaataaaatgcaataaaatggakaactgaagataagtttaaaaaact

SEQ ID NO: 106593 - DNA, 50 bp, homo sapien
agaaagaaagtactgtggtcagattwaaccatttggatgtgagcaaaaca

SEQ ID NO: 106594 - DNA, 50 bp, homo sapien
atgcatctcttgaatcagttgttgckctttggtattttttcagttgtcct

SEQ ID NO: 106595 - DNA, 50 bp, homo sapien
ctccacattttcttcccatagaactsacttattaaagctttacaaaaggc

SEQ ID NO: 106596 - DNA, 50 bp, homo sapien
gaatgctctgcattgagtagagtaartgctcaggatgactcaggctgttt

SEQ ID NO: 106597 - DNA, 50 bp, homo sapien
aggcaattctttaattgaaatagtcmaattatcacatttcagtgcacctg

SEQ ID NO: 106598 - DNA, 50 bp, homo sapien
actgtattactgtatatacaaggccrcaggtgcactgaaatgtgataatt

SEQ ID NO: 106599 - DNA, 50 bp, homo sapien
tttgtttccatcagcttcatgccaartatggagatgcgtgagatactatt

SEQ ID NO: 106600 - DNA, 50 bp, homo sapien
agctaagtcaataaatgttccccctraattgtagagtacatattcaatta

SEQ ID NO: 106601 - DNA, 50 bp, homo sapien
taagttgtaaactatagtcctatacyagaaattcgaatgcctagtctttt

SEQ ID NO: 106602 - DNA, 50 bp, homo sapien
gaagaatttctgaagtgttttaaatsaagatgagaattaagtttagacaa

SEQ ID NO: 106603 - DNA, 50 bp, homo sapien
gcttaacactaaaacagtagagacamgtaatcaagcatgaaatacacgtg

SEQ ID NO: 106604 - DNA, 50 bp, homo sapien
tgcaatcagggttcccattgcacatraagtaagagctcatgtgttttgtt

SEQ ID NO: 106605 - DNA, 50 bp, homo sapien
ataaccactgctaacctgtggcctargaagaaaggagcttgagggcagaa

SEQ ID NO: 106606 - DNA, 50 bp, homo sapien
ggctagagatggaccactattagaamagaaaacaaagaagaggtaataag

SEQ ID NO: 106607 - DNA, 50 bp, homo sapien
ggccatcagagacccaagaaccagayggtggaaaaaggagaagcagaagt

SEQ ID NO: 106608 - DNA, 50 bp, homo sapien
atcttctaaacttccaagaactaacrctccttaagacatgaaggagaaag

SEQ ID NO: 106609 - DNA, 50 bp, homo sapien
aaagaattgcatagcaaatatttacraagctcacatgatatgaccataat

SEQ ID NO: 106610 - DNA, 50 bp, homo sapien
gctgattctttctccaggtaagttamgttttggatgataacaggagagcc

SEQ ID NO: 106611 - DNA, 50 bp, homo sapien
tgtatggttaatataacatggaatcraggcgagtatgaaagcagttatag

SEQ ID NO: 106612 - DNA, 50 bp, homo sapien
taggctggaggttctcaagctaacasatgatgaaggagcaggaagccttt

SEQ ID NO: 106613 - DNA, 50 bp, homo sapien
aaagggtcagaggaattaaagggaaytgcaacatatgagggaaagaattg

SEQ ID NO: 106614 - DNA, 50 bp, homo sapien
tctccaattatggggcaccatattgrattaagagttatgtgtatttatta

SEQ ID NO: 106615 - DNA, 50 bp, homo sapien
tacccctgacctacttaactaaagaytctcaggggcggggcctagaagtc

SEQ ID NO: 106616 - DNA, 50 bp, homo sapien
ttgcctgttggcttcgaagtacccayagtacattgttggtggctggtgat

SEQ ID NO: 106617 - DNA, 50 bp, homo sapien
aatgagactcaaggagcaattttccratcttcttcagaattgagtagctt

SEQ ID NO: 106618 - DNA, 50 bp, homo sapien
ccagccctggggaatccatctctatygcatggcagccttacctagtctca

SEQ ID NO: 106619 - DNA, 50 bp, homo sapien
tggcaccagaaacttgggaaataaasactgctaatggagaggtcccttgc

SEQ ID NO: 106620 - DNA, 50 bp, homo sapien
gtccgatttttagtcaggtcaagtcyctgtggtgcatgagggatggagac

SEQ ID NO: 106621 - DNA, 50 bp, homo sapien
taatagaaatacctttcatgtaaaastcacaatttacaatttctaacagt

SEQ ID NO: 106622 - DNA, 50 bp, homo sapien
tcttgtaaagcaggtctattggtgaygaactctccagtttttgtttgtct

SEQ ID NO: 106623 - DNA, 50 bp, homo sapien
atttgtgctaaagtgagcaaagctamctgtataaagaaaacacagtgggt

SEQ ID NO: 106624 - DNA, 50 bp, homo sapien
agataaaccaggcttcctaactggaratagaaaattggagcctgagatta

SEQ ID NO: 106625 - DNA, 50 bp, homo sapien
tgtactaaaaatcataaattaaaaayctgacatagaatgatcacatttcc

SEQ ID NO: 106626 - DNA, 50 bp, homo sapien
tcagtgctaagcatcttgaaatattyaaacatatggcatttgaaaggaga

SEQ ID NO: 106627 - DNA, 50 bp, homo sapien
aaggccttagacatttttttcagtaycctagtaacaagtcatatcacgat

SEQ ID NO: 106628 - DNA, 50 bp, homo sapien
tccccaacagataatctattctaaayattgacatcaaaacaatatggttt

SEQ ID NO: 106629 - DNA, 50 bp, homo sapien
caaggacacttcttgtgtgactagargtaaataaagagagatatgcaagg

SEQ ID NO: 106630 - DNA, 50 bp, homo sapien
agaaactagctttttttcctcaacartctgtctgaattcattttgctttc

SEQ ID NO: 106631 - DNA, 50 bp, homo sapien
tttactctaagccatgaataaaaggrcctaacaaataatgcccacctaga

SEQ ID NO: 106632 - DNA, 50 bp, homo sapien
ttttcttcactgcccattgtctctastgctcacacaaccggagtcctgcc

SEQ ID NO: 106633 - DNA, 50 bp, homo sapien
aagctgtcaaggagataatagatagyaagctcttcgaaggcagacattta

SEQ ID NO: 106634 - DNA, 50 bp, homo sapien
gacaatttgttttcactatgaatgasagctattactttttaaggctgtta

SEQ ID NO: 106635 - DNA, 50 bp, homo sapien
ttcttgctattttcttctcgatcagsattttgcaatagcagcattcttga

SEQ ID NO: 106636 - DNA, 50 bp, homo sapien
atatgctgacctctcaatctatgctwacactttgtcatgaatatggctta

SEQ ID NO: 106637 - DNA, 50 bp, homo sapien
tgatatttgggtaagaaaaaccgtayggagagatgagttggaaatatcct

SEQ ID NO: 106638 - DNA, 50 bp, homo sapien
attttgacaataacttggtgataaarcttcattttcagtatcaacatcct

SEQ ID NO: 106639 - DNA, 50 bp, homo sapien
acctctttctcaactggtcctccacratctccaattcttcattaaaggcc

SEQ ID NO: 106640 - DNA, 50 bp, homo sapien
agaaaatatttacagactatacatcwgatgaagatctaatatccagggtc

SEQ ID NO: 106641 - DNA, 50 bp, homo sapien
tggtaatagtgtctattaacgtccastatgcaagctgcaaattgtaagat

SEQ ID NO: 106642 - DNA, 50 bp, homo sapien
tactcagagaatcttcaggaccatcragttttcaatagccaataaaattc

SEQ ID NO: 106643 - DNA, 50 bp, homo sapien
agctaaagtgacctatccaaagttaygagttagttggaggcagggtcaga

SEQ ID NO: 106644 - DNA, 50 bp, homo sapien
agccagcacacatataaatctttcckcacaggcttaataacatgagcacc

SEQ ID NO: 106645 - DNA, 50 bp, homo sapien
aattagacagtcacttgctgtccacrgtaagaagttcagtctaccagggc

SEQ ID NO: 106646 - DNA, 50 bp, homo sapien
gatctgcaagttggcatcaggaaaakaaattctgtagtactctgtattaa

SEQ ID NO: 106647 - DNA, 50 bp, homo sapien
tttctgcaccgtttctacaccgtaaygcacagtgatgcttttttaggagt

SEQ ID NO: 106648 - DNA, 50 bp, homo sapien
ttttcacaagaaaacagcacttaagscttctatatataatcactgttact

SEQ ID NO: 106649 - DNA, 50 bp, homo sapien
aaccaagcccaattagacctcatcasttttccccaacattaacaaaccac

SEQ ID NO: 106650 - DNA, 50 bp, homo sapien
ttttagtcacactagaactctcctaygcttatttataaaatagtttattt

SEQ ID NO: 106651 - DNA, 50 bp, homo sapien
gccttatatcacataagaagtataayggtcatgaaaagttaacttaaatg

SEQ ID NO: 106652 - DNA, 50 bp, homo sapien
cagctgctgtcctctcgttttttccrcaaagggcatccagaacagcaaca

SEQ ID NO: 106653 - DNA, 50 bp, homo sapien
aagttttatataaaacagtttaccaragaatacaagtataataatagtac

SEQ ID NO: 106654 - DNA, 50 bp, homo sapien
gaaaggcaggttgttgcatttatctrtcaattattatagtgtgtttttct

SEQ ID NO: 106655 - DNA, 50 bp, homo sapien
agaaaaatccgacttaagagttgacsatcaattcatacttaggacatact

SEQ ID NO: 106656 - DNA, 50 bp, homo sapien
caatcacaaaatcatttctaatagcycttgtattttatttatatatgtga

SEQ ID NO: 106657 - DNA, 50 bp, homo sapien
ccaaatcacatctctataacatccartaacagagatatgaaagtctgttt

SEQ ID NO: 106658 - DNA, 50 bp, homo sapien
ttatagatttcttgtgaaaattaaaygacataatctgtttaaagtctctg

SEQ ID NO: 106659 - DNA, 50 bp, homo sapien
agagctacatgtaaatgaaaccacamagtatatactctttttggggaggg

SEQ ID NO: 106660 - DNA, 50 bp, homo sapien
aaatagaaataaaacaaggacattayctacactcacatagccaaggttaa

SEQ ID NO: 106661 - DNA, 50 bp, homo sapien
tccccagtgatcttgtttgtctcatratgaaaaccagtgttttctttttt

SEQ ID NO: 106662 - DNA, 50 bp, homo sapien
cacaattattttgagatgcactcatrtttttgcataaaggaatatttata

SEQ ID NO: 106663 - DNA, 50 bp, homo sapien
tatgtgtccttactagttccttgagwctatcaactaaatccgtatgtgtg

SEQ ID NO: 106664 - DNA, 50 bp, homo sapien
tcatgcctccagtttttactatggcrgaaaatcattatgagttggaatta

SEQ ID NO: 106665 - DNA, 50 bp, homo sapien
tttttgtcagatcactgacaataacmagagttgaaaaggaagctgtggac

SEQ ID NO: 106666 - DNA, 50 bp, homo sapien
gatttgaacccaactttttctgataycacaccctggtcttcatcactaag

SEQ ID NO: 106667 - DNA, 50 bp, homo sapien
cgagagacttatgccagacacctccracattcctggtggtccctcttcag

SEQ ID NO: 106668 - DNA, 50 bp, homo sapien
gtgtctgaaaatgtggaaagaacaartatcaggtaagagactccatttgt

SEQ ID NO: 106669 - DNA, 50 bp, homo sapien
tgtttgatgctggtgtttaaaaataygagcaaggccaggcatggcggctc

SEQ ID NO: 106670 - DNA, 50 bp, homo sapien
gttatgctggtccaataatcagagargtctaatatgtgagtgtcttagtt

SEQ ID NO: 106671 - DNA, 50 bp, homo sapien
tacactttttgtatggtactttaaargttttgcttcactatcttcttgct

SEQ ID NO: 106672 - DNA, 50 bp, homo sapien
gttcaccctccaaaataatggaaacygtcatcacctctccaaccttagct

SEQ ID NO: 106673 - DNA, 50 bp, homo sapien
gtctcagcctcctagttcaccaaaasgacataagagtgcctgatgtggtt

SEQ ID NO: 106674 - DNA, 50 bp, homo sapien
attattgtcattttgccgagaataasgtttgcagagctcctcatgccacc

SEQ ID NO: 106675 - DNA, 50 bp, homo sapien
ttatttattcattcacctgtcgatarcatttgcattgttcctagtttttt

SEQ ID NO: 106676 - DNA, 50 bp, homo sapien
actccagagctttgtcagcaataaaytagtgattttcattaacccagtat

SEQ ID NO: 106677 - DNA, 50 bp, homo sapien
tttctctggaaacttcttatttgatycatgtgttacttagaagttttttt

SEQ ID NO: 106678 - DNA, 50 bp, homo sapien
ggagaagctgacagagaaagatgccraagatcggtatagctttccatttg

SEQ ID NO: 106679 - DNA, 50 bp, homo sapien
aacgaatgagaacataatctcaccasgtaggaggcaaacaaaacatgatt

SEQ ID NO: 106680 - DNA, 50 bp, homo sapien
tacagtctgtccatatatgagcttayacatgcatttgtttcccaaatgat

SEQ ID NO: 106681 - DNA, 50 bp, homo sapien
ttaagctggtagtttctcttgtatasgtaacttgattttatttagaaatt

SEQ ID NO: 106682 - DNA, 50 bp, homo sapien
atccacttcgtagagacagtaagtakggcaaatctttttatccagccttt

SEQ ID NO: 106683 - DNA, 50 bp, homo sapien
actgatatggtaaggagagaacttcygactgaaagctagagagtgacctg

SEQ ID NO: 106684 - DNA, 50 bp, homo sapien
acttgtaagatcttaaacaatttaaycaaagttctaagccctaacttgct

SEQ ID NO: 106685 - DNA, 50 bp, homo sapien
gtatcatttcctccataaataccttrtatcattctccagtccaataagta

SEQ ID NO: 106686 - DNA, 50 bp, homo sapien
attacccagaatggaatatctatcaygcattctgggcaaaataattaagc

SEQ ID NO: 106687 - DNA, 50 bp, homo sapien
aataaaatgtcattcaggatgcatayagttggaagtaagggaaataacct

SEQ ID NO: 106688 - DNA, 50 bp, homo sapien
ttacctcggctcatctcctgtgacamatattgataatctaaaatgtgccc

SEQ ID NO: 106689 - DNA, 50 bp, homo sapien
tgtgcagtgtggatctgctgtaatayatttaaccattcccctgccgatgg

SEQ ID NO: 106690 - DNA, 50 bp, homo sapien
atattttagccatttctaagacgacyaatttaatgcatatttgataacat

SEQ ID NO: 106691 - DNA, 50 bp, homo sapien
cagaatctcggtgtaggatcagtcaygagagtaagtcaaacatcaggctt

SEQ ID NO: 106692 - DNA, 50 bp, homo sapien
tctaatgtctagatactttaaaacayagatattactacggatttaagcca

SEQ ID NO: 106693 - DNA, 50 bp, homo sapien
tacttgatgtttaaaagtctgtataygagtttaagtccacttctaataaa

SEQ ID NO: 106694 - DNA, 50 bp, homo sapien
gatggggagctcaataatggctggaycacgctgaccacactagaatctac

SEQ ID NO: 106695 - DNA, 50 bp, homo sapien
gagatgacagctgggaaaagccgagrcatctgattgtgctgttcttgctt

SEQ ID NO: 106696 - DNA, 50 bp, homo sapien
ggaaaaaggcaacttatgtcaaagckcagggtcacaggagagcatgttcc

SEQ ID NO: 106697 - DNA, 50 bp, homo sapien
atttaattctgctttgtctttggacrttttcacctttaaccataagcaga

SEQ ID NO: 106698 - DNA, 50 bp, homo sapien
tcctctttttcaatataggcacttasaactataatcttccctcttagtac

SEQ ID NO: 106699 - DNA, 50 bp, homo sapien
cccatggcaggcagatcaagtcgtgractcatgaaagcctttatgacaaa

SEQ ID NO: 106700 - DNA, 50 bp, homo sapien
gggcacagaatagatcctcagtaagkaagtgttagataaacaagctgaac

SEQ ID NO: 106701 - DNA, 50 bp, homo sapien
tccaacctactcccaagatagctctrcttgaccttcatctctttcctcct

SEQ ID NO: 106702 - DNA, 50 bp, homo sapien
ggatttccatttgctctgtaggtgaygataggatattgaagactttaaag

SEQ ID NO: 106703 - DNA, 50 bp, homo sapien
tgtttctagcctagatgtctctctcratgtccatagaaactcaagtttag

SEQ ID NO: 106704 - DNA, 50 bp, homo sapien
ttccatgtgctaggtcttacatgaaytaaaagggccctgggtggttgttc

SEQ ID NO: 106705 - DNA, 50 bp, homo sapien
atacttttggaggtcacaggtccctytgacaaactggtaagaagctatga

SEQ ID NO: 106706 - DNA, 50 bp, homo sapien
tttgaataaaacttgtagtacttccrcacagtatgacagacctctagact

SEQ ID NO: 106707 - DNA, 50 bp, homo sapien
ttgtaaggtcattttataatgattaraagagtcgaagatacaaaaaaagt

SEQ ID NO: 106708 - DNA, 50 bp, homo sapien
tgaggttaaaatgattcagcatttasactttaaaaattacctcaatgttc

SEQ ID NO: 106709 - DNA, 50 bp, homo sapien
tttagtttacttagctagatgtcaawactacaatttgatatgtcatgaaa

SEQ ID NO: 106710 - DNA, 50 bp, homo sapien
acagggcttcaatcaaggttataagraaggtgcagaagtcattttaaact

SEQ ID NO: 106711 - DNA, 50 bp, homo sapien
caaggatgtgagcccaagttacagaygttaagagctctttccccgtacca

SEQ ID NO: 106712 - DNA, 50 bp, homo sapien
taaatttaaatataactgtattctcrataaatgtaaatgactcagacttt

SEQ ID NO: 106713 - DNA, 50 bp, homo sapien
gctgggccattattcaataactgaamcttatacttgtttacttaggatta

SEQ ID NO: 106714 - DNA, 50 bp, homo sapien
aaacatacatgctttgactttacatyatctcatgaggcgttaacccagct

SEQ ID NO: 106715 - DNA, 50 bp, homo sapien
tgaaatttatattttcattagtagaygggagataaggacctagctgtgtc

SEQ ID NO: 106716 - DNA, 50 bp, homo sapien
ctgacatctcctgcctggaccttcgytatccttctctaactagtcttcct

SEQ ID NO: 106717 - DNA, 50 bp, homo sapien
tctaacctacgttagtaaagctatcyattcttcacgctgtacatcttgat

SEQ ID NO: 106718 - DNA, 50 bp, homo sapien
agataaagcacttgttcgtaatgctrgacacatcgccattgggtgattta

SEQ ID NO: 106719 - DNA, 50 bp, homo sapien
cagccagaacagaccaagacaggcaygatgttggaatcaacgttgactgg

SEQ ID NO: 106720 - DNA, 50 bp, homo sapien
tattaataattacatattaaatgtaygccagtatagacagtggcagcatt

SEQ ID NO: 106721 - DNA, 50 bp, homo sapien
agaagggattgaatcccactattcakggtaaagcagaagctgtgcctggt

SEQ ID NO: 106722 - DNA, 50 bp, homo sapien
ttgaatcaaacatgcatatgctttgyagtaacatgggattttaaaaattc

SEQ ID NO: 106723 - DNA, 50 bp, homo sapien
ttcaaaagcccatgtgacatcaaaartaggtaaagttaaccacatgagga

SEQ ID NO: 106724 - DNA, 50 bp, homo sapien
aagggtgtattcatttgatgaagaargatagaaaaaaaggaatctgtttt

SEQ ID NO: 106725 - DNA, 50 bp, homo sapien
tatagctgttttatgaaatgcaagayaattaactccatttcttgacaatt

SEQ ID NO: 106726 - DNA, 50 bp, homo sapien
tccacagaataaggtcatatttcaaygaagggttaactcggctgtccagc

SEQ ID NO: 106727 - DNA, 50 bp, homo sapien
aattcagaatagacagatatttctcrgactctcaagatctagaaaactgc

SEQ ID NO: 106728 - DNA, 50 bp, homo sapien
ctgcaggaatcagagtaaggagataytaaggttaaatattctaaaataat

SEQ ID NO: 106729 - DNA, 50 bp, homo sapien
tttccttttttccccagtgactacarattaaactatggtttcttttcatt

SEQ ID NO: 106730 - DNA, 50 bp, homo sapien
tattcatttgcaaaatggttatgaawcagagtccattccatgaagttttt

SEQ ID NO: 106731 - DNA, 50 bp, homo sapien
tgaaaactaccatgcagttggaactyagtaatgataaagagtcttgatgg

SEQ ID NO: 106732 - DNA, 50 bp, homo sapien
agagtttttcttcctgaggaatatargccaaaaactggttttaagaaacc

SEQ ID NO: 106733 - DNA, 50 bp, homo sapien
ggtcctcattccagaaatgccctatraactcgtgattctctagtagacat

SEQ ID NO: 106734 - DNA, 50 bp, homo sapien
tcaaaattgaacagactgggaacacygtgaaggcttcatcagggtatttt

SEQ ID NO: 106735 - DNA, 50 bp, homo sapien
ggcacacagtagttctcagtaaggcscataaccagccaagcccgttttct

SEQ ID NO: 106736 - DNA, 50 bp, homo sapien
gaaaaggccaaatactcagcacactsaatgatgcatgctgcaacccttgg

SEQ ID NO: 106737 - DNA, 50 bp, homo sapien
tttttttaataccagccctttagcgratttaggaagggagtttagagaaa

SEQ ID NO: 106738 - DNA, 50 bp, homo sapien
gagatagattctagacatacatacaraaggttaatgtcaaagcttgtaga

SEQ ID NO: 106739 - DNA, 50 bp, homo sapien
agtaagttggtttgaaagaacacagraactcatttggaaaggtcttagca

SEQ ID NO: 106740 - DNA, 50 bp, homo sapien
gcatgagaagcagtcttgcactctcraaatgagtgtaggccacaccctct

SEQ ID NO: 106741 - DNA, 50 bp, homo sapien
tcttagctgctccaaattagttataracatgtagcactgatatgagcacg

SEQ ID NO: 106742 - DNA, 50 bp, homo sapien
agtgtaactcatcctatgatatttgkcaaagtatgctaaaataggcttta

SEQ ID NO: 106743 - DNA, 50 bp, homo sapien
cgggctcaaggagcccaaatgccagrtgatgaatccatgacgatgaaagg

SEQ ID NO: 106744 - DNA, 50 bp, homo sapien
cacttccagaagatgttatcccaggkagtcacttaacccttgatgtcttg

SEQ ID NO: 106745 - DNA, 50 bp, homo sapien
attgctcctcttttcaaaattcccastcttcactgtactgactgcatcta

SEQ ID NO: 106746 - DNA, 50 bp, homo sapien
accatgaactgctctgttaggattayagattataccagccccagggtgaa

SEQ ID NO: 106747 - DNA, 50 bp, homo sapien
ttggctccctaattcatttcctgctsaagccacctgatacacaacatctc

SEQ ID NO: 106748 - DNA, 50 bp, homo sapien
agatacttattgtacaattttgtgayaggaagttccaagagaggcaagta

SEQ ID NO: 106749 - DNA, 50 bp, homo sapien
tttctctactctgaagtatctgctcygaagtacctgctcccctcgtaggg

SEQ ID NO: 106750 - DNA, 50 bp, homo sapien
gtttaaggttaaactactaaaattaygaaatatctcttttgaacaaatca

SEQ ID NO: 106751 - DNA, 50 bp, homo sapien
tgaaagatggagtgacagaaaccatraataggaaaagcaaaaattaattg

SEQ ID NO: 106752 - DNA, 50 bp, homo sapien
gcttcttggcatggaaatcctctccwaatgtactgtgttccttggatacc

SEQ ID NO: 106753 - DNA, 50 bp, homo sapien
tataaaatgtattatagacatttcartagttgcccagctttgtccctggc

SEQ ID NO: 106754 - DNA, 50 bp, homo sapien
gggtcctaaagagattgttattaaamgtgaaaatatgtatcaaaagtgtt

SEQ ID NO: 106755 - DNA, 50 bp, homo sapien
ctcagcaagttacacctagaagataygcaatgggaagggcatctggcaac

SEQ ID NO: 106756 - DNA, 50 bp, homo sapien
gtgttcttattataaaagttatataygcttattgaaaaaaataagagaca

SEQ ID NO: 106757 - DNA, 50 bp, homo sapien
cctctcatgctcaacactttagcctyaatccacctcagttcttctccaga

SEQ ID NO: 106758 - DNA, 50 bp, homo sapien
atctctaccatgcatagaacattcartcgtggccaggtgaggtctacaca

SEQ ID NO: 106759 - DNA, 50 bp, homo sapien
atgctttgggaaatctacgcccagaygatgttccatgcaggaggcagctc

SEQ ID NO: 106760 - DNA, 50 bp, homo sapien
ctgatacagaagttcaattttttaargacatgttcaatttattctttttc

SEQ ID NO: 106761 - DNA, 50 bp, homo sapien
ttctctcctctctccatttaacttaygttcaactgcaataactttatgaa

SEQ ID NO: 106762 - DNA, 50 bp, homo sapien
tggtatgtttagggcttagtgatatmtttccacctctgttttttctttag

SEQ ID NO: 106763 - DNA, 50 bp, homo sapien
attggttttcatcttattattattcyataaatggcattagtaggttttac

SEQ ID NO: 106764 - DNA, 50 bp, homo sapien
aattattttttatgaaatagacatgraaatttatgtaaaacctactaatg

SEQ ID NO: 106765 - DNA, 50 bp, homo sapien
actatttgttgctaagatttatattsaaagattcacatttaatcaatctt

SEQ ID NO: 106766 - DNA, 50 bp, homo sapien
gagctaagaaagctaaagagcaaaamttaaattgtaagtgactttaatgt

SEQ ID NO: 106767 - DNA, 50 bp, homo sapien
actacaaatagcctgatgcccgttaycatttgaagggtagaaaactgaaa

SEQ ID NO: 106768 - DNA, 50 bp, homo sapien
gaaaacctctgctcatgaccacttamagcaacagcctgttctaatttatt

SEQ ID NO: 106769 - DNA, 50 bp, homo sapien
ccatcataaacagccccatggtttcrcttgataatatgccactgatgaag

SEQ ID NO: 106770 - DNA, 50 bp, homo sapien
aaatttctagtcaaaattacacttamatctatgaaatatatgaaatacat

SEQ ID NO: 106771 - DNA, 50 bp, homo sapien
ttacttggaattaaagtgtgaattcygatttgaggatttataaaagccaa

SEQ ID NO: 106772 - DNA, 50 bp, homo sapien
ttagtaatttaagtaaattgctcaartgtggtcaatgacattactaccca

SEQ ID NO: 106773 - DNA, 50 bp, homo sapien
caatcaagcgaaagctgcgtccttaygactcagggccctacacatgctgg

SEQ ID NO: 106774 - DNA, 50 bp, homo sapien
gtcagtgggtctcactgtgggttcaygctcagactgcaggctggaaagca

SEQ ID NO: 106775 - DNA, 50 bp, homo sapien
taagttttatcaatagcaattatcargctactaagaataataaattaaaa

SEQ ID NO: 106776 - DNA, 50 bp, homo sapien
tcctagggaaatacaggatgataacrggactaagatttcctgtgaccttc

SEQ ID NO: 106777 - DNA, 50 bp, homo sapien
attaaattaaatttcatagtattaargaccacattgggcaaaagagtgga

SEQ ID NO: 106778 - DNA, 50 bp, homo sapien
aacaaatggcagagaggtttccatamgatcagctttttaaaaaatcaact

SEQ ID NO: 106779 - DNA, 50 bp, homo sapien
agagcccagctgtttggcttactacrcttttccatgaggaattgaaacat

SEQ ID NO: 106780 - DNA, 50 bp, homo sapien
gttgatgactctcttcttcttgaaastccatctttgcttggcttctagaa

SEQ ID NO: 106781 - DNA, 50 bp, homo sapien
gagcttatttgaggaccggctgtacmaggatggtgatgaggttgaggagg

SEQ ID NO: 106782 - DNA, 50 bp, homo sapien
tgaaccagcaatagtcaatgtaaaamctaccatatttgctccactccaca

SEQ ID NO: 106783 - DNA, 50 bp, homo sapien
tggagagctagaattagcacttttcraattgtcggacccagtgcttgggg

SEQ ID NO: 106784 - DNA, 50 bp, homo sapien
ttcagcacagtataatctctatgtascaatactttgttgttcacagctgt

SEQ ID NO: 106785 - DNA, 50 bp, homo sapien
attccttctctttccagtggcttaarttaaattaaaagccatctatgtga

SEQ ID NO: 106786 - DNA, 50 bp, homo sapien
ataaacatttaacttttttttcatcraagagaagcctctctgacattcta

SEQ ID NO: 106787 - DNA, 50 bp, homo sapien
tggcgagaggcaccatcagaattgawctcaggtctatgtggcagccagcc

SEQ ID NO: 106788 - DNA, 50 bp, homo sapien
cttgcctaggtgcacggtatcagtamgggaggcactgtgttcctgcatag

SEQ ID NO: 106789 - DNA, 50 bp, homo sapien
actcgagaaagatgcaagtgtggaayatgaagtgaaacagagaaagaacg

SEQ ID NO: 106790 - DNA, 50 bp, homo sapien
agaagtgaaagagaatttcttccctraataatgtgtgaactaaatcacaa

SEQ ID NO: 106791 - DNA, 50 bp, homo sapien
agtgggggctctaagaaataaatcayactagcagaagagacaaagattat

SEQ ID NO: 106792 - DNA, 50 bp, homo sapien
tttatgttgcactatcatattgaccratttctgtgtccgtgtgaacactt

SEQ ID NO: 106793 - DNA, 50 bp, homo sapien
ttgtaattctagcctgggccataaarctttcaagaatgaggctctctcct

SEQ ID NO: 106794 - DNA, 50 bp, homo sapien
ttttggcaaaatacatgaacttataracccaagagactaagggaagccta

SEQ ID NO: 106795 - DNA, 50 bp, homo sapien
tgcagtttacactatctcattggagrccctctcattcgtggatggcagat

SEQ ID NO: 106796 - DNA, 50 bp, homo sapien
agaaggacatagactgtacaactgargaattcaatgattgaaacaaaaac

SEQ ID NO: 106797 - DNA, 50 bp, homo sapien
gaactgttagatttttaatttctggyattatagtgatatgagtaaaatac

SEQ ID NO: 106798 - DNA, 50 bp, homo sapien
agtctattctatttcaagtatgttcrcaattacccattaaagcttttttg

SEQ ID NO: 106799 - DNA, 50 bp, homo sapien
ctagcctcctttgcattttaaacaawacgtagccacacatcccccaaatt

SEQ ID NO: 106800 - DNA, 50 bp, homo sapien
gaaagaagaacaagtctcattttgayacattttatgtttgaccagaaggg

SEQ ID NO: 106801 - DNA, 50 bp, homo sapien
atcattttgttgcaagcaagagaaaytccctaggctagaggaaagaaaca

SEQ ID NO: 106802 - DNA, 50 bp, homo sapien
gaagatttggcttttctcctgaagtraaagaatacatgaatctgatgaga

SEQ ID NO: 106803 - DNA, 50 bp, homo sapien
ttctcgattcctttcttcatttagcwcccttaggtagtcggcatgctttc

SEQ ID NO: 106804 - DNA, 50 bp, homo sapien
ctggtttggctttgaaaaaaatgaasaagataccaacaggtgagtctgtt

SEQ ID NO: 106805 - DNA, 50 bp, homo sapien
atgttttgtttttcatcattgctcamtatttagtaataggttaatcaaaa

SEQ ID NO: 106806 - DNA, 50 bp, homo sapien
ttcctgagtactgagatgatttattktatcactgctatctaataactttc

SEQ ID NO: 106807 - DNA, 50 bp, homo sapien
tagtaaataaaagttggaataaatamgtttgtcatttattatatacaggt

SEQ ID NO: 106808 - DNA, 50 bp, homo sapien
taatcatgtatagtgccttatgaackaagtttctatacaaataaataata

SEQ ID NO: 106809 - DNA, 50 bp, homo sapien
aatcaggaggagcgaggactgatgaracagacaaaaaagaaaacccatcc

SEQ ID NO: 106810 - DNA, 50 bp, homo sapien
atacagagacaattccaggatatgasagaatcattgtaatgcgagccagg

SEQ ID NO: 106811 - DNA, 50 bp, homo sapien
aaagagcctagacaaacatcggcagraattgcttcatggcttctgagcag

SEQ ID NO: 106812 - DNA, 50 bp, homo sapien
atcatggttttgtgaatactcactakgcattaggacaaagttttgtaact

SEQ ID NO: 106813 - DNA, 50 bp, homo sapien
gcaaaggtactggctatggtcccttyaaccacaaggagagaaaaagcaaa

SEQ ID NO: 106814 - DNA, 50 bp, homo sapien
cacacactttcccctgtactgccaaygtttttcataagctcaattcataa

SEQ ID NO: 106815 - DNA, 50 bp, homo sapien
ttccttgagccacatgttccttgaayagcaaatgagtggtccttaacatt

SEQ ID NO: 106816 - DNA, 50 bp, homo sapien
cctcagttccttctacaccacgtackatctctgactttcaatgaaaaatt

SEQ ID NO: 106817 - DNA, 50 bp, homo sapien
gttggtccttactgacaagtcaataycatgcctgcagcagctatcacagg

SEQ ID NO: 106818 - DNA, 50 bp, homo sapien
catagagcccatcagttacaaaacartcataatttctatttaaagacaga

SEQ ID NO: 106819 - DNA, 50 bp, homo sapien
atctcaacctctctaaagactgagcrtagggttcccagttcccaggggga

SEQ ID NO: 106820 - DNA, 50 bp, homo sapien
gctggtgcgatagtccagggtcaaaragcagtgaatctgaaatcaggcag

SEQ ID NO: 106821 - DNA, 50 bp, homo sapien
tctgaggtaatctcatattgttgaaygtggagaaatcctgaaagagatat

SEQ ID NO: 106822 - DNA, 50 bp, homo sapien
gacccaggtcataactgcaagttaarctcagaccaaatgggactggctca

SEQ ID NO: 106823 - DNA, 50 bp, homo sapien
acatcttgcaactttgttcttgatasgtgattgtctttccagaggatgat

SEQ ID NO: 106824 - DNA, 50 bp, homo sapien
aatatttcttctcttaagacatcatragaatacaaattacaatccatttt

SEQ ID NO: 106825 - DNA, 50 bp, homo sapien
aactgaggactaggccctgcttcacrggcaatgaacagtggggcacacac

SEQ ID NO: 106826 - DNA, 50 bp, homo sapien
aaaaagaaaatgtggtatatacagaygatgcaatagtattcagccttaaa

SEQ ID NO: 106827 - DNA, 50 bp, homo sapien
tttattatttttagaaattaattcartaaacactttgcagatctaatata

SEQ ID NO: 106828 - DNA, 50 bp, homo sapien
tatattcagaccatagcacaagtcartaagtgagtaaaacaaggagagag

SEQ ID NO: 106829 - DNA, 50 bp, homo sapien
taaaataaataagtagacaataacaraatcaaggcaaaagtaggaagtgt

SEQ ID NO: 106830 - DNA, 50 bp, homo sapien
atgttcacacctgctacactaatacrctttaacatcttgttgaaatagat

SEQ ID NO: 106831 - DNA, 50 bp, homo sapien
acaacggacctgatgagatttgggaycaattcctcttcttgtccacagct

SEQ ID NO: 106832 - DNA, 50 bp, homo sapien
tctcacatggcttgtgaaatgccacsatgcccttaatattaagaattgat

SEQ ID NO: 106833 - DNA, 50 bp, homo sapien
aaaaaagaattgatgaaacatatagyaatactccaatgctggtgtgtaac

SEQ ID NO: 106834 - DNA, 50 bp, homo sapien
tacagcttggatttcttgtgccaaaygatcaaacagtaaaagcactgaca

SEQ ID NO: 106835 - DNA, 50 bp, homo sapien
attcatccctgaatttatttattcaytacactatgggtacactaagcctt

SEQ ID NO: 106836 - DNA, 50 bp, homo sapien
agaactctgcattggtcccagattargctatgaagtcacaggtacagaca

SEQ ID NO: 106837 - DNA, 50 bp, homo sapien
cataataggatgacatctataatctkacgaagagtgtgaatctgctgggt

SEQ ID NO: 106838 - DNA, 50 bp, homo sapien
tatttgcagaaattaaaattagaacyacattgtttgcttatcatttatct

SEQ ID NO: 106839 - DNA, 50 bp, homo sapien
ctgaataaatgggaatagccttctgkaaaatgaagaatgcttggatttgc

SEQ ID NO: 106840 - DNA, 50 bp, homo sapien
agaaaatgttggtacaaatatagagyaaggagcatttcaacactatgtgt

SEQ ID NO: 106841 - DNA, 50 bp, homo sapien
tcctgccgaggttagggccttggaasaatgctgataaagagcctattaca

SEQ ID NO: 106842 - DNA, 50 bp, homo sapien
aattagaaaaagagaggaaaacggayctctatgggccaaatcctgtgcag

SEQ ID NO: 106843 - DNA, 50 bp, homo sapien
cacatatggggttatggcatatgtamaacaggaaagcattttctagaaag

SEQ ID NO: 106844 - DNA, 50 bp, homo sapien
gaattgatgtgattcttctgagactraacttggaaccaatacaaatgaga

SEQ ID NO: 106845 - DNA, 50 bp, homo sapien
atagaccaaagaaaaaagtgacatamgctattttgaggaaaaacaagtga

SEQ ID NO: 106846 - DNA, 50 bp, homo sapien
cagacaatgaagtgactccacctgarccaagagtagtgaagtcaattctg

SEQ ID NO: 106847 - DNA, 50 bp, homo sapien
aatgtgtgtgctgataaactgtttcwcttatagtaaagactaaggggaag

SEQ ID NO: 106848 - DNA, 50 bp, homo sapien
aatcaccagttagctaaggtaccacrcataacatcatctggtcccttatg

SEQ ID NO: 106849 - DNA, 50 bp, homo sapien
atctgattactctcacagtccacaaygtccaagataaaacacgaaccaac

SEQ ID NO: 106850 - DNA, 50 bp, homo sapien
agctcttattcatggactgcatatawgatacacacccattccatctgcta

SEQ ID NO: 106851 - DNA, 50 bp, homo sapien
cctcaaataatataattccaagacawgtactcagctaaccacatttctct

SEQ ID NO: 106852 - DNA, 50 bp, homo sapien
gattcagcacttatagagatgctatyacttgtttggataactttctttag

SEQ ID NO: 106853 - DNA, 50 bp, homo sapien
gttctaaatcataagttggtagaagkatcaaaatatggctctgacctttc

SEQ ID NO: 106854 - DNA, 50 bp, homo sapien
caaatatgttgagattcccagataartggatccaagatttgttccataga

SEQ ID NO: 106855 - DNA, 50 bp, homo sapien
cttatgtgagaaatagtggagggaaygagagatggtcagctttaaactgc

SEQ ID NO: 106856 - DNA, 50 bp, homo sapien
gtacggagtgaatttctttgccgcaygtgaatattcctgtttccttacta

SEQ ID NO: 106857 - DNA, 50 bp, homo sapien
ggacattttgtgatatgtaataaaamataaactactgagggagagatgtg

SEQ ID NO: 106858 - DNA, 50 bp, homo sapien
ttttcaatttggtcaaataaaaccarggagtcctgacttagagaatctct

SEQ ID NO: 106859 - DNA, 50 bp, homo sapien
tctctaaggaattcacaattccgccragtacacagatatacgagcaggtt

SEQ ID NO: 106860 - DNA, 50 bp, homo sapien
gttctgacttacatgagttactgaarttatccaataggatactttccagc

SEQ ID NO: 106861 - DNA, 50 bp, homo sapien
gtgtgtattaggtctatttggtctaygtgttattcaagtcctctatgtcc

SEQ ID NO: 106862 - DNA, 50 bp, homo sapien
gaggaagaacctgcagtcatcctcartccctagatttaaatccattaaca

SEQ ID NO: 106863 - DNA, 50 bp, homo sapien
tttcaggtaccacagaagttgaagargaaagcaagggtgtcgtaagaaga

SEQ ID NO: 106864 - DNA, 50 bp, homo sapien
atttctttaatgccatcacacgtcarccatatcgttttaaaaagcaattt

SEQ ID NO: 106865 - DNA, 50 bp, homo sapien
ttctttaaaaaattaagtgattaaarctacaacattgttagagagagaaa

SEQ ID NO: 106866 - DNA, 50 bp, homo sapien
aagattctgggtctcctctttgtacrgagctcatagaaaatcatcacttt

SEQ ID NO: 106867 - DNA, 50 bp, homo sapien
cacagggaaccaaggctgaaaatacygatactcaacaaacagcagacaca

SEQ ID NO: 106868 - DNA, 50 bp, homo sapien
cagtacccagcatcctggcataacamagagataaagcaggagaatcacat

SEQ ID NO: 106869 - DNA, 50 bp, homo sapien
acataaaagtacaggaattcactcaragatggacactagtatgaaactag

SEQ ID NO: 106870 - DNA, 50 bp, homo sapien
agagtgagatgttaaatgcatggtcycaacagaaaatttctcattatacc

SEQ ID NO: 106871 - DNA, 50 bp, homo sapien
tgtcttttttctttctttctttttamattgacatagaatttatctagagt

SEQ ID NO: 106872 - DNA, 50 bp, homo sapien
tgtttatctctctttaaagatttcasgtattatatgtgtacaaccacatt

SEQ ID NO: 106873 - DNA, 50 bp, homo sapien
tctgaagtaatggaggcttgtgtcawatgtattcattccttctcaggtgc

SEQ ID NO: 106874 - DNA, 50 bp, homo sapien
aagaaagtataattccttggttttgragaacattcccaatggatatggaa

SEQ ID NO: 106875 - DNA, 50 bp, homo sapien
taaaagaaagaagaaacaggtcttaygtaaactgcagaatctgttgcatc

SEQ ID NO: 106876 - DNA, 50 bp, homo sapien
gactgtcaacaaagaactcaataccsagcacaattttgcttcaaaaatga

SEQ ID NO: 106877 - DNA, 50 bp, homo sapien
attctgtctaagccagaacatagacraggaagactaaaaccctattttgt

SEQ ID NO: 106878 - DNA, 50 bp, homo sapien
ccatttatttatttagttgttacacraagttcttcaaggtattacgggca

SEQ ID NO: 106879 - DNA, 50 bp, homo sapien
aaaaggaactctggatgagataccaraagtggaagcacatgagcctgatt

SEQ ID NO: 106880 - DNA, 50 bp, homo sapien
ggggcacatagggacttacagccaayggtcaggtgagagggtccctgggt

SEQ ID NO: 106881 - DNA, 50 bp, homo sapien
ggagttgtaaaatctccctctgtaawgcgtttcaatgttaatacggtaaa

SEQ ID NO: 106882 - DNA, 50 bp, homo sapien
gtttgctccatttcagtctcttgttsaaatatgttttcaggttattctca

SEQ ID NO: 106883 - DNA, 50 bp, homo sapien
gaacatgttattttttaagaaaagtwaagaatgatcacaactgtgattca

SEQ ID NO: 106884 - DNA, 50 bp, homo sapien
aagaacatctgcaaaaacagccaatrtaacattcagtggtgaatgctgaa

SEQ ID NO: 106885 - DNA, 50 bp, homo sapien
aattcactaattcataaaagaattayaccctgaaatcgatttgattgtat

SEQ ID NO: 106886 - DNA, 50 bp, homo sapien
taaaatgtatttactgtgcttataaygattgccagtttcagaaacttcaa

SEQ ID NO: 106887 - DNA, 50 bp, homo sapien
cactatctagacaaaaaatttcaacrcatcagtcccagcaagtttagtta

SEQ ID NO: 106888 - DNA, 50 bp, homo sapien
ttctttcgattcaacagttaggtaayactgttcttgtccattctgcaaat

SEQ ID NO: 106889 - DNA, 50 bp, homo sapien
tccttcagggcaggtactgcattggyaggaacaaattaaagacccaaaga

SEQ ID NO: 106890 - DNA, 50 bp, homo sapien
ttaggtgagcatttgatatataccarcagatagataataacatattgcta

SEQ ID NO: 106891 - DNA, 50 bp, homo sapien
tgtttagtaaagccaagtcatactayaggagaacacattcagatgcaagt

SEQ ID NO: 106892 - DNA, 50 bp, homo sapien
cccaaggctacaagagcatagacaargcattaggagacatagaaggtaaa

SEQ ID NO: 106893 - DNA, 50 bp, homo sapien
gcgctggacaggagcttgccagttayccaaagaattgtctgagaaaggcc

SEQ ID NO: 106894 - DNA, 50 bp, homo sapien
gtctgtagcacagatacctgtgtccmtgtaagttatttagcctgtatttc

SEQ ID NO: 106895 - DNA, 50 bp, homo sapien
caacccagacaacaaatcgtagtgamctttcccaacataaatggatgctc

SEQ ID NO: 106896 - DNA, 50 bp, homo sapien
tgtagtagaaatataaacatgtcctragaagaaaatatgaatagatcctg

SEQ ID NO: 106897 - DNA, 50 bp, homo sapien
aatacaaaattcttatcctccacaaratttaaaataaaacagaatctcta

SEQ ID NO: 106898 - DNA, 50 bp, homo sapien
ggtggtatatgtataactatagatayggatatggataggctagagctaga

SEQ ID NO: 106899 - DNA, 50 bp, homo sapien
ggttcacatctgaccctgtaataaartaactctttggagtcttcagaggg

SEQ ID NO: 106900 - DNA, 50 bp, homo sapien
gaaaagattgtcttcatttattgaaygtgcttaactcaggcccgggaaag

SEQ ID NO: 106901 - DNA, 50 bp, homo sapien
tatgggaaactcgtataattctgatwtgacttagtgtatgctatcagtaa

SEQ ID NO: 106902 - DNA, 50 bp, homo sapien
ttttcacatttatgcatttctgaaawttagatgcaatgtcaagttttggt

SEQ ID NO: 106903 - DNA, 50 bp, homo sapien
actatttttttaaaaggtctggtcakgtataagattaaacaatggtataa

SEQ ID NO: 106904 - DNA, 50 bp, homo sapien
aattaaatgtgtagtaaccaccaacrgatgctaaaaaacaggaaaattaa

SEQ ID NO: 106905 - DNA, 50 bp, homo sapien
tttgatgtaagatccgtattaaaaartcaatagcattaatatatgtcagc

SEQ ID NO: 106906 - DNA, 50 bp, homo sapien
ggggaaaagaaagataatgatgtgarataatagatatgttagtttgcttg

SEQ ID NO: 106907 - DNA, 50 bp, homo sapien
tttagaagctgaaaaagtctgtcagraccatgtacaacatccaatatccg

SEQ ID NO: 106908 - DNA, 50 bp, homo sapien
ggccatcagtgctttcacagagaccrcctattttgctagcaacaggaagt

SEQ ID NO: 106909 - DNA, 50 bp, homo sapien
gacaatggccatctcttttcctccaygtcttttctgtttttctttcctta

SEQ ID NO: 106910 - DNA, 50 bp, homo sapien
atcagaaggacccttcctcttccacrgtccaacaagataaactagataaa

SEQ ID NO: 106911 - DNA, 50 bp, homo sapien
tctaatagagaattacctcggatcayggtcaaatcttacacctcttcaga

SEQ ID NO: 106912 - DNA, 50 bp, homo sapien
ttttcattattgttttcctaatccargtagttatttagttgtttgtttat

SEQ ID NO: 106913 - DNA, 50 bp, homo sapien
tggatatttttctaatgtgttgtgaygaagttaatgtgcaagattatctt

SEQ ID NO: 106914 - DNA, 50 bp, homo sapien
gcatatgtatcctttagtttgctcaygggtaagtcattttactgttttaa

SEQ ID NO: 106915 - DNA, 50 bp, homo sapien
atgttcccagtctattcaaatttcaygctctctcctctatcttgcagctc

SEQ ID NO: 106916 - DNA, 50 bp, homo sapien
aacttcctcatgtggcaatgctttcwaaagtaccagttgtcactgaccat

SEQ ID NO: 106917 - DNA, 50 bp, homo sapien
ctacctgcaggtaccccagccatccrcacttagctcttccctaagcctag

SEQ ID NO: 106918 - DNA, 50 bp, homo sapien
atctgcaggcagcaagctagataccyaagaaaaactgtggtttagttgaa

SEQ ID NO: 106919 - DNA, 50 bp, homo sapien
gcccagtgcctggatttggtcaggawcactcaaaaaatgatgggtatgat

SEQ ID NO: 106920 - DNA, 50 bp, homo sapien
cttacaatgtagtaagttaatttacratagtcttaatgcagcaaaattgt

SEQ ID NO: 106921 - DNA, 50 bp, homo sapien
ctccttaagaaatgtggtattaaacygatatatatttttaatgtaacttt

SEQ ID NO: 106922 - DNA, 50 bp, homo sapien
gtaatgtggcaaactggttctacacrcagttctggaagcaagaatgttaa

SEQ ID NO: 106923 - DNA, 50 bp, homo sapien
tggattctttgtgttggtttatgtaygttaggtaagacaactgcctctct

SEQ ID NO: 106924 - DNA, 50 bp, homo sapien
tatcttaatgtttctaaggtaaggargaatataaatttagaagcaggacc

SEQ ID NO: 106925 - DNA, 50 bp, homo sapien
ggggaaacgcttaaaatataatgtaytaaactgaagcaaggtgttgctaa

SEQ ID NO: 106926 - DNA, 50 bp, homo sapien
acatggaccaacggatgctcacgaamtgacgatggggttacactttcagt

SEQ ID NO: 106927 - DNA, 50 bp, homo sapien
cttcccttgcagagctttgagcaaaygtgtaatgtataattttcaggcca

SEQ ID NO: 106928 - DNA, 50 bp, homo sapien
ttaacacccatgttttgagggatccraaggcagaaatgttctttctcaac

SEQ ID NO: 106929 - DNA, 50 bp, homo sapien
tctctaactcaaatgtgaaatcatayattagcaggtcaagaagttaattg

SEQ ID NO: 106930 - DNA, 50 bp, homo sapien
agagagccccacggagagaaaatcaytgacactatgtgaggcgggactga

SEQ ID NO: 106931 - DNA, 50 bp, homo sapien
gaaatcccatcagagttttcatcccraatagtgcatgtcctacagcaaac

SEQ ID NO: 106932 - DNA, 50 bp, homo sapien
agagtgtctgtggcagtgacatattyggtgttcacattgaaactgtgcat

SEQ ID NO: 106933 - DNA, 50 bp, homo sapien
aaagaagaaactactgtaataattcycaacatgaattctcaacattctaa

SEQ ID NO: 106934 - DNA, 50 bp, homo sapien
ttaagttcatcaagctttatgaaagratatgaggcactaactagagcagt

SEQ ID NO: 106935 - DNA, 50 bp, homo sapien
agaacaccaggatatcggtggtataygccataagtttggatggaaggacc

SEQ ID NO: 106936 - DNA, 50 bp, homo sapien
gtattgtgtctttatgcaacactatsaagcagcaagtgggagccagacac

SEQ ID NO: 106937 - DNA, 50 bp, homo sapien
atctcagttattcattcctaagtaartagactcaacagtgaggtgcgagg

SEQ ID NO: 106938 - DNA, 50 bp, homo sapien
tggtgatggaaatgatttagatccayactgtcccaatttgagatgcccag

SEQ ID NO: 106939 - DNA, 50 bp, homo sapien
ccacactgcctccctccgagggcacygataacaaggaggagctcatcagc

SEQ ID NO: 106940 - DNA, 50 bp, homo sapien
caccctgtcctgtagacctgcgttcrtgggcaactgtactctccctcagc

SEQ ID NO: 106941 - DNA, 50 bp, homo sapien
tgtgctaccatgaaaatgtgctgttwtcagatgtgcagtgtccccagcag

SEQ ID NO: 106942 - DNA, 50 bp, homo sapien
acatttcccgtcaaagatgtgataaygttttagtaattttctataaggca

SEQ ID NO: 106943 - DNA, 50 bp, homo sapien
tgggatcacagccagaggtaaagaartcgtaagtgttcaaaattattagc

SEQ ID NO: 106944 - DNA, 50 bp, homo sapien
tacttttgtctccatgcagcttgaaygattaaatagaaaaaagcagattt

SEQ ID NO: 106945 - DNA, 50 bp, homo sapien
tccaaattaaatttaaagcaaaatgyaggagatattagtccacagcaaaa

SEQ ID NO: 106946 - DNA, 50 bp, homo sapien
cagatttgaatgtttaatatcatcargcagggatagttggatgcatctat

SEQ ID NO: 106947 - DNA, 50 bp, homo sapien
ctcagatctctcgtaatccatgcaamcttctgatgatttggctctctatg

SEQ ID NO: 106948 - DNA, 50 bp, homo sapien
tggatgaggagtggggtatgtaaaartttagcaaccagctttcaagtgag

SEQ ID NO: 106949 - DNA, 50 bp, homo sapien
taaatctgatctataaatctcatacraatctggaaattagacccagtttt

SEQ ID NO: 106950 - DNA, 50 bp, homo sapien
gtttgagagcgaaccacaatgaacayatataagccttcataaattgtttt

SEQ ID NO: 106951 - DNA, 50 bp, homo sapien
agattttttcatttaaaatgtttagkccggttgcggtcctgtaatcgcag

SEQ ID NO: 106952 - DNA, 50 bp, homo sapien
agcttctatccaccttgagaataagycaacaagataaactgttaaagaaa

SEQ ID NO: 106953 - DNA, 50 bp, homo sapien
cttagaaattcaagagagtatagtayccagatattggctattgaaagaag

SEQ ID NO: 106954 - DNA, 50 bp, homo sapien
gataccttttctattaacacttgcayggttgatccagggatgcagcgtct

SEQ ID NO: 106955 - DNA, 50 bp, homo sapien
tcagatttagagatgttcaaggatamcttttctattaacacttgcacggt

SEQ ID NO: 106956 - DNA, 50 bp, homo sapien
gaaagtctgataactatatcttgtgratggtggtcttgtataatatcttg

SEQ ID NO: 106957 - DNA, 50 bp, homo sapien
ccttggggacaattagaaatgaaccrcaaagggacacatcagctgctttg

SEQ ID NO: 106958 - DNA, 50 bp, homo sapien
ataaagttgtttttaaagagtttacygacaaatagtcctgagtaaaaaat

SEQ ID NO: 106959 - DNA, 50 bp, homo sapien
agaaggcactcatatagccattaggwccaatcctttctgccgccaacacc

SEQ ID NO: 106960 - DNA, 50 bp, homo sapien
agaatgtgtgactttgagcactaaakgttcaacaatacaaggcacagtta

SEQ ID NO: 106961 - DNA, 50 bp, homo sapien
ggccccattttgcttgcgctaaagcraaaaacacagagtctagcaaagaa

SEQ ID NO: 106962 - DNA, 50 bp, homo sapien
actctaatacaagggacgtatcacarcagagcatgtgtgaaatgattatt

SEQ ID NO: 106963 - DNA, 50 bp, homo sapien
tttcctcatctggcagatgaacaaaygatgagcctgttgagcagcctcac

SEQ ID NO: 106964 - DNA, 50 bp, homo sapien
acaacataattcagctaaaaggttarctccacatgccgttttatcatgat

SEQ ID NO: 106965 - DNA, 50 bp, homo sapien
gaagaataggtaaggagggattaacyctggactctgtatttgattccatt

SEQ ID NO: 106966 - DNA, 50 bp, homo sapien
gaaggagttgaattaatgaattgacrcattggggatcctataatcctttg

SEQ ID NO: 106967 - DNA, 50 bp, homo sapien
agaaaactccataagtttaagtttayatgctttggcattttatttttttt

SEQ ID NO: 106968 - DNA, 50 bp, homo sapien
ctgtacccccaaaactattgaaatartaatgataaaaacaagaaacacag

SEQ ID NO: 106969 - DNA, 50 bp, homo sapien
tagagatgttttaatgatgattgtawctacagtgtaattctagctttatt

SEQ ID NO: 106970 - DNA, 50 bp, homo sapien
tgtctagataagcggctataactaartattaaaatgataatatgacacac

SEQ ID NO: 106971 - DNA, 50 bp, homo sapien
catgttgtctttgttttgtcaactgyaaagactaatatcaacttcctaga

SEQ ID NO: 106972 - DNA, 50 bp, homo sapien
aaggtttgctttttctcatgggcacrataaattaaatacatcactgaggt

SEQ ID NO: 106973 - DNA, 50 bp, homo sapien
ggcaagttgtagtcttctctgttcaytctatcagttaaatttccctccat

SEQ ID NO: 106974 - DNA, 50 bp, homo sapien
tttattttttatattgtacatgatakaattgttttaattcattttccata

SEQ ID NO: 106975 - DNA, 50 bp, homo sapien
gacatttgaatgagagcttgaaggayaagtaaatgttgattgatgcagaa

SEQ ID NO: 106976 - DNA, 50 bp, homo sapien
atagcagtcaccattcaggatgaccrcgaatttcaggttaacatccaaag

SEQ ID NO: 106977 - DNA, 50 bp, homo sapien
agattcaatattgaaatggaaatgayctaaattcaactaaaatgtaaaga

SEQ ID NO: 106978 - DNA, 50 bp, homo sapien
ggacctgataacctgcaatcttaacraaagtgacttaacagatcttataa

SEQ ID NO: 106979 - DNA, 50 bp, homo sapien
taacattttcctatctatatgtatamaaataacatcacatggtaaacctc

SEQ ID NO: 106980 - DNA, 50 bp, homo sapien
gcttcctccttaaagtgaacccctayataaagcagtctgtggaccctcga

SEQ ID NO: 106981 - DNA, 50 bp, homo sapien
tctttttaatgggtgtgtaaccttargtatatctggtacatctctgcact

SEQ ID NO: 106982 - DNA, 50 bp, homo sapien
tagagtctctcactgtagaggaaaaytaccaatgcttcttaacctgggtt

SEQ ID NO: 106983 - DNA, 50 bp, homo sapien
tgatatgtctatttgatacccaatgkaaatgaaagtattgagtaattagg

SEQ ID NO: 106984 - DNA, 50 bp, homo sapien
tggtgctgattcttggtgcaaaaatmaccatgttacctgtgtttagaatc

SEQ ID NO: 106985 - DNA, 50 bp, homo sapien
atgtcatgctatgtgttaataactcrgaacatacacccagcaactctatg

SEQ ID NO: 106986 - DNA, 50 bp, homo sapien
gggaaaatcgcaaggtgaaatcatascagaatgtcattttcttgtgacac

SEQ ID NO: 106987 - DNA, 50 bp, homo sapien
ttattttccagttctggagtacctgmatcatacaattacaacttggtctt

SEQ ID NO: 106988 - DNA, 50 bp, homo sapien
gtgaaatctaaaaacttctttttgcscaatttgtaagacttatttgtggt

SEQ ID NO: 106989 - DNA, 50 bp, homo sapien
ctgtttcttgcatgtaagatgaaacrgcataatatatcaatggtttacgg

SEQ ID NO: 106990 - DNA, 50 bp, homo sapien
catggtattcctgttagatctataastaaacaatcactcctggcatctga

SEQ ID NO: 106991 - DNA, 50 bp, homo sapien
ccatatcaccttggtgcttagcttarcaatatatcacaatcctttgtgta

SEQ ID NO: 106992 - DNA, 50 bp, homo sapien
aaagccttggtctagtaattataaaraggtcacaaaagattatgacactc

SEQ ID NO: 106993 - DNA, 50 bp, homo sapien
gacagaaattcttgcttctcttccartcttcagttatgtctctctgggag

SEQ ID NO: 106994 - DNA, 50 bp, homo sapien
tgtttactgatggaaaaatttgatayataattgaaatagggccagttttt

SEQ ID NO: 106995 - DNA, 50 bp, homo sapien
gcagattctaggaaaacagttgttcsaaattgctcaatcaaaagaatggt

SEQ ID NO: 106996 - DNA, 50 bp, homo sapien
tccagtgatgcctggacagagtctgmatattatttaggcatatttgatac

SEQ ID NO: 106997 - DNA, 50 bp, homo sapien
tacaaaggagctttcttagaaaaggmtttgtgatctgtgcattcgtctca

SEQ ID NO: 106998 - DNA, 50 bp, homo sapien
tgttctgaaatgacattgtttctaaraattcattacttgcattatattca

SEQ ID NO: 106999 - DNA, 50 bp, homo sapien
agcccgagggaaaatgcaaagctggwcacagcgcagatggggagacctct

SEQ ID NO: 107000 - DNA, 50 bp, homo sapien
caataactaggtaatcatcttctaaygcaatcatctacatcaatcatgca

SEQ ID NO: 107001 - DNA, 50 bp, homo sapien
gttgactacttttttgtttcctcaastcatcaaattttgaattctttttc

SEQ ID NO: 107002 - DNA, 50 bp, homo sapien
cctgtcttagagaaagataagaaccrctgacagggaccacctttctccct

SEQ ID NO: 107003 - DNA, 50 bp, homo sapien
acatcttgccagctttccgtgattayggactattgcccacaaaatggttt

SEQ ID NO: 107004 - DNA, 50 bp, homo sapien
acagtgtgtcagaaactatggaaccrgagacagctttgcaagggtttttc

SEQ ID NO: 107005 - DNA, 50 bp, homo sapien
agaaggaggtcgattcagttcccgcraggacttttaggtgatgggatgct

SEQ ID NO: 107006 - DNA, 50 bp, homo sapien
acccctcttctttattaaagaaccaygcagaagtgctcaggaaattactg

SEQ ID NO: 107007 - DNA, 50 bp, homo sapien
tccatggggagtgagtttggagagaratataagggataaatctgggcttt

SEQ ID NO: 107008 - DNA, 50 bp, homo sapien
accctccttcctgggaccctgttcayaagtctatgcatctgtagcaatgt

SEQ ID NO: 107009 - DNA, 50 bp, homo sapien
tgagaaattagataatttatcaaaamtggcctttacttttaaaaatgttt

SEQ ID NO: 107010 - DNA, 50 bp, homo sapien
caaaaagttaatcactctttctaaaygctaaagtagttaatcacactttc

SEQ ID NO: 107011 - DNA, 50 bp, homo sapien
ttcagaagaaataggtaggacaaccraagttgatgctttaaggaaacaaa

SEQ ID NO: 107012 - DNA, 50 bp, homo sapien
ttgggagtagaacgttgtttttaaakatggtcggattacactgtctccag

SEQ ID NO: 107013 - DNA, 50 bp, homo sapien
tcgacttcatctttcctcattaaacrgatcacctttgagcacccctaact

SEQ ID NO: 107014 - DNA, 50 bp, homo sapien
ggaaagtagaaaaatatacagacacraaaataggtcatgttttccttcca

SEQ ID NO: 107015 - DNA, 50 bp, homo sapien
tttattcatttgtctattgcttatcratcagtcaatttttaatgtggctt

SEQ ID NO: 107016 - DNA, 50 bp, homo sapien
gtaactccaagtaaaatcatttaaasaactgaataaatactgtataagtg

SEQ ID NO: 107017 - DNA, 50 bp, homo sapien
atcttttcactgtgtgtttaacgatsaatttatatttcctttgtgtgaga

SEQ ID NO: 107018 - DNA, 50 bp, homo sapien
ttgtgttctctcttatttccttgagwagtcattatgggttctccttgaag

SEQ ID NO: 107019 - DNA, 50 bp, homo sapien
catgaggaaacctggaatgtcaaagrtaaagtgcaacacattctgcattt

SEQ ID NO: 107020 - DNA, 50 bp, homo sapien
tgattttgaaaaagtctgtcctagawacagtgttatttgaaatttgtgtc

SEQ ID NO: 107021 - DNA, 50 bp, homo sapien
atcaggaaactgggaaactctcaacyggataccaaccaaagacatctctt

SEQ ID NO: 107022 - DNA, 50 bp, homo sapien
gttttcctgatatcattgagttaccyatctgtattgttttgcatcttgag

SEQ ID NO: 107023 - DNA, 50 bp, homo sapien
cggagatctctctctctcttcatgasgctcttagtctaatggagagaggt

SEQ ID NO: 107024 - DNA, 50 bp, homo sapien
caaaattgagacccacaaatccacayaaaaggtcaaggaaatcaaaattg

SEQ ID NO: 107025 - DNA, 50 bp, homo sapien
aaaacgccaaccatgctcacagacckcagtgaaagaaaaatagaaatcaa

SEQ ID NO: 107026 - DNA, 50 bp, homo sapien
ttcgtaatagagaatgataaaagagsacgattgatatggcaaagcaaacc

SEQ ID NO: 107027 - DNA, 50 bp, homo sapien
atttcactaaaagcaagtaaagagartaacaggaactaaatatttcataa

SEQ ID NO: 107028 - DNA, 50 bp, homo sapien
tttagaattgtagaaatacctgatcrctcagacaatttacactgaattcg

SEQ ID NO: 107029 - DNA, 50 bp, homo sapien
tgactgccacttaataaaccgccaaygaatgtgtgctgaaaaagtgaaag

SEQ ID NO: 107030 - DNA, 50 bp, homo sapien
atgaacagaaatgtcttccaattgcwgcaattcggttcagtgctacctgc

SEQ ID NO: 107031 - DNA, 50 bp, homo sapien
ttcaggcatccactaggggtcttaarcttgctaggataagaagggactaa

SEQ ID NO: 107032 - DNA, 50 bp, homo sapien
attctagttcactttagtgtgatagyacatacatctaatgagtatcatat

SEQ ID NO: 107033 - DNA, 50 bp, homo sapien
tgtataaattaataagttttagagayccaaaatgagaattttaaaataaa

SEQ ID NO: 107034 - DNA, 50 bp, homo sapien
tgggcagatgccttggtaatctcaarctttcaaaagagaatatcaacact

SEQ ID NO: 107035 - DNA, 50 bp, homo sapien
gtttccattgtagatcactatactcstaaagaaataaaatgatttcatca

SEQ ID NO: 107036 - DNA, 50 bp, homo sapien
ccagttgagaaactcaagagaataartaagttatggagttggagacccca

SEQ ID NO: 107037 - DNA, 50 bp, homo sapien
gaattgcctcctctcagtccttgtcracaaaatggatgttaaaggataac

SEQ ID NO: 107038 - DNA, 50 bp, homo sapien
cctcaggcccataattctcatgttayctgtagaagcaggatggccctgac

SEQ ID NO: 107039 - DNA, 50 bp, homo sapien
ggcacaaatatttgggtcagagcaartatcatttataatagcaaataaac

SEQ ID NO: 107040 - DNA, 50 bp, homo sapien
acttcagggaggggttagttatggaygaaatcaaaggacaccgagggaaa

SEQ ID NO: 107041 - DNA, 50 bp, homo sapien
aggtattcacgtatatttaaatagcraacagccataaatagagatcctat

SEQ ID NO: 107042 - DNA, 50 bp, homo sapien
gaccatgacatgtcacggaagagaaraattcaggaatcaaatttacctag

SEQ ID NO: 107043 - DNA, 50 bp, homo sapien
ttaaaattacctctgtttttttctaygagattctactataagatggaatt

SEQ ID NO: 107044 - DNA, 50 bp, homo sapien
aaaaagtatggtgtgccaattattasatgacagctgatactttttatctg

SEQ ID NO: 107045 - DNA, 50 bp, homo sapien
acagtttagctgatgacaccaataartaaataatggaaaagtgcataggc

SEQ ID NO: 107046 - DNA, 50 bp, homo sapien
gctcataagatacaagaaaacacaartagataaatcaatgaaatcaggaa

SEQ ID NO: 107047 - DNA, 50 bp, homo sapien
aatgtattatgttataaacactttamatagatcttgtgctttataaatat

SEQ ID NO: 107048 - DNA, 50 bp, homo sapien
ggctagggatctctctcaaaccgcakaggctatcttaggttctagatact

SEQ ID NO: 107049 - DNA, 50 bp, homo sapien
accatgtggtctctgcgcactctaaygtttaaagtgtcaagaggttattg

SEQ ID NO: 107050 - DNA, 50 bp, homo sapien
gacacagacattattttgttcatcakatggccaagtcaaatatgacaaat

SEQ ID NO: 107051 - DNA, 50 bp, homo sapien
cacttcagaaatttaagcaaatgaayatctttacctttatgccacattgg

SEQ ID NO: 107052 - DNA, 50 bp, homo sapien
aatgtaaatcttgccggaagaaacartggaggtagagaaggtgattagtg

SEQ ID NO: 107053 - DNA, 50 bp, homo sapien
aggctggaggtgggtttttagaagcsgactcccagagagacagtgtctag

SEQ ID NO: 107054 - DNA, 50 bp, homo sapien
cagattctagttcgtgcagctactaygtgaattgtggttgggaaattgtc

SEQ ID NO: 107055 - DNA, 50 bp, homo sapien
ctttaatttacatgtcttttaactgmactcaggattttgacaacaaagta

SEQ ID NO: 107056 - DNA, 50 bp, homo sapien
ggaaatcagctaccatgaagaaagcrgatgcatttaatccttcttgattt

SEQ ID NO: 107057 - DNA, 50 bp, homo sapien
taatgtgggaaaagtctgcctgtcaycctttgaatgatacaacatatatt

SEQ ID NO: 107058 - DNA, 50 bp, homo sapien
tctatgtgagaagaatgttttctcaraagataggatattaacctgctgct

SEQ ID NO: 107059 - DNA, 50 bp, homo sapien
cctctggtctcccaaccactactcayattacttctgtcattctcacggga

SEQ ID NO: 107060 - DNA, 50 bp, homo sapien
gatgctttttcctctgcgttttctaygggattatagcatttttggccaaa

SEQ ID NO: 107061 - DNA, 50 bp, homo sapien
agaaacactcagcagccatatattaycgtttatgcttttattttatacca

SEQ ID NO: 107062 - DNA, 50 bp, homo sapien
atttctgaagtcacacccatttggayatgatgaataggaagggcacaaaa

SEQ ID NO: 107063 - DNA, 50 bp, homo sapien
aaggatctatttttcttcggttccartaaggatgaaataacagcaagaaa

SEQ ID NO: 107064 - DNA, 50 bp, homo sapien
taaaagcacaagtctgtcctaactakagtagtattaaaatgtgactattt

SEQ ID NO: 107065 - DNA, 50 bp, homo sapien
gagagagtcctgtgtttagcattggyactaaggctgatatttactaagag

SEQ ID NO: 107066 - DNA, 50 bp, homo sapien
aacagtgaccgcaggaggctctttgracaataacttttctgtcttggcaa

SEQ ID NO: 107067 - DNA, 50 bp, homo sapien
aatgccgcttgcaaacttaaaccaargacgactcttgctaagtctttacc

SEQ ID NO: 107068 - DNA, 50 bp, homo sapien
taaggcctaaattgaaaactctagcrctttagtcatggaggaacagtatg

SEQ ID NO: 107069 - DNA, 50 bp, homo sapien
aaaaaaaaattacaaatggggcaaayagtctagtgtaatggatcaaatta

SEQ ID NO: 107070 - DNA, 50 bp, homo sapien
tttactattaagaactgtacagatayactcagtgttagaaataagtgaca

SEQ ID NO: 107071 - DNA, 50 bp, homo sapien
tcagaatcatgcttctgacccattargagaggctaactcttgttattttg

SEQ ID NO: 107072 - DNA, 50 bp, homo sapien
aataaaattggatacctttttgtaartatctccataagtttcaaaaatgt

SEQ ID NO: 107073 - DNA, 50 bp, homo sapien
cattgtcaagaacacaactttgaatsgttatataatatcttttcccatga

SEQ ID NO: 107074 - DNA, 50 bp, homo sapien
aagtaactctggcctttaacgtttaygagcttagcaggtctctggccgag

SEQ ID NO: 107075 - DNA, 50 bp, homo sapien
ttggataatcttaatgaaaataatgkactagaatatggagagagcagtta

SEQ ID NO: 107076 - DNA, 50 bp, homo sapien
atttattgctctgaattaatttcacrgaatatggcaatttagtagtggtt

SEQ ID NO: 107077 - DNA, 50 bp, homo sapien
gaataaaaacaagactgttatgtcawgataaagtatcatctgggtctgct

SEQ ID NO: 107078 - DNA, 50 bp, homo sapien
tttgggaagaagcacaaatagggcamaagaacatataaagagaggtgtag

SEQ ID NO: 107079 - DNA, 50 bp, homo sapien
ccttcatttgaggtttctacagagtracaaaacaaaacaataattgtaaa

SEQ ID NO: 107080 - DNA, 50 bp, homo sapien
gtgttgtcggggaggcaggttcctaktaaactctacattaagctagatgc

SEQ ID NO: 107081 - DNA, 50 bp, homo sapien
atacgaggagaaaaacagaggggacragagataagttcaatgagattacc

SEQ ID NO: 107082 - DNA, 50 bp, homo sapien
tttgaaattcgaaaccctgcttctgrgttagacacacttggtcatccttt

SEQ ID NO: 107083 - DNA, 50 bp, homo sapien
taatcagtgtcatgtgccagattccrattcactaacagtgtgcctgtatg

SEQ ID NO: 107084 - DNA, 50 bp, homo sapien
tttcaatgtcaactttccatccaaaracataataagatgggaacctttag

SEQ ID NO: 107085 - DNA, 50 bp, homo sapien
aatcttatttcctaccttttcattayccagttccatttttgtatacttaa

SEQ ID NO: 107086 - DNA, 50 bp, homo sapien
agggatcagcaggtgccaccagggcrgatgtaaatgatgtccttgagaag

SEQ ID NO: 107087 - DNA, 50 bp, homo sapien
aaaggttcctcttaggtgtaagctcyagtatatttttaattgaactcctc

SEQ ID NO: 107088 - DNA, 50 bp, homo sapien
tatctcatttctaagaacaccatgayccattaactattaccacaggtgag

SEQ ID NO: 107089 - DNA, 50 bp, homo sapien
attactattctagcctaaaatatgaktacaggaagaaattatacagctgt

SEQ ID NO: 107090 - DNA, 50 bp, homo sapien
ctctctcagctgtcctttcatgaaayttgtctatttgggtataaatccac

SEQ ID NO: 107091 - DNA, 50 bp, homo sapien
aaagttagaccaagagtgcacaataygaaattattataaaaatgctgcag

SEQ ID NO: 107092 - DNA, 50 bp, homo sapien
aataaatcatttaattgtgaaagaargacataaaaaggagagtaaacaca

SEQ ID NO: 107093 - DNA, 50 bp, homo sapien
gtcttttagttttcctttagctaaakcctattctatgaacttataattca

SEQ ID NO: 107094 - DNA, 50 bp, homo sapien
cattttcaaatggcatattttccatkactatcatgttcttcttagaacta

SEQ ID NO: 107095 - DNA, 50 bp, homo sapien
atctgaagagcatgttaaagtatgaraaggagacacttccataggggtgg

SEQ ID NO: 107096 - DNA, 50 bp, homo sapien
ttattcattatcttatcggtcttgasgtatttcaatggcaggtgcagcat

SEQ ID NO: 107097 - DNA, 50 bp, homo sapien
tatgtaagcttataatattcttacamgagaaaagtaattcaaaatattaa

SEQ ID NO: 107098 - DNA, 50 bp, homo sapien
agatgttagtttccactgtaaaaackgtccgataatataaagaatagagt

SEQ ID NO: 107099 - DNA, 50 bp, homo sapien
aaaaaaattatacaggctctttatgraattcttagaaacacaaaattatt

SEQ ID NO: 107100 - DNA, 50 bp, homo sapien
gtagggagagctggactaaagcctgkaagactagagagatgtgtccccac

SEQ ID NO: 107101 - DNA, 50 bp, homo sapien
aaaaagatatcatcatcggagcctcyacatttttaaatacacattttata

SEQ ID NO: 107102 - DNA, 50 bp, homo sapien
atatgaactaagactcacggaaacasaactgaaaataatcattcaacatg

SEQ ID NO: 107103 - DNA, 50 bp, homo sapien
taggaatcaggagatctgaaggtaamaatatttagaacagaaatatattt

SEQ ID NO: 107104 - DNA, 50 bp, homo sapien
ttcttaagctcgtgatttttatttaygatacatgcagttcacttctcaaa

SEQ ID NO: 107105 - DNA, 50 bp, homo sapien
actgtcatttggtatttcaaaaacaytcacagtacacatggttggtctaa

SEQ ID NO: 107106 - DNA, 50 bp, homo sapien
aaacatctgatttccaggagggtcaygttgggaagtcaagaacagcacca

SEQ ID NO: 107107 - DNA, 50 bp, homo sapien
agagtctgaatcacacaccaagtaartaagagatccagattttaagctct

SEQ ID NO: 107108 - DNA, 50 bp, homo sapien
cctcaaatcccaccaggagcaattaygtttctctagtttctgcctacatt

SEQ ID NO: 107109 - DNA, 50 bp, homo sapien
ttaaaatacttccattctttactcartctttcatagataaatacattttt

SEQ ID NO: 107110 - DNA, 50 bp, homo sapien
aaaagaagatcaacaatgccttaaaycaactagaccgaacaaatatctac

SEQ ID NO: 107111 - DNA, 50 bp, homo sapien
gtgtcccattttgcaatttaaaaagycgaggctcagacaaatgtcacaca

SEQ ID NO: 107112 - DNA, 50 bp, homo sapien
tagaataggagtttgccaccctagtracacattagaatcatctggagatg

SEQ ID NO: 107113 - DNA, 50 bp, homo sapien
tagtgaattcttaatagtcctcctarcatcctaaagaaatgaacttgtac

SEQ ID NO: 107114 - DNA, 50 bp, homo sapien
ccctattttgcagagcctcacaggaygtaaagatcagagaaaagataggt

SEQ ID NO: 107115 - DNA, 50 bp, homo sapien
aaagagaggatacattagccttccaytgagatactgactttgaactcaga

SEQ ID NO: 107116 - DNA, 50 bp, homo sapien
tagccctattaagaacacaatggaaygacttattaaacttgggtttaaat

SEQ ID NO: 107117 - DNA, 50 bp, homo sapien
aatttttctgaattctatttttaccyaagtcaactaatctttcaacatca

SEQ ID NO: 107118 - DNA, 50 bp, homo sapien
atgtggacatcacagcccacatgacyaagctctgtccatacatacatccc

SEQ ID NO: 107119 - DNA, 50 bp, homo sapien
tgcacgagcatgtgtttagtgtcaaytctgcgatccagaccctgcctggt

SEQ ID NO: 107120 - DNA, 50 bp, homo sapien
ggcagggtattatgctgtggcttaaytctgtttagtaaacactttatact

SEQ ID NO: 107121 - DNA, 50 bp, homo sapien
cacttcccacaagcctaaaataggayctaagtgtatatacctaccattgc

SEQ ID NO: 107122 - DNA, 50 bp, homo sapien
ctgccttcaactcctcatgttttacraagtaggaatccacagagaatagc

SEQ ID NO: 107123 - DNA, 50 bp, homo sapien
acacacttttttttgtgggaatgcamtgattcaaaaatagtcatgtgttt

SEQ ID NO: 107124 - DNA, 50 bp, homo sapien
tagagctaagagctgggcaaaaacayactctttcataccaagaagctttt

SEQ ID NO: 107125 - DNA, 50 bp, homo sapien
cacgtcataatatctagcatggcaaycctaatcattttgtttttgaagtt

SEQ ID NO: 107126 - DNA, 50 bp, homo sapien
cagcagggctggtattcactgcaagsaaccacgctcggtactcattggat

SEQ ID NO: 107127 - DNA, 50 bp, homo sapien
gggtgtgtgcctctgatgtccttcartatcaatctttctttggagaagca

SEQ ID NO: 107128 - DNA, 50 bp, homo sapien
ccaagggcatggcttcctctttgcasattgtctcatatctctgacctgga

SEQ ID NO: 107129 - DNA, 50 bp, homo sapien
tggaagtcctcctgcagatgtcagcrgccatttgttttcaatgaccacaa

SEQ ID NO: 107130 - DNA, 50 bp, homo sapien
aagactggctgacttcctggcagatktatcctaaagaaaaattgaaactg

SEQ ID NO: 107131 - DNA, 50 bp, homo sapien
atgctaaccagtgcatactggaatgsataagattaatgaagcctttggtt

SEQ ID NO: 107132 - DNA, 50 bp, homo sapien
tagcagtgtgagaaaggactaataamatttcacagtcttaaactctagat

SEQ ID NO: 107133 - DNA, 50 bp, homo sapien
gtcttcatatcttgacttcgttatcyctgcagtatttggtaccataaaat

SEQ ID NO: 107134 - DNA, 50 bp, homo sapien
taaaatctgcctttcagtaagcttakctccatattttgaggtctctagat

SEQ ID NO: 107135 - DNA, 50 bp, homo sapien
ctggctaagtggactgtcagtcatakgtggactttgcaagtactgataag

SEQ ID NO: 107136 - DNA, 50 bp, homo sapien
tgtaaaccttaatgattaccacttgratacttaaagttctgcaattgctc

SEQ ID NO: 107137 - DNA, 50 bp, homo sapien
gaaaccacgttataacccacagcatractgaatataggactaaatactag

SEQ ID NO: 107138 - DNA, 50 bp, homo sapien
ttgctctttcatatggtcaagaagcraggtttcacattggtttaaacagg

SEQ ID NO: 107139 - DNA, 50 bp, homo sapien
tatatgtatccattggcttacttackctttaaggacttaggctttgaggt

SEQ ID NO: 107140 - DNA, 50 bp, homo sapien
cctcattttacattcatttaacctgycaattaatttattttattgtagtt

SEQ ID NO: 107141 - DNA, 50 bp, homo sapien
ctttgctacatacacacatttgcackcttgaccaataatctcaaagaact

SEQ ID NO: 107142 - DNA, 50 bp, homo sapien
ttggtcacatgatattaatgaaagamagcacatagtttccccaaagctaa

SEQ ID NO: 107143 - DNA, 50 bp, homo sapien
gaagaatgagtactagaatactagcragagaatccttgttctagtgcctc

SEQ ID NO: 107144 - DNA, 50 bp, homo sapien
gtcgatcctgataaaatagcatccaycagtagtttagtgagcgactacta

SEQ ID NO: 107145 - DNA, 50 bp, homo sapien
atttccattgatttagttacaggtcrgaagtgaaagcaaggcaagatgtg

SEQ ID NO: 107146 - DNA, 50 bp, homo sapien
aggggcacctagaatttcgtttacawgcagttgttaaaagaagccacatg

SEQ ID NO: 107147 - DNA, 50 bp, homo sapien
gggtcagtgccactgaacacctttaygtaactcacttactggggtaaaag

SEQ ID NO: 107148 - DNA, 50 bp, homo sapien
atggataaatacataaataaatagcrgatgagtagtaatggaataaacta

SEQ ID NO: 107149 - DNA, 50 bp, homo sapien
gaacaaaaaacgcatgctctaatcaytgaattaaatagcacacgtatgaa

SEQ ID NO: 107150 - DNA, 50 bp, homo sapien
ggtctccactgtgttccctgtaaagycaagtggttgagctggatgccctt

SEQ ID NO: 107151 - DNA, 50 bp, homo sapien
tttctagctcctgggccaaggttcckgagatttttgccagccctcttcta

SEQ ID NO: 107152 - DNA, 50 bp, homo sapien
ctgtaactccaggaaatggtcctacrgagagaactaaagagaaactacga

SEQ ID NO: 107153 - DNA, 50 bp, homo sapien
agaagaacattgtatgtcagagtctragaaaaaattcagctaaaagtaaa

SEQ ID NO: 107154 - DNA, 50 bp, homo sapien
cagcacccggccactatgggccacaytcttgaggacagaggcatttctac

SEQ ID NO: 107155 - DNA, 50 bp, homo sapien
agttaggggtagagagtttgttcaayggaataataatacagaacttccca

SEQ ID NO: 107156 - DNA, 50 bp, homo sapien
gtagaattaagtttgaggaagattcraggatatggattaaacagtcattc

SEQ ID NO: 107157 - DNA, 50 bp, homo sapien
ctcagcatcagcctctgtacttaaamattaggaaagaaaacaaaattggc

SEQ ID NO: 107158 - DNA, 50 bp, homo sapien
aatttccaaagagtagcctgattgcyataaagccctctctgccttcacaa

SEQ ID NO: 107159 - DNA, 50 bp, homo sapien
gacgacatttcccttatcatcctaaraaaaattaaccagatgtttattaa

SEQ ID NO: 107160 - DNA, 50 bp, homo sapien
ggagctaagccttattcacctcttgsacctagcatagtacagtcatctct

SEQ ID NO: 107161 - DNA, 50 bp, homo sapien
ctatggtttgatgattctgttttgaytaaggttgaatcttttgaaattta

SEQ ID NO: 107162 - DNA, 50 bp, homo sapien
atagtctggctgctgctttccactargagtcttaactatatatttgagat

SEQ ID NO: 107163 - DNA, 50 bp, homo sapien
tcaaattaaataacctttgtagagcrattccaggaagtataaagttcata

SEQ ID NO: 107164 - DNA, 50 bp, homo sapien
atcaagccaatctcaactgaagttaycttgtgtctgcctcacctttgtga

SEQ ID NO: 107165 - DNA, 50 bp, homo sapien
gtgcgcacacacacaacacattgaamactttattgtttctgtagtgatgg

SEQ ID NO: 107166 - DNA, 50 bp, homo sapien
ctttggtgctgtaacagtccctcaakaattgtgttctcttgggtaggaag

SEQ ID NO: 107167 - DNA, 50 bp, homo sapien
tgaaactgaatgagtcttccatagaraccatgttataagagttgttaaag

SEQ ID NO: 107168 - DNA, 50 bp, homo sapien
agaattcattctgagaaggtcattayacattgaagatgaaatgtgatttt

SEQ ID NO: 107169 - DNA, 50 bp, homo sapien
tcttatatatgtgtgaaatgacttaygtactaggttgtttactataataa

SEQ ID NO: 107170 - DNA, 50 bp, homo sapien
acagtcattctcaacagtggtcatgraggtacaagttattgttatgggac

SEQ ID NO: 107171 - DNA, 50 bp, homo sapien
acttcagcattttacttagtcgatayatctcttcgtgtgactcaaagtat

SEQ ID NO: 107172 - DNA, 50 bp, homo sapien
cttttagtagctgttttacaagaatsagaaagtactgtagagactgtctg

SEQ ID NO: 107173 - DNA, 50 bp, homo sapien
atagcaaccagatttcctaatatccratctagtgttatacttgaaagcaa

SEQ ID NO: 107174 - DNA, 50 bp, homo sapien
gttttatcatttttgaagctttaacmacataaaatatatgtgcattaatc

SEQ ID NO: 107175 - DNA, 50 bp, homo sapien
tttatctaagtttctacaaatcaaawagacgagttttctgcttttttttt

SEQ ID NO: 107176 - DNA, 50 bp, homo sapien
gttgaaaaccccatttcgtgattaaygcaatggagtcccagggaagttcc

SEQ ID NO: 107177 - DNA, 50 bp, homo sapien
tctcaactaaaatcagggattgctasttcctgtcaatcgcagctttatcc

SEQ ID NO: 107178 - DNA, 50 bp, homo sapien
tttgtttcttagaagagagagagtayaatcaggagtgctgctgcttacaa

SEQ ID NO: 107179 - DNA, 50 bp, homo sapien
atgtgagttggcatgtttaaattgtygtaatctgagtgagtgtgtgtgtg

SEQ ID NO: 107180 - DNA, 50 bp, homo sapien
tccacagatgttcctagttcaacaartggaaaaatacttgggtttctcta

SEQ ID NO: 107181 - DNA, 50 bp, homo sapien
gcaaaatgatttgtctcctctaaacratgtcaattactgctttgcaaaca

SEQ ID NO: 107182 - DNA, 50 bp, homo sapien
caaatgtgacagagaaccagcatatsacagtgaataagcatgcagtctct

SEQ ID NO: 107183 - DNA, 50 bp, homo sapien
taggcagattctagctctgacttacygaatgctcaactgtatttccccta

SEQ ID NO: 107184 - DNA, 50 bp, homo sapien
tgctccctttccactcagcctaacayggagcacagtgaactgtaatcact

SEQ ID NO: 107185 - DNA, 50 bp, homo sapien
acttgcaaaagccaaatagttattgraatctttatcaaaacggaggtctt

SEQ ID NO: 107186 - DNA, 50 bp, homo sapien
attacattgattccggacccacagayggcaatcactacatcccttttcga

SEQ ID NO: 107187 - DNA, 50 bp, homo sapien
cttcacagaattagaaaaaaaactayaccagaattcatatgaaaccaaaa

SEQ ID NO: 107188 - DNA, 50 bp, homo sapien
aggtcagttctctttaggcctttggkattcctgtcttagttgttgtaaga

SEQ ID NO: 107189 - DNA, 50 bp, homo sapien
acactgatgtctccaactgtaagctmttattatatggtcatcctagaatt

SEQ ID NO: 107190 - DNA, 50 bp, homo sapien
ctagcgacagattcctgtctcagtcrcagttatacatcagcacgtcccaa

SEQ ID NO: 107191 - DNA, 50 bp, homo sapien
atgttggctttcttgaaaatacaccrgagaccagagaaggtcaccatgtg

SEQ ID NO: 107192 - DNA, 50 bp, homo sapien
ttcaggggatcactggatctaaagcyattccttatgggaaatgttggctt

SEQ ID NO: 107193 - DNA, 50 bp, homo sapien
ggcttcgggaagcatttggtcctcayagttatccaataccagcatggccc

SEQ ID NO: 107194 - DNA, 50 bp, homo sapien
gaagtaaagctctgcaggatgtataygacaatgattttttttttttgagc

SEQ ID NO: 107195 - DNA, 50 bp, homo sapien
tttacttcttgtgaactttgttccargtctgaagtaaagctctgcaggat

SEQ ID NO: 107196 - DNA, 50 bp, homo sapien
tgcattgatataaatttgttcagtcktctaataattttattctacaccca

SEQ ID NO: 107197 - DNA, 50 bp, homo sapien
tactttgaagtctcctggtttttctkaaaatcacatgacttttgcacaac

SEQ ID NO: 107198 - DNA, 50 bp, homo sapien
agaaagtagaaagctaacaaattcaygatactattttaagtaaaaaagca

SEQ ID NO: 107199 - DNA, 50 bp, homo sapien
ttgccattgataatctggtttcacartgacatatctaggtatggattttc

SEQ ID NO: 107200 - DNA, 50 bp, homo sapien
ttgcttcttcaacgtgtcttctttaycgcttaatgaagttctttgttttc

SEQ ID NO: 107201 - DNA, 50 bp, homo sapien
tccaccaccaccatcactaacaaaawtctaacaataccaagtgcctgtga

SEQ ID NO: 107202 - DNA, 50 bp, homo sapien
aagaatatttgtgattggagaaaacraagaacttcattaagcggtaaaga

SEQ ID NO: 107203 - DNA, 50 bp, homo sapien
gtctactgataacaagtcctatgacratttatttatgtatatattttttg

SEQ ID NO: 107204 - DNA, 50 bp, homo sapien
agatacgttgaattaggtcatctcartacccatttggtcccttttccttt

SEQ ID NO: 107205 - DNA, 50 bp, homo sapien
actgaattagttacctaccatgaaaygtgcatatactggcctaatgaaat

SEQ ID NO: 107206 - DNA, 50 bp, homo sapien
cacgttttagctcttcctgtacccgraatatatggtatgtagcatgaaag

SEQ ID NO: 107207 - DNA, 50 bp, homo sapien
acaagctaagtactaaaccaatcttrttgttgtgaaattaacattttctg

SEQ ID NO: 107208 - DNA, 50 bp, homo sapien
ttcttcagtttaataatcttagtaartgttttatgtagaagccttatacc

SEQ ID NO: 107209 - DNA, 50 bp, homo sapien
aaataactgatttctaagttggagayatactatgtaactgtattaagtca

SEQ ID NO: 107210 - DNA, 50 bp, homo sapien
gaagaaaccatccagttgtcaagcaraagtaatatggtcagctctatggg

SEQ ID NO: 107211 - DNA, 50 bp, homo sapien
cccattttagccatttttaagtatasgattcagtggcatcaagtacattc

SEQ ID NO: 107212 - DNA, 50 bp, homo sapien
atcaacctgacacatgacttttcagkatatattcttacccaagacagggt

SEQ ID NO: 107213 - DNA, 50 bp, homo sapien
taagaatttatattgagaaaatggcrataaaaagaagaagaatcctatca

SEQ ID NO: 107214 - DNA, 50 bp, homo sapien
aacagtgatccaaatactctaattaygacccagcctgttacagaggggct

SEQ ID NO: 107215 - DNA, 50 bp, homo sapien
tcaagtgacagtagaaaatactgcarttactgatatggatatgacctaaa

SEQ ID NO: 107216 - DNA, 50 bp, homo sapien
atccacaggtcatttttctctctccrgaaactcaatctcagtctttacat

SEQ ID NO: 107217 - DNA, 50 bp, homo sapien
ggcagagatgggataacatgttatayacccttttcatggctggcacatat

SEQ ID NO: 107218 - DNA, 50 bp, homo sapien
aaggatatttagtagagtttaacagratctatgtcataaataaagtttcc

SEQ ID NO: 107219 - DNA, 50 bp, homo sapien
agctaatcacatcaggcttgctgtgwaactaatgctcagttggttagtcg

SEQ ID NO: 107220 - DNA, 50 bp, homo sapien
tagtggatgaggaagagaataatgaygagagaacaagctggggtcactgg

SEQ ID NO: 107221 - DNA, 50 bp, homo sapien
tgatggaagaagataggtggctagamccagaatcaataagaaaggggcca

SEQ ID NO: 107222 - DNA, 50 bp, homo sapien
ggaacatgcaaagcagttcaacagtsaaaagacaggtttattgtggagaa

SEQ ID NO: 107223 - DNA, 50 bp, homo sapien
atgtatctaaaatctactaagtgacyattcatccactgaactcttaatga

SEQ ID NO: 107224 - DNA, 50 bp, homo sapien
tttcagtggatatgagatctcattcyctttaatattgcagtatttatgaa

SEQ ID NO: 107225 - DNA, 50 bp, homo sapien
agacaaataactcatttaacttgccygagatatttttacttattgatatg

SEQ ID NO: 107226 - DNA, 50 bp, homo sapien
aggtttctcaatcaggatcaattccrgagaagagtggaggtgggatccaa

SEQ ID NO: 107227 - DNA, 50 bp, homo sapien
aagaacagcctaatacacctggttasattcaggttaaacatttttggcat

SEQ ID NO: 107228 - DNA, 50 bp, homo sapien
ctgttgtactatttctgtggtccttraactctgatggcaacctaccttga

SEQ ID NO: 107229 - DNA, 50 bp, homo sapien
agagtgattcagaagtattcttctayctaccaaaagaaattgtagtgaat

SEQ ID NO: 107230 - DNA, 50 bp, homo sapien
ataagagatacagatagagagatggyaaaatccatggcatatctgtgacg

SEQ ID NO: 107231 - DNA, 50 bp, homo sapien
ttgtcagaccgatgagcgaggctccrtgcagacaggtgacatattcgagg

SEQ ID NO: 107232 - DNA, 50 bp, homo sapien
ctactaattttgaaactactggcaasatgaaggattgctttatgaagttt

SEQ ID NO: 107233 - DNA, 50 bp, homo sapien
tggaatgctgaatttatagtctacayatagtttaaatggaataaaagagt

SEQ ID NO: 107234 - DNA, 50 bp, homo sapien
tccagaaagcaattatatccagcaartcaactatgaattttttttttttt

SEQ ID NO: 107235 - DNA, 50 bp, homo sapien
cccagtggggagagtggtgttcagtytcacccattagagctccctacaac

SEQ ID NO: 107236 - DNA, 50 bp, homo sapien
agttgctggtaacaattcagttagamcagagtgctgagagcaaaaggagc

SEQ ID NO: 107237 - DNA, 50 bp, homo sapien
cacagattacccctgagagcacatcratatatattaccaaggatacttat

SEQ ID NO: 107238 - DNA, 50 bp, homo sapien
aagaatttatctgcattttaggtaawcttatctagccacagtactatgat

SEQ ID NO: 107239 - DNA, 50 bp, homo sapien
ctaacctctcctgccttatcactaayggaagctccttttgctctcagcac

SEQ ID NO: 107240 - DNA, 50 bp, homo sapien
accaatggggataatttgtgttatarcttgcacttctattatgaggagga

SEQ ID NO: 107241 - DNA, 50 bp, homo sapien
cagaaaattgaagtgcaaaatctaamggcgtaaattgttcagagcacatt

SEQ ID NO: 107242 - DNA, 50 bp, homo sapien
cttgtccacaactagattgactgagyatatgtatatgtgtgtatgtagca

SEQ ID NO: 107243 - DNA, 50 bp, homo sapien
tgaaacattaaaaacattaaaacaartaatgtcattaaaaacaaatagtg

SEQ ID NO: 107244 - DNA, 50 bp, homo sapien
taaacagggattcaagagaataaaarctaaagatactagaacttttaatg

SEQ ID NO: 107245 - DNA, 50 bp, homo sapien
cttttggtaattgcattgggtagaamcgtacatgtagaaaattggaactt

SEQ ID NO: 107246 - DNA, 50 bp, homo sapien
caggttgcttaggaggaatctgcccragcaactctgtccgccccctcggc

SEQ ID NO: 107247 - DNA, 50 bp, homo sapien
aaataacactctgattgcagagttasgaataattgagccttttttgaaga

SEQ ID NO: 107248 - DNA, 50 bp, homo sapien
tgcagaagcattttgaaagaacgtasaataatctgggaaaatcgctgagg

SEQ ID NO: 107249 - DNA, 50 bp, homo sapien
tctacattttattgcattatggtcargattattgtttgcactatttctgc

SEQ ID NO: 107250 - DNA, 50 bp, homo sapien
gatatgaaagaactaaatatcataaytaggcagatcttgtggctcttact

SEQ ID NO: 107251 - DNA, 32 bp, homo sapien
agatctaagcttatatsaaaggtggggacaaa

SEQ ID NO: 107252 - DNA, 50 bp, homo sapien
aataaagcctgttaacaaaacacaarctgaatattaaaaatgtaactgga

SEQ ID NO: 107253 - DNA, 50 bp, homo sapien
tgttaggcacacaataacagttgtgyaatagacaggtaaatggaaggata

SEQ ID NO: 107254 - DNA, 50 bp, homo sapien
acttcctcctcactcagagacaaaawctatagcattaatgaaaggccaca

SEQ ID NO: 107255 - DNA, 50 bp, homo sapien
gaaatttgacttaacaaagcatgaarttattcctttatttttgtattaag

SEQ ID NO: 107256 - DNA, 50 bp, homo sapien
tgattgtttactataaggttcctgcyactactctaaggcctttaaccttg

SEQ ID NO: 107257 - DNA, 50 bp, homo sapien
ccagggagatagagcaactaaggtcwactttatttagaacagccattgaa

SEQ ID NO: 107258 - DNA, 50 bp, homo sapien
agtgttaggattttctggatggtaaraggaagtcaatttgaggtttaaca

SEQ ID NO: 107259 - DNA, 50 bp, homo sapien
tgcagtttgtaggtaattctgacaaragcccactaatctccctaatacaa

SEQ ID NO: 107260 - DNA, 50 bp, homo sapien
aaaatttctggctcctattcaaaacygacattatagattatcagtttaaa

SEQ ID NO: 107261 - DNA, 50 bp, homo sapien
caaaggaccactggactttctatatracaaacatttttaaatatttcatt

SEQ ID NO: 107262 - DNA, 50 bp, homo sapien
taggacaacatctcacaaaatcataygttacaggaaatgcatgaacagcc

SEQ ID NO: 107263 - DNA, 50 bp, homo sapien
gtctatctcgggactagagtcaacaktcactgggtggtgctacaaaccag

SEQ ID NO: 107264 - DNA, 50 bp, homo sapien
tgttcaaaatacatataaataaagcygatttggactatcttcctcctagg

SEQ ID NO: 107265 - DNA, 50 bp, homo sapien
ggattcaaggatatattttgtctacyggccctcatgtttgtatgtacttg

SEQ ID NO: 107266 - DNA, 50 bp, homo sapien
aaggaaaatacagcatggtaatttayggtaccagcatgaagcaagaagtg

SEQ ID NO: 107267 - DNA, 50 bp, homo sapien
agaacattctattcatgctcgtaaaygtcatcagataaatgccaatagat

SEQ ID NO: 107268 - DNA, 50 bp, homo sapien
tgggactcttaaattgagatctcccrctaggcaatattatagagtcactg

SEQ ID NO: 107269 - DNA, 50 bp, homo sapien
tcccacatcagttacacagtttctcmctactgaagtttccaagactgagg

SEQ ID NO: 107270 - DNA, 50 bp, homo sapien
caggaagagaaagagtaccatcaagyatagaaagctaacctggcataatt

SEQ ID NO: 107271 - DNA, 50 bp, homo sapien
ctgatgctacaactcttcccttaggrcatagaccatttatctgccaaaca

SEQ ID NO: 107272 - DNA, 50 bp, homo sapien
gagagctggatataggagaacttaaycttgtccaacttatctacatgata

SEQ ID NO: 107273 - DNA, 50 bp, homo sapien
aaataagagaccattccaacttaaaygtgaactctgagtgtcatcccaca

SEQ ID NO: 107274 - DNA, 50 bp, homo sapien
tctttcttaaatttcattatctaacmaattgtaaatgtatacaaaatgat

SEQ ID NO: 107275 - DNA, 50 bp, homo sapien
cgtttttaaagtgtagctgatacacsattattctggagctcatgtcgaaa

SEQ ID NO: 107276 - DNA, 50 bp, homo sapien
tcattttaaatacaattaactcatayaggctatttaaagatggtcttaaa

SEQ ID NO: 107277 - DNA, 50 bp, homo sapien
caaatggggaccatttactccattayaatattaagacattgactaatgga

SEQ ID NO: 107278 - DNA, 50 bp, homo sapien
tgccatgttatcacaatgtatccaayaagtttgcttatttccgtatgtca

SEQ ID NO: 107279 - DNA, 50 bp, homo sapien
gtgtttgacaaatttttgcttaccawctttaatatttaagtgaggtaaaa

SEQ ID NO: 107280 - DNA, 50 bp, homo sapien
ttcctgaatgtatcttctcaatttcmagccacctgccaaattcaaactct

SEQ ID NO: 107281 - DNA, 50 bp, homo sapien
taaagagccaaaatttgtgctctcargtatattattgtttagtgaaggga

SEQ ID NO: 107282 - DNA, 50 bp, homo sapien
tttccatttaaaccaaagaagttccmatttcacaagaacatttatgtgta

SEQ ID NO: 107283 - DNA, 50 bp, homo sapien
gcagataactatgagatggaattccraagccaattcagcattaactttat

SEQ ID NO: 107284 - DNA, 50 bp, homo sapien
ttaagagaggatttgccatttaagakcttgctagtaacctttaagaaggt

SEQ ID NO: 107285 - DNA, 50 bp, homo sapien
ctcatgtatacattgtagattaatamagcaaataaaatccctgatggctc

SEQ ID NO: 107286 - DNA, 50 bp, homo sapien
taactcatgccagtctgaatgcacamgggtatactgaaacctttccatca

SEQ ID NO: 107287 - DNA, 50 bp, homo sapien
tccacatttttttgctctctggtccmtgatattgatagtagccttttgca

SEQ ID NO: 107288 - DNA, 50 bp, homo sapien
tcaaagtggaattgactcattatgcytcgaattttttcatgcatttctaa

SEQ ID NO: 107289 - DNA, 50 bp, homo sapien
gaagaggcataaagatagacttatgwaggtcagcagaaagtctgtggatc

SEQ ID NO: 107290 - DNA, 50 bp, homo sapien
ataaatgtgtatacagactcctaagyagtatttaatcaactggcaggtct

SEQ ID NO: 107291 - DNA, 50 bp, homo sapien
tcatcttcacatctcttttacagccrctatctaatctgactttgtcactc

SEQ ID NO: 107292 - DNA, 50 bp, homo sapien
ggaacataaacttatttctgattaaygtaatgtctctcctgtgtatccca

SEQ ID NO: 107293 - DNA, 50 bp, homo sapien
attatgcttgactgtaatggtaatayggcctaaaaaggatgcagaaaaaa

SEQ ID NO: 107294 - DNA, 50 bp, homo sapien
aacttattagctcctgaaggcgaaawtattagttcctgggatgtgtcttt

SEQ ID NO: 107295 - DNA, 50 bp, homo sapien
atagctccatcctctttcttagagcmaaacatggaaggattaagtactat

SEQ ID NO: 107296 - DNA, 50 bp, homo sapien
ggtgttcccaaattgcctccaacaayggtatattccatattattaaatgg

SEQ ID NO: 107297 - DNA, 50 bp, homo sapien
attcctacattccaataggtataagrataaatgatctctgttcttcatgt

SEQ ID NO: 107298 - DNA, 50 bp, homo sapien
tgtggcaattaagccccagtagagaygaaaaagtagtaagctacaggttt

SEQ ID NO: 107299 - DNA, 50 bp, homo sapien
gttataatatactactgagttaaagkcaaaaaatatactatgattcttaa

SEQ ID NO: 107300 - DNA, 50 bp, homo sapien
cctggttggtctacaacaaatgaaaytgaagttgtagaacttccttggta

SEQ ID NO: 107301 - DNA, 50 bp, homo sapien
ttagtcaagtttagtttatgattaasgaagctactgaagctgctccaaat

SEQ ID NO: 107302 - DNA, 50 bp, homo sapien
tggagaatattgaataatgattaaaragtattcaacaatggtttgatata

SEQ ID NO: 107303 - DNA, 50 bp, homo sapien
gtatcatacctgttcagtgatctgamaaatttactgattacatttataat

SEQ ID NO: 107304 - DNA, 50 bp, homo sapien
ctggagaagcttttggtttgctacgwataattttctactcactgttctag

SEQ ID NO: 107305 - DNA, 50 bp, homo sapien
gatagacatctttttggccattatgktattgtccagtttttggctattat

SEQ ID NO: 107306 - DNA, 50 bp, homo sapien
gactagtttttaacattttattacamgcaagattaggacctttccacaga

SEQ ID NO: 107307 - DNA, 50 bp, homo sapien
cacttccagttcaggaatatggaatsagaatctttgttaatcaccagata

SEQ ID NO: 107308 - DNA, 50 bp, homo sapien
aaagtgaagctaggcactgtttatayattcaaggcatttttacaagtagc

SEQ ID NO: 107309 - DNA, 50 bp, homo sapien
agaaactgatccaaataaatgatgayggaatgagaccagaaaacaggatt

SEQ ID NO: 107310 - DNA, 50 bp, homo sapien
aaaaagtaagaagatcctaaaagaamgatgtatctgtgtaacactacaaa

SEQ ID NO: 107311 - DNA, 50 bp, homo sapien
catgaaaatgcaaattttgctatccyaaattaaatgaataatgctggtct

SEQ ID NO: 107312 - DNA, 50 bp, homo sapien
ctggtcttaccctagtcctatattcyacccaaaagaaataaatcaaattg

SEQ ID NO: 107313 - DNA, 50 bp, homo sapien
gtcgaatggctgaagagaacattgayattaaagagaaaattttgatacat

SEQ ID NO: 107314 - DNA, 50 bp, homo sapien
aaaagatatatcaagaaaatacatcrccactggaggaatttcaagaatct

SEQ ID NO: 107315 - DNA, 50 bp, homo sapien
gaaatttgatctaaagagcacttaasatggaaggagtgaggaagacagag

SEQ ID NO: 107316 - DNA, 50 bp, homo sapien
caatcagagttattgtgatagttaartgagagattatgaggatcttattc

SEQ ID NO: 107317 - DNA, 50 bp, homo sapien
gatgtcaaaaagattgatgcattttktgtatgataaagaattctcataaa

SEQ ID NO: 107318 - DNA, 50 bp, homo sapien
agttagagattctgttcttcttgttsattcacatattctgcaaccttcac

SEQ ID NO: 107319 - DNA, 50 bp, homo sapien
atccaaaaaatatggtctctttaacrccattacaggggtggctttacaga

SEQ ID NO: 107320 - DNA, 50 bp, homo sapien
taagaatgtaataatttaatagtggmataacattagctctaacacaagta

SEQ ID NO: 107321 - DNA, 50 bp, homo sapien
gctcttccaataagggaatcatgcamgttttttagatcagcagaaaaaca

SEQ ID NO: 107322 - DNA, 50 bp, homo sapien
gataaaagctcacagagcaaaggcaratagttcatactaagtagcataaa

SEQ ID NO: 107323 - DNA, 50 bp, homo sapien
actaaccaaaatataattttgtttasagcaacattatttcttatcccatg

SEQ ID NO: 107324 - DNA, 50 bp, homo sapien
tagctcccatcacttattccaaatckataaaaactctaagacagatttta

SEQ ID NO: 107325 - DNA, 50 bp, homo sapien
ttggaatcatgaagtgtaagaccaawgggaaacatttcataattcaccac

SEQ ID NO: 107326 - DNA, 50 bp, homo sapien
agccaagtgagtgccattcacaccaytgagtatgttagaagttctatttg

SEQ ID NO: 107327 - DNA, 50 bp, homo sapien
ctattggaccgtaccttgtgattccrcgagtcaacactccttaataaact

SEQ ID NO: 107328 - DNA, 50 bp, homo sapien
attttaagttaataacaatgaacacratatagaaatgggtgatttaagca

SEQ ID NO: 107329 - DNA, 50 bp, homo sapien
ccttttctttgctcagatttttttcyatccaagctactatttaaaactct

SEQ ID NO: 107330 - DNA, 50 bp, homo sapien
ataggcccacaaggaagttcttccargccaccaccgaagttcacttaaag

SEQ ID NO: 107331 - DNA, 50 bp, homo sapien
tggggtaagacagatagaaaagtgawagacctcagtgtttcagtgtgtgt

SEQ ID NO: 107332 - DNA, 32 bp, homo sapien
aaaactaaattattccrctccatgacctcccg

SEQ ID NO: 107333 - DNA, 50 bp, homo sapien
aatgagaatttatggtggccacaatyagtactagaagatcaattaaataa

SEQ ID NO: 107334 - DNA, 50 bp, homo sapien
tacgaaaaaagtaaatcatagtttcraacaatacaatcagggcagtattt

SEQ ID NO: 107335 - DNA, 50 bp, homo sapien
acttatgctatgtcacaaggcagtaygatgtgttttaatacaattgtgca

SEQ ID NO: 107336 - DNA, 50 bp, homo sapien
tttttaaaaatttcatgacaaagtayagttttcaaaatttcttcaaagga

SEQ ID NO: 107337 - DNA, 50 bp, homo sapien
aaaatattttccagttaatatcaaamtaatttgtacccaatttgatctat

SEQ ID NO: 107338 - DNA, 50 bp, homo sapien
aatattttggattaagttgggtaatratcagagaatgggctcctttgtaa

SEQ ID NO: 107339 - DNA, 50 bp, homo sapien
ggtgaatctaatttgatgaatctaakgctcaagaaaataattatatgtat

SEQ ID NO: 107340 - DNA, 50 bp, homo sapien
taggagaaaccacatttgctttgtascttttagggcagttttacacaact

SEQ ID NO: 107341 - DNA, 50 bp, homo sapien
aataaaacactgatcaaataactaargccttggatttccacaaagcactg

SEQ ID NO: 107342 - DNA, 50 bp, homo sapien
ccttaaattgaaaagaattcctataygcagttatttatcataatcctttc

SEQ ID NO: 107343 - DNA, 50 bp, homo sapien
atcagaatcatttacagtgtttattkaaaatataggtttctgggcctcac

SEQ ID NO: 107344 - DNA, 50 bp, homo sapien
tcttagcagtgaacacctttgctatyaagattatttcctctgctatgagt

SEQ ID NO: 107345 - DNA, 50 bp, homo sapien
tccaggggccaggattattggcatcrctggaaagttattggaaattcagg

SEQ ID NO: 107346 - DNA, 50 bp, homo sapien
ttatagaccatggacaatcttgacayggaagttataggccattggtttct

SEQ ID NO: 107347 - DNA, 50 bp, homo sapien
tttacagagaccatatttcattttayagtggtaagaaaattaaaatggaa

SEQ ID NO: 107348 - DNA, 50 bp, homo sapien
aaataacacattttaacagtaattgwaaacatcagatttagtattacaca

SEQ ID NO: 107349 - DNA, 50 bp, homo sapien
ctcatagcttttattaaaatcttcawtccaaagaccagtgatccttacca

SEQ ID NO: 107350 - DNA, 50 bp, homo sapien
cccaagccttagcagctaacacatgrcattgggcctgctggtacacagaa

SEQ ID NO: 107351 - DNA, 50 bp, homo sapien
caaatttaccttccttgaattactcwcttctactacaaactaagtaatat

SEQ ID NO: 107352 - DNA, 50 bp, homo sapien
ttaaattgtggaaaaatgcacatatraagctctcccagtaccaatagcac

SEQ ID NO: 107353 - DNA, 50 bp, homo sapien
ttcctaaactgtgtatttcttccaaygtagacacaacatactctgaataa

SEQ ID NO: 107354 - DNA, 50 bp, homo sapien
cttgcttttgctcagtttagtcaacsaaagcatactctactctgtgccta

SEQ ID NO: 107355 - DNA, 50 bp, homo sapien
aataaattagaggaaagaaaccatarattaattcaaaatccagttaacac

SEQ ID NO: 107356 - DNA, 50 bp, homo sapien
acatccaaactgcccaatcttgctgragaaaattacacaccagtaaatca

SEQ ID NO: 107357 - DNA, 50 bp, homo sapien
tatataaaaagtagttaacaattacrgggcatatattgtgtgccatgcac

SEQ ID NO: 107358 - DNA, 50 bp, homo sapien
agataagtgctaccatataactgaaytgaagacgtgataaacctgcattc

SEQ ID NO: 107359 - DNA, 50 bp, homo sapien
tctccaaccctttattttgagtctayagatgttgttacttgtgaaatggg

SEQ ID NO: 107360 - DNA, 50 bp, homo sapien
gagagctatttttcataatttaagcrccaccagatgacaagaacaaattg

SEQ ID NO: 107361 - DNA, 50 bp, homo sapien
taaattatgaaaaatagctctccaarggtttaatccctgaatctagtttg

SEQ ID NO: 107362 - DNA, 50 bp, homo sapien
gtgtggtcccccacactctaaactayggaccatcaaactacatcctgtag

SEQ ID NO: 107363 - DNA, 50 bp, homo sapien
gtttctaattcaggtccacgtgagaygcctacttaaaaaattatcctcat

SEQ ID NO: 107364 - DNA, 50 bp, homo sapien
cagtaacataagacatttccatgttmaaatttggactccctcctcttcat

SEQ ID NO: 107365 - DNA, 50 bp, homo sapien
atcatgcttctacaagatttatgccsaagtatatgcttcctgaatatata

SEQ ID NO: 107366 - DNA, 50 bp, homo sapien
agcttaaaatagaacccatcagtcaytagttgaagtaaaatctttcttat

SEQ ID NO: 107367 - DNA, 50 bp, homo sapien
ttgcagtttgacctcagacaaataartaatttccaggcaggcactggtgc

SEQ ID NO: 107368 - DNA, 50 bp, homo sapien
gacctgtataagcagaatatttttargtcaaatggacaaaaatctaacct

SEQ ID NO: 107369 - DNA, 50 bp, homo sapien
accttgtacacataatttgttttagyacctgatttagtcactctctcttt

SEQ ID NO: 107370 - DNA, 50 bp, homo sapien
agtatataaattcatattttgtgaasttaattttagaatttatagtctgt

SEQ ID NO: 107371 - DNA, 50 bp, homo sapien
gaagaattcaaaatggagacaaatcrccttaacccaccactttataaaca

SEQ ID NO: 107372 - DNA, 50 bp, homo sapien
aacatgcagaaatacagaactagatwaaaattcaataaactgtaagtaag

SEQ ID NO: 107373 - DNA, 50 bp, homo sapien
ggcagttgttaaatgatgcagttgargtaaccatggactagtgccaaatt

SEQ ID NO: 107374 - DNA, 50 bp, homo sapien
gtattttctgtacgcacatgtagtcrgaaaatatgtccgtttttaagcta

SEQ ID NO: 107375 - DNA, 50 bp, homo sapien
aaaactatggtacatcctcttaatayatttactgttgttaactataatgt

SEQ ID NO: 107376 - DNA, 50 bp, homo sapien
atcttggggatttaagaagttgagaratcaaaaattatgagcaattatga

SEQ ID NO: 107377 - DNA, 50 bp, homo sapien
ctgcaccagagtgtatgtaaatgccrcaaatgattaagattggttagtaa

SEQ ID NO: 107378 - DNA, 50 bp, homo sapien
aagcttattaaactactcatcagaaygaatgcaaatatcagtagtatact

SEQ ID NO: 107379 - DNA, 50 bp, homo sapien
ctagatagtccttttgtatttttcawattggataccataccctttcctta

SEQ ID NO: 107380 - DNA, 50 bp, homo sapien
tatgtgaccccattggccaaggaccraagaagatactacattgccaccag

SEQ ID NO: 107381 - DNA, 50 bp, homo sapien
tgtataatccactaacactcttagayacattatgaattggaaaacagttt

SEQ ID NO: 107382 - DNA, 50 bp, homo sapien
gtcctgacattgactgttctatttargagttcaggctggctgtcttatag

SEQ ID NO: 107383 - DNA, 50 bp, homo sapien
caagaatatctacctggagagaaccrcaactaaagattctccaccatcca

SEQ ID NO: 107384 - DNA, 50 bp, homo sapien
agtatgttgatgtgttcctttgttcmataacacatctggaatcacagttg

SEQ ID NO: 107385 - DNA, 50 bp, homo sapien
ggatagattgatttgttagcaaccayggactaagaattgcaccaaggaaa

SEQ ID NO: 107386 - DNA, 50 bp, homo sapien
catgagtctagaatagagtaacactraatttgtaaagcagcaaggtaaaa

SEQ ID NO: 107387 - DNA, 50 bp, homo sapien
catggcaatacagatgcactgaatgwcaaatttaaaaatctacattcttt

SEQ ID NO: 107388 - DNA, 50 bp, homo sapien
gggagggatgcatgggctgaactgakccaataagcttatttctcttaaga

SEQ ID NO: 107389 - DNA, 50 bp, homo sapien
tcccagaaccctactgttccctcacrcagactgaaaactattgtgaggct

SEQ ID NO: 107390 - DNA, 50 bp, homo sapien
tttgagaacactaaacataataaacrctatcactggtgaccaccaaatga

SEQ ID NO: 107391 - DNA, 50 bp, homo sapien
taatgccactaatgctgtcacatgasgatctctctaaactaatagcagta

SEQ ID NO: 107392 - DNA, 50 bp, homo sapien
gtttctgggcaaagtattcaggatcyagtagtgaatagcaatgtccttac

SEQ ID NO: 107393 - DNA, 50 bp, homo sapien
aataagaataagcaaaaatattgacrctttctcctaatgtaacaatgagt

SEQ ID NO: 107394 - DNA, 50 bp, homo sapien
tgatacaaatacaatacacataatayaatacgaagcacgaagcactaatg

SEQ ID NO: 107395 - DNA, 50 bp, homo sapien
ccatgctttgtctctgactatgagcraagaactacaccctccccttagct

SEQ ID NO: 107396 - DNA, 50 bp, homo sapien
aaggaaccattaatttcttcctatawgatccaaagctattaaataagaaa

SEQ ID NO: 107397 - DNA, 50 bp, homo sapien
tgaagagtaaaagaggtctattttcrtaactagaagacgaaactgaaggt

SEQ ID NO: 107398 - DNA, 50 bp, homo sapien
cacatctctcatcatagccagctacracttgggcagccttttcttatagt

SEQ ID NO: 107399 - DNA, 50 bp, homo sapien
gtgcagatttatttaataaatattasctattgtctgctacagactgtgtc

SEQ ID NO: 107400 - DNA, 50 bp, homo sapien
tccagaatgacagctttgatggtatyagtaactggccagaagtcgtcagt

SEQ ID NO: 107401 - DNA, 50 bp, homo sapien
aagttggagttgtttaatctaacaawtgaatcataaaagccagaatacag

SEQ ID NO: 107402 - DNA, 50 bp, homo sapien
aacaaaagaaaaatacaccaaaatartaaagacataattctattaataaa

SEQ ID NO: 107403 - DNA, 50 bp, homo sapien
gtgagcagtggtctaggtctaaggamgatccaaagtgacaatgttcctgt

SEQ ID NO: 107404 - DNA, 50 bp, homo sapien
gttcatagtttgttgttgctgaataratccaatttgatctcaggtttttt

SEQ ID NO: 107405 - DNA, 50 bp, homo sapien
gcctgctttacatgacgtcccaatcyatgttttaatgttcatagtttgtt

SEQ ID NO: 107406 - DNA, 50 bp, homo sapien
ctttacaccggtgtgatatttacggsaaagcgtgtgctgagtgttgcctc

SEQ ID NO: 107407 - DNA, 50 bp, homo sapien
taactaagctactaaagtgatacaaygtaaagaacaaagtcaaggatttg

SEQ ID NO: 107408 - DNA, 50 bp, homo sapien
tctgctgaattcccttgcatatttaygttgctatttattttcctcttagc

SEQ ID NO: 107409 - DNA, 50 bp, homo sapien
tattcattcattgtaagaaaacaaaygagaggattattattcaaatattt

SEQ ID NO: 107410 - DNA, 50 bp, homo sapien
ataagactatgaaaaattcagtgccrcatatcgaggagcaaggaatggaa

SEQ ID NO: 107411 - DNA, 50 bp, homo sapien
acaggtgattttagagtgaataaatmaaaatcaataccaaagatattatt

SEQ ID NO: 107412 - DNA, 50 bp, homo sapien
taccaaagatattattacattcatamgaagactgcctgtgctattttttc

SEQ ID NO: 107413 - DNA, 50 bp, homo sapien
aagaattaaaatactgaatttctttwcttaatctcagaactcgatattta

SEQ ID NO: 107414 - DNA, 50 bp, homo sapien
ggagaaaatgtgcagaaggttgacasgttactaagaacaaactaacagta

SEQ ID NO: 107415 - DNA, 50 bp, homo sapien
aaacagttttagatttgatatgcacracggctaaagagaagttgagaagt

SEQ ID NO: 107416 - DNA, 50 bp, homo sapien
ctcacatgttgaggatttagtactartaatgggtcttctaataatttaag

SEQ ID NO: 107417 - DNA, 50 bp, homo sapien
ggcattgatttattattgtatcaaawtcaccaaataagctctgcaggaga

SEQ ID NO: 107418 - DNA, 50 bp, homo sapien
ctatgatatatcggcattgtgaaaaratagatggaaggagatgacttgct

SEQ ID NO: 107419 - DNA, 50 bp, homo sapien
agacatttcctgtgtctgtccactayaaaggtctagaaataacaataacc

SEQ ID NO: 107420 - DNA, 50 bp, homo sapien
aactggaagattttcattcttggctwaaagtcttcagaaaataacaaatt

SEQ ID NO: 107421 - DNA, 50 bp, homo sapien
aaccatgcgcctgaccaactgacaasctgggaatacaaagagtagatcta

SEQ ID NO: 107422 - DNA, 50 bp, homo sapien
caactctgaaaatatggacttatcartaatagtgactagtttggattctc

SEQ ID NO: 107423 - DNA, 50 bp, homo sapien
cttatagaagaataaactgacattarcatttttataaattagagctataa

SEQ ID NO: 107424 - DNA, 50 bp, homo sapien
tctgtggctcaattgctttttaatcratccctctgaagagtcagtatgtt

SEQ ID NO: 107425 - DNA, 50 bp, homo sapien
tgaaagcaagaacggattaaaggagrccaattaggagccaattgcgtgtg

SEQ ID NO: 107426 - DNA, 50 bp, homo sapien
ccacatgaagaggtgccctgaactcrcaaagacaagcatctattctgtgg

SEQ ID NO: 107427 - DNA, 50 bp, homo sapien
acagactgccttgattctgtctaaartccaggtgttttataacgcttact

SEQ ID NO: 107428 - DNA, 50 bp, homo sapien
gtatctccagggaatgattttctaaytattcagtgtgttgatggttgtca

SEQ ID NO: 107429 - DNA, 50 bp, homo sapien
aagcaggctcgtaaggcactcgcgtmaaagatgcaaaccatttagtaaaa

SEQ ID NO: 107430 - DNA, 50 bp, homo sapien
aattacttttgcacgaacctaataartagggaatggattctgaacttggg

SEQ ID NO: 107431 - DNA, 50 bp, homo sapien
aactttgccctctttaagcagatagragaactttggacaacaaatgcagt

SEQ ID NO: 107432 - DNA, 50 bp, homo sapien
gtctttgctacagtgagtggttgaaytggaaggagtgggagatctgagaa

SEQ ID NO: 107433 - DNA, 50 bp, homo sapien
tttactcctttacagaaaccttcackggattacagtttcttctacaaaat

SEQ ID NO: 107434 - DNA, 50 bp, homo sapien
tttaaagaaactttcacagtttacckaataattatgctaatttatacttc

SEQ ID NO: 107435 - DNA, 50 bp, homo sapien
cagtaatggtatataaatgggtccartaaaagcaatagtggggatcattg

SEQ ID NO: 107436 - DNA, 50 bp, homo sapien
taataattacctcaggcttacatcaytcaagatactacattaggtgacca

SEQ ID NO: 107437 - DNA, 50 bp, homo sapien
acttctctgttcctcagtatatgtamcgaatttcaaaaaatacttctcat

SEQ ID NO: 107438 - DNA, 50 bp, homo sapien
gccatatagtaatcttgcaaaggacraaaataggtatttatatatccaaa

SEQ ID NO: 107439 - DNA, 50 bp, homo sapien
tatggatgtaaaacagttgtttgaamtgcatcctatttaccttaggattt

SEQ ID NO: 107440 - DNA, 50 bp, homo sapien
atgcttctatgtagtcctgttttaartacaatggaaatatgactttagtg

SEQ ID NO: 107441 - DNA, 50 bp, homo sapien
gacttctaaagatataatttgtgaaytcctctaggatttatcacttgatg

SEQ ID NO: 107442 - DNA, 50 bp, homo sapien
atttgtggtgatgtttattatattcyattactcctaggaaacctcattaa

SEQ ID NO: 107443 - DNA, 50 bp, homo sapien
aaatataagagagatacagcatgaaraaataatagctgcaatgttaaaaa

SEQ ID NO: 107444 - DNA, 50 bp, homo sapien
tcaacaacaacaaaaaattgctgcaytgaattgaggtaaaaactattttg

SEQ ID NO: 107445 - DNA, 50 bp, homo sapien
aaacaaaaagtgcatgacaaatttargatgaaattaagcaagcctaatgt

SEQ ID NO: 107446 - DNA, 50 bp, homo sapien
cttaattttgaagaagttctacaaarccttgacttatctctctgagatta

SEQ ID NO: 107447 - DNA, 50 bp, homo sapien
aaattttgctgttcagatgtgatgaygaaaacttaattttgaagaagttc

SEQ ID NO: 107448 - DNA, 50 bp, homo sapien
tttctttgtaagacttcaagcaatcraagctaatgttttcttgtttattt

SEQ ID NO: 107449 - DNA, 50 bp, homo sapien
gaattgaatgtcataaggttgaaaargtgaaattctctatgaacttgtac

SEQ ID NO: 107450 - DNA, 50 bp, homo sapien
ttggttaaacctcactgaggcatccsaggtctcttgaaggtctggaaatt

SEQ ID NO: 107451 - DNA, 50 bp, homo sapien
tttaatccatctaaccttcaaggcartcctcggagataagtattattatt

SEQ ID NO: 107452 - DNA, 50 bp, homo sapien
cccttgctttaagtaaaagttgttayggtctgcattttcatctctcacct

SEQ ID NO: 107453 - DNA, 50 bp, homo sapien
cttttctgatatttatgggttttacrgccttatccattttaatttttgtc

SEQ ID NO: 107454 - DNA, 50 bp, homo sapien
tacactaatcacagggtaagggtccyaaagagaatacattaagatagatc

SEQ ID NO: 107455 - DNA, 50 bp, homo sapien
ttataaaatattgcaaatagttctaycgtttaagcaattctagattttat

SEQ ID NO: 107456 - DNA, 50 bp, homo sapien
ttcctcaatctttgattacttattamactcttgctaattcttacatacta

SEQ ID NO: 107457 - DNA, 50 bp, homo sapien
tcaattagcatatagtataataagcrcatgattcttgaatttctgtcttt

SEQ ID NO: 107458 - DNA, 50 bp, homo sapien
gtagcccaaactgtagcttctaacaygggagatcttttaaaaatacttta

SEQ ID NO: 107459 - DNA, 50 bp, homo sapien
gcttcatctcagattaaattgaaccrcatatattaaataatctgtgtatt

SEQ ID NO: 107460 - DNA, 50 bp, homo sapien
tgctacttcaccttgcacttttataygatgaagatggtttcctttcttaa

SEQ ID NO: 107461 - DNA, 50 bp, homo sapien
ctgagttggttaaacaatccttgtcyattgtctaaaatattatgaagttt

SEQ ID NO: 107462 - DNA, 50 bp, homo sapien
ctcttgatttaggaggtataacaatragtaaataaaagtcatttatcaag

SEQ ID NO: 107463 - DNA, 50 bp, homo sapien
cagtggcataggttaaaaggctcaargagatcaaagagagattttgattt

SEQ ID NO: 107464 - DNA, 50 bp, homo sapien
cttttggatttcttcactcagtaatratggtattgtattgtattgaaata

SEQ ID NO: 107465 - DNA, 50 bp, homo sapien
gaatgttcaattttggaatccttcaycgatttgaaaatagttaaggaatg

SEQ ID NO: 107466 - DNA, 50 bp, homo sapien
tgtccccatagtagcatgaatagaartaaattcaccttttcatttaatgt

SEQ ID NO: 107467 - DNA, 50 bp, homo sapien
ttgatcacctttaaggaaccaagcarcctactgaatttcagctacatttt

SEQ ID NO: 107468 - DNA, 50 bp, homo sapien
aatatagccctaatgtggactcttaygctttgggatgacataacctgttt

SEQ ID NO: 107469 - DNA, 50 bp, homo sapien
taaaagccatcaatgacaaatttcayctccttacctcacaattctagatg

SEQ ID NO: 107470 - DNA, 50 bp, homo sapien
gcctgagttctttctagctttgaacycattagtttcatttacagtcctgt

SEQ ID NO: 107471 - DNA, 50 bp, homo sapien
aatccaagattcccataaagattttsagccttctggaagtatagcaggtt

SEQ ID NO: 107472 - DNA, 50 bp, homo sapien
tcctattaccattacctgaactaagrcctatattaatccttcaactatta

SEQ ID NO: 107473 - DNA, 50 bp, homo sapien
gaaaacttgctatttttctttaatasaccagagaacaagcaggtgtataa

SEQ ID NO: 107474 - DNA, 50 bp, homo sapien
ctttgattgatacaatcctttactcwcttgacttttgcttaactatacca

SEQ ID NO: 107475 - DNA, 50 bp, homo sapien
ggttccatagaaaatatatggacttyaacaattcttaatcaaataagttt

SEQ ID NO: 107476 - DNA, 50 bp, homo sapien
ggcagaaatgtgttatagaaagaagsctactcacaagctactcacagaat

SEQ ID NO: 107477 - DNA, 50 bp, homo sapien
ttctgcatgtcttccttgctaaacaytagtatctcttacttgttatatca

SEQ ID NO: 107478 - DNA, 50 bp, homo sapien
cttgttatatcacattaattaggaartacccttctactcttagttgcctt

SEQ ID NO: 107479 - DNA, 50 bp, homo sapien
ctggaaacggcatgcacgaagtatcygacatcttagcctaaatttcctca

SEQ ID NO: 107480 - DNA, 50 bp, homo sapien
tctccattcttgatgatttcccaaasattataaacaatggttccatgaat

SEQ ID NO: 107481 - DNA, 50 bp, homo sapien
gatgtcagatattcagaaaagtcaartcaatgaatcctgaaagtaattta

SEQ ID NO: 107482 - DNA, 50 bp, homo sapien
aaatgaataaggtgcaaaggacgatrtttgggagtggaaggcaggatggt

SEQ ID NO: 107483 - DNA, 50 bp, homo sapien
catttactttgccttgtataagaaaytgatgagtatgtgagatgaggtta

SEQ ID NO: 107484 - DNA, 50 bp, homo sapien
tttgtttatgagctctcagtaggcartaatccttacagctggggcatgag

SEQ ID NO: 107485 - DNA, 50 bp, homo sapien
taagagggaagattaacattcggacyaaccatgtttccactaaaccaatt

SEQ ID NO: 107486 - DNA, 50 bp, homo sapien
attcatcatgtaatttttgagcccayatgttccaggcacaacactagtca

SEQ ID NO: 107487 - DNA, 50 bp, homo sapien
tttggagttatttttttgcttgggamgattttggttctattaaatttttt

SEQ ID NO: 107488 - DNA, 50 bp, homo sapien
gcaaaaaaataactccaaaaatgtayccctcattatgaaagtcctagggt

SEQ ID NO: 107489 - DNA, 50 bp, homo sapien
ctagacaatctctcctctgttcttcrcttctctctttgcccagctctaaa

SEQ ID NO: 107490 - DNA, 50 bp, homo sapien
ttagaatcctgtaaaaataaatattsaacagctagataggtctattatag

SEQ ID NO: 107491 - DNA, 50 bp, homo sapien
ttcacagatgactaaacttaatcctsaacaattttctgatgtggatggac

SEQ ID NO: 107492 - DNA, 50 bp, homo sapien
aaagtgtgagtgagaaatattaccasagacaacagtgaatggttttgaga

SEQ ID NO: 107493 - DNA, 50 bp, homo sapien
aacattttgttcttactgtaatagaygcttactctggacatgaatttgcc

SEQ ID NO: 107494 - DNA, 50 bp, homo sapien
tcctgtgcttcaagaaaatatagaasttaatcaccaagttgtacatttaa

SEQ ID NO: 107495 - DNA, 50 bp, homo sapien
ccaaaccacaccaatggacaagggamagaccacttcatgttaatgtctca

SEQ ID NO: 107496 - DNA, 50 bp, homo sapien
tttcaccagtgagatttgaaaaggtwaaattgcacatgatgcaaaagact

SEQ ID NO: 107497 - DNA, 50 bp, homo sapien
tttctatttaactctgtaaggcataygtaagtaaaattaaagggactcca

SEQ ID NO: 107498 - DNA, 50 bp, homo sapien
aataaaggaaatagatgtccaacaaytctgagatgagatcaatactggta

SEQ ID NO: 107499 - DNA, 50 bp, homo sapien
catttgtgaatgagggataagataamatgaggttcttgcagttgttctag

SEQ ID NO: 107500 - DNA, 50 bp, homo sapien
tgccaagagctgttcaagaccctaamgcaaatgggcaatgttacctctct

SEQ ID NO: 107501 - DNA, 50 bp, homo sapien
gaatgtcgtttgattacaaattaaamgtagtaaactgacaatatgtattt

SEQ ID NO: 107502 - DNA, 50 bp, homo sapien
atcttcttttatctcctcacccaaawgacttaattccaacaacatacttg

SEQ ID NO: 107503 - DNA, 50 bp, homo sapien
ggcaaattgcaatgataagaagtacractattactttcagtaagaacagt

SEQ ID NO: 107504 - DNA, 50 bp, homo sapien
cccaggtcaaacagattttgtcacaytacttactgccattatactcatgg

SEQ ID NO: 107505 - DNA, 50 bp, homo sapien
ctatttctcaaatacatatctgcaaygtagctatatgtcaagtctatttt

SEQ ID NO: 107506 - DNA, 50 bp, homo sapien
acagttccttcttataaaaagtgtayaatctgaagaaagaaaataatatc

SEQ ID NO: 107507 - DNA, 50 bp, homo sapien
cagcaggcaggtattaggaggattasagcattgacactaaggtttaaatg

SEQ ID NO: 107508 - DNA, 50 bp, homo sapien
caaaataaagaaataaaggagtataygatagcatgcaaacacacacacac

SEQ ID NO: 107509 - DNA, 50 bp, homo sapien
aaaatgccaaatagtggcactacaartggaaaaagaacaccagctatatt

SEQ ID NO: 107510 - DNA, 50 bp, homo sapien
cttagcaccaaatctagtatatatargttcaagaagagtgtaaagaggac

SEQ ID NO: 107511 - DNA, 50 bp, homo sapien
atcaactgactcttgtattttaacascacaggctgaagctgataagggtc

SEQ ID NO: 107512 - DNA, 50 bp, homo sapien
tgggtctgattagaacaaaacccaayggcttattcacaacaaaaagctta

SEQ ID NO: 107513 - DNA, 50 bp, homo sapien
atttgcattatgttgtacatgccacygtcttcagatggctaatccctatg

SEQ ID NO: 107514 - DNA, 50 bp, homo sapien
ttaagtatgtgatgagtacaaaaacrgaatgacagacaaggttgcaccca

SEQ ID NO: 107515 - DNA, 50 bp, homo sapien
agaatcagtatctaaaatgcaacaarttactcttcgatgtgacattaaat

SEQ ID NO: 107516 - DNA, 50 bp, homo sapien
tgagaatcaacagaactgatgatgtraatatccgagttaaggagatgttg

SEQ ID NO: 107517 - DNA, 50 bp, homo sapien
attgggaatgaaatttgacctatcargaaatcaaagtatgacagtttgat

SEQ ID NO: 107518 - DNA, 50 bp, homo sapien
tagtaaaaattttgatgtactaagaratcagaatatgacaggttgatctt

SEQ ID NO: 107519 - DNA, 50 bp, homo sapien
taagctgatgtcactgtggaaccaarcaaacaccagtaaacaggcaaaca

SEQ ID NO: 107520 - DNA, 50 bp, homo sapien
aaatatgaagaattattataactcartaagaagatgacccaatttaaaaa

SEQ ID NO: 107521 - DNA, 50 bp, homo sapien
ttgtatttctcatacagagtatagckaattaatgtggcttcaaacatgac

SEQ ID NO: 107522 - DNA, 50 bp, homo sapien
atggagaactagtatactaagaaaawttaaagcaataaccaaaagaaaaa

SEQ ID NO: 107523 - DNA, 50 bp, homo sapien
tgagctaaacttaaaaagaattaaaytgatggtaagaaaatgttgataaa

SEQ ID NO: 107524 - DNA, 50 bp, homo sapien
aatagaaggacaaccaaatgacaccracactaatatgaatcaaaaaaaaa

SEQ ID NO: 107525 - DNA, 50 bp, homo sapien
cctggattcaggagtgggttataccrgggcttcccatccacagagaacac

SEQ ID NO: 107526 - DNA, 50 bp, homo sapien
tgtagtttgtcatgaatacaagttayatacaaatgtcagaagaggagaaa

SEQ ID NO: 107527 - DNA, 50 bp, homo sapien
attcctatcctattgggaatatggamggtaaaagatgtctatttcttata

SEQ ID NO: 107528 - DNA, 50 bp, homo sapien
cttcctgtttctctcttataaggaamcttgtaattgctttgagcccactt

SEQ ID NO: 107529 - DNA, 50 bp, homo sapien
ggtctagagtaagaatgcagtggtaygggaagtataggcacctgtcctcc

SEQ ID NO: 107530 - DNA, 50 bp, homo sapien
tcaactatgtataaatgagagagatmaaattgtaaaatagagcaagtaag

SEQ ID NO: 107531 - DNA, 50 bp, homo sapien
agtcttgtcctcctggacggttgcckaaagactggaactgcaaagataaa

SEQ ID NO: 107532 - DNA, 50 bp, homo sapien
attattggttacagttacctccaaarggcattaacattttcttgtgatgt

SEQ ID NO: 107533 - DNA, 50 bp, homo sapien
agagatttcacctaaatggaatcacrcaccatcttagtctatttgggcta

SEQ ID NO: 107534 - DNA, 50 bp, homo sapien
tttctgaactggaagtgaaagtccayctgatgattagagggaggaaaatg

SEQ ID NO: 107535 - DNA, 50 bp, homo sapien
tctctgacccctctcttcggagtcaytaccaataactactttttttcagg

SEQ ID NO: 107536 - DNA, 50 bp, homo sapien
gtgcaagaatgtcaaacccatactcygaatatttgttgattctggtaaag

SEQ ID NO: 107537 - DNA, 50 bp, homo sapien
tatgaggaagccaaatggagtccctraaagaaaaggatgagcatttggct

SEQ ID NO: 107538 - DNA, 50 bp, homo sapien
tgctttaaaaacatgggctaatccayctttataacatccccaggctgcag

SEQ ID NO: 107539 - DNA, 50 bp, homo sapien
atatgaataattgtaaaatagtgtcyaatttacctgatgctcatggcagg

SEQ ID NO: 107540 - DNA, 50 bp, homo sapien
actactagtgttctagggaatttaartatcagtggagtggttgtccttag

SEQ ID NO: 107541 - DNA, 50 bp, homo sapien
agaacaatggaatcagtaacttcctrtaagctgaaagtatctattccatt

SEQ ID NO: 107542 - DNA, 50 bp, homo sapien
agaggtcacagattgttctaccgaartagtgactagtatagtatgtaaaa

SEQ ID NO: 107543 - DNA, 50 bp, homo sapien
tagaatgggcaatgatataaagacamaacaactcaacagagtttgttatc

SEQ ID NO: 107544 - DNA, 50 bp, homo sapien
atccaaggacttgaccatttgataasgtatttaattggatgcatcaaagt

SEQ ID NO: 107545 - DNA, 50 bp, homo sapien
catataagcaaagaagcatctgagtraatggtcaaaacggaaagaaatga

SEQ ID NO: 107546 - DNA, 50 bp, homo sapien
atcaatgcaagaattaagtatatacrcctttcagcttttgactgaaatta

SEQ ID NO: 107547 - DNA, 50 bp, homo sapien
agcttattttagcattgttcttactsctagatatttgatcttatttcaag

SEQ ID NO: 107548 - DNA, 50 bp, homo sapien
aaagtgattctacttttccacagaaytggtcctaggtctgattccagttt

SEQ ID NO: 107549 - DNA, 50 bp, homo sapien
ctaactgctccttaggaaaattcaarcactagaggcaacacagtatatgt

SEQ ID NO: 107550 - DNA, 50 bp, homo sapien
ctatttatcaaatatatgattctatwaaaaatggactgaaagattctagg

SEQ ID NO: 107551 - DNA, 50 bp, homo sapien
caagagaatgaatattattcagcatkaagattaaaggttgatttgagaca

SEQ ID NO: 107552 - DNA, 50 bp, homo sapien
gctttaaaaatacatttttaaataawgacaaatgtgatataaatcaattt

SEQ ID NO: 107553 - DNA, 50 bp, homo sapien
gtatactacagtttgtggttgagtgmatgtgctctgtagccaaactgcct

SEQ ID NO: 107554 - DNA, 50 bp, homo sapien
tgagtctcgttgctgttgccacccartatgaggagaatgttctctctagg

SEQ ID NO: 107555 - DNA, 50 bp, homo sapien
atacacccagactccagacttccaaygggaacacaactgagattctccca

SEQ ID NO: 107556 - DNA, 50 bp, homo sapien
ttctctctggtttaatccatgactgraaattggaaataaataccagaagt

SEQ ID NO: 107557 - DNA, 50 bp, homo sapien
aggtatgtatgtttgcatctgagaayaaaaactgagccaaataaataaat

SEQ ID NO: 107558 - DNA, 50 bp, homo sapien
atgattccctttctccattgtactaygaaaatatttctatgccacctatg

SEQ ID NO: 107559 - DNA, 50 bp, homo sapien
aggcctttggaccgtatggcaatgaktattcctgggcattgtgatcacat

SEQ ID NO: 107560 - DNA, 50 bp, homo sapien
atctctccttgaactgtggtaaccargttttcttatcttcaacccctatc

SEQ ID NO: 107561 - DNA, 50 bp, homo sapien
cagtctagacattgatatttaggaaygatctcggtctgtagagcagacag

SEQ ID NO: 107562 - DNA, 50 bp, homo sapien
tcagatatttatcattttggtagaaragacaaaagctattatttttaaaa

SEQ ID NO: 107563 - DNA, 50 bp, homo sapien
ttctttctttgaattgattcttaacrgaccattcccctattccattgttt

SEQ ID NO: 107564 - DNA, 50 bp, homo sapien
gatcgctgtatgtcactacatcatckcattaatccctcaagtcaaagaat

SEQ ID NO: 107565 - DNA, 50 bp, homo sapien
actcctttctttctatacattgttasacttagcctgtattaacacacaca

SEQ ID NO: 107566 - DNA, 50 bp, homo sapien
ccaaaatattagttatgctgtaatayatccattaagctatttaagaaaac

SEQ ID NO: 107567 - DNA, 50 bp, homo sapien
ggttaaataaaaagtactaagtaaaraatgaccaatgcttattatatgga

SEQ ID NO: 107568 - DNA, 50 bp, homo sapien
cctcttcacctcagagcttcaagaaraaagtacatgtggtgcagaaaaag

SEQ ID NO: 107569 - DNA, 50 bp, homo sapien
ttggtagtcattcctcctgttccaarttcaaatgtcaccccctcgtgaga

SEQ ID NO: 107570 - DNA, 50 bp, homo sapien
tcagctgtggcttggagccttggagraactttgcaactgaatcaagcaat

SEQ ID NO: 107571 - DNA, 50 bp, homo sapien
aatcaagctggagacccataagagcsaataatgtagttccagtccaggtt

SEQ ID NO: 107572 - DNA, 50 bp, homo sapien
gcatttgactgtgcagaataaagacraaattcctccttattgtttacagc

SEQ ID NO: 107573 - DNA, 50 bp, homo sapien
catacatctgaacaattaccatgagmaagagacacatatccttataggac

SEQ ID NO: 107574 - DNA, 50 bp, homo sapien
gtgaataaattccacataaatacaaygaacaaatccaaaactaatacaac

SEQ ID NO: 107575 - DNA, 50 bp, homo sapien
gttcttgattttataaatgcatgtayattaaaacctaaaatatatcctag

SEQ ID NO: 107576 - DNA, 50 bp, homo sapien
ctcctcctgatagtgtttcaatgaasttgacctttagtgcaagcagtaag

SEQ ID NO: 107577 - DNA, 50 bp, homo sapien
ggtttggtgtagtctctcaatttatraggtcgtttaattcaagttcaatt

SEQ ID NO: 107578 - DNA, 50 bp, homo sapien
acagaagtagtctgaagatcttttcsaatgaggtagaaaaccaaaagaac

SEQ ID NO: 107579 - DNA, 50 bp, homo sapien
aagacttttagatgattgcttcttcrcgtattttaagtgtgtcctccact

SEQ ID NO: 107580 - DNA, 50 bp, homo sapien
ttttttaaactttggaattcttgacytggttaagggaggattcacaaagc

SEQ ID NO: 107581 - DNA, 50 bp, homo sapien
aaccatcaggctactgagatagtgayagcaattttttttcatacttcttc

SEQ ID NO: 107582 - DNA, 50 bp, homo sapien
ttcacaccttagtcaatctggaataktaggatttcagataataaaatgct

SEQ ID NO: 107583 - DNA, 50 bp, homo sapien
gtgtattgtatgatatatatggtaarctgtagaaacattcctgtcaggaa

SEQ ID NO: 107584 - DNA, 50 bp, homo sapien
gattgtttagggtgttgcaggctaartaaggaatttaacagaatgagatg

SEQ ID NO: 107585 - DNA, 50 bp, homo sapien
tttggttgccagtttttttattgtarcacactgaatttatcgtctcatac

SEQ ID NO: 107586 - DNA, 50 bp, homo sapien
cttagagacagcctcattttactccratgccaatatgccaaacaaatatt

SEQ ID NO: 107587 - DNA, 50 bp, homo sapien
ttaaattattgctgctaattctgtcygaaccacacgattttcctctggga

SEQ ID NO: 107588 - DNA, 50 bp, homo sapien
ccaaataatcttaaatcctacctccrattacataattctgctgattaaag

SEQ ID NO: 107589 - DNA, 50 bp, homo sapien
ctggtgcttatcattctctcacatgyttttacagtcttctgtcatagata

SEQ ID NO: 107590 - DNA, 50 bp, homo sapien
agaaacacagaaaatccatgcagagrcaatgttctttacaatgctttttc

SEQ ID NO: 107591 - DNA, 50 bp, homo sapien
gcagaatagatagaaacaaaaacacmagaggaacttgagagtaaaaacaa

SEQ ID NO: 107592 - DNA, 50 bp, homo sapien
aatttaaggaccaaaatgccatctayagtttagacaaacttcatgtatca

SEQ ID NO: 107593 - DNA, 50 bp, homo sapien
ttttatgtgcatgtgtatttatccawctagttattttttctcctaatgtg

SEQ ID NO: 107594 - DNA, 50 bp, homo sapien
attcacacattgtttcatctatatakaatgcatagtctatttttgtcttg

SEQ ID NO: 107595 - DNA, 50 bp, homo sapien
tgtcatatctgttttacaatccctawtaggaaagaactgttaagaatttt

SEQ ID NO: 107596 - DNA, 50 bp, homo sapien
aaatatatttgtaatatgaactatasaagtaccgactaggctctggcact

SEQ ID NO: 107597 - DNA, 50 bp, homo sapien
aaatgcagctattatgccaaaaccaycagagtgctctttagcttcaggct

SEQ ID NO: 107598 - DNA, 50 bp, homo sapien
gatatttaacaaggctgaacaaaccyattatctactaacagaatctcata

SEQ ID NO: 107599 - DNA, 50 bp, homo sapien
tctaggatatcatttaagctaaaacwtactaacacatgacttaaccagag

SEQ ID NO: 107600 - DNA, 50 bp, homo sapien
ataaaaacagaatattacaatgcaasgaagagggagaaattcaccaaatg

SEQ ID NO: 107601 - DNA, 50 bp, homo sapien
ttagctattacttaaccatcacttamctattaatgtgacctctgctttct

SEQ ID NO: 107602 - DNA, 50 bp, homo sapien
cacagcactggacactgcaaaagtayctagtgagtgagtaaggatttctg

SEQ ID NO: 107603 - DNA, 50 bp, homo sapien
attacttttttagcatactctctatkagaatctacaacttcaactcagat

SEQ ID NO: 107604 - DNA, 50 bp, homo sapien
taattccatcctgtaaaaatatgtcygtaagttaaattcctaaaagtgcc

SEQ ID NO: 107605 - DNA, 50 bp, homo sapien
aaattcaaattttatgaatagtacartgaaacagtaaacatgttctaagg

SEQ ID NO: 107606 - DNA, 50 bp, homo sapien
cacacaaaaggagacgtatgcaaatkaagccataaggcaaaagtgtcaca

SEQ ID NO: 107607 - DNA, 50 bp, homo sapien
aaagagatcagagctgggtgatacastgacaaggtgaaacagaatgccta

SEQ ID NO: 107608 - DNA, 50 bp, homo sapien
ctttccttggcattttctagtgggcyacataataacatcaaacatgtaat

SEQ ID NO: 107609 - DNA, 50 bp, homo sapien
ctcccttctgcagctataaaatatgkataacacctgaaataggaagagat

SEQ ID NO: 107610 - DNA, 50 bp, homo sapien
aatgtcagcttccctattaaccttcraaaatgatttgaagaaaaagcaat

SEQ ID NO: 107611 - DNA, 50 bp, homo sapien
aactacctatgtcagatctgcggaamgatgagtagaatgggtagtgaaat

SEQ ID NO: 107612 - DNA, 50 bp, homo sapien
aaagaattatgacaatgtgtatcttsaaaaaatcaacttcacactgaaag

SEQ ID NO: 107613 - DNA, 50 bp, homo sapien
tgttccattgactgcttatatttaaytgactctggattcaattttctttt

SEQ ID NO: 107614 - DNA, 50 bp, homo sapien
tacgctttatacagcaaaaatttcasagttacaactaacattatgttttc

SEQ ID NO: 107615 - DNA, 50 bp, homo sapien
atataagctgagatctgaaggataartaagtgttgccaggtggagatggt

SEQ ID NO: 107616 - DNA, 50 bp, homo sapien
taggccaaatgagtttccatggaackgaatgtggtaagagaaaaacagag

SEQ ID NO: 107617 - DNA, 50 bp, homo sapien
aactagcataggtgctaactaaaaasttattgaaatcagttaggggaaag

SEQ ID NO: 107618 - DNA, 50 bp, homo sapien
aacatatataagtggaaatatgcatraatgaaggagtattcttgtaattg

SEQ ID NO: 107619 - DNA, 50 bp, homo sapien
attttactgttgaacagagcatcaamtctctaaagacttcaagaaatcaa

SEQ ID NO: 107620 - DNA, 50 bp, homo sapien
ctgtgtcacttcttttcttaaattayccaagtggagtccaatttctcttc

SEQ ID NO: 107621 - DNA, 50 bp, homo sapien
aaagaactgttccagtggcccttcaraaaccacagaatcaaacactgcag

SEQ ID NO: 107622 - DNA, 50 bp, homo sapien
tggttatttctcagttgacttgagakaaatactaccatgaatcttatagg

SEQ ID NO: 107623 - DNA, 50 bp, homo sapien
cagggaatcaatttatgctttttaawcctagagatgtaggaaggaaaaga

SEQ ID NO: 107624 - DNA, 50 bp, homo sapien
caagaccctttctttaatgggtacawaatgtcaaaaatatttttatataa

SEQ ID NO: 107625 - DNA, 50 bp, homo sapien
ttttcatttccaaatcatttgcactraaagtatattcactcttatttggc

SEQ ID NO: 107626 - DNA, 50 bp, homo sapien
gatagctttgattttgaaataaataygtaggtcagtctgaaataatgttc

SEQ ID NO: 107627 - DNA, 50 bp, homo sapien
taatttccttcaccaaggattcaackgatctctttaatacctgattgctt

SEQ ID NO: 107628 - DNA, 50 bp, homo sapien
taacataccatgaaattagataaaarttatagtgtcattccctcccaacc

SEQ ID NO: 107629 - DNA, 50 bp, homo sapien
tatgaagaaagacatgaggttcaccratgtcaagcgatttagcttaatga

SEQ ID NO: 107630 - DNA, 50 bp, homo sapien
tgcagtggagatcactgtgagctaayggatgataaaatactttaaatgct

SEQ ID NO: 107631 - DNA, 50 bp, homo sapien
gaattgcctcatgatttttaaaatayggattcctgtgcatttcttctaga

SEQ ID NO: 107632 - DNA, 50 bp, homo sapien
gcatcagtcacctaaggcctaattayatctccttcagcaaccatcgcaat

SEQ ID NO: 107633 - DNA, 50 bp, homo sapien
aacattgcttgaaaatgtaagaccasatgacaataaaataagatcttgga

SEQ ID NO: 107634 - DNA, 50 bp, homo sapien
agcgaagaatcacagagaaacaatcytaaactgctgaaatttcctctccc

SEQ ID NO: 107635 - DNA, 50 bp, homo sapien
aatacctgtgtaagtccattaaaaaktacaggtttgatgtagaatcagag

SEQ ID NO: 107636 - DNA, 50 bp, homo sapien
atcttaaagtcctcctttcctttacwatctttagtaccatatttccttca

SEQ ID NO: 107637 - DNA, 50 bp, homo sapien
tctaagggtggctaaagtcaaagacrgattattaagtggtttatcctgtt

SEQ ID NO: 107638 - DNA, 50 bp, homo sapien
tcaagtgtgtaagggtctaaggtccrgaaggtagtgatccacttcacctt

SEQ ID NO: 107639 - DNA, 50 bp, homo sapien
tgcattcatatctctcattatatacraaaattaagatagattaaagattt

SEQ ID NO: 107640 - DNA, 50 bp, homo sapien
gcaaatcaagtaggagcttaataacrgtccattttattccttttgaacac

SEQ ID NO: 107641 - DNA, 50 bp, homo sapien
taaagtcagagtagtgtgaaaatcaycaacttataaaatacctcagtatg

SEQ ID NO: 107642 - DNA, 50 bp, homo sapien
aacacggtagaacatggtctgtttcratcaataattatgtgttcaaaagg

SEQ ID NO: 107643 - DNA, 50 bp, homo sapien
ggtcacaatgtgcccgtattgttatsgaaaagacaagtgttcagctttct

SEQ ID NO: 107644 - DNA, 50 bp, homo sapien
taaacttcaaaaaaagactactagargatgtggtagacaatatcagaaga

SEQ ID NO: 107645 - DNA, 50 bp, homo sapien
ttcttgctctcagcaagtcttgttcrattagggttctagctggtaaaatg

SEQ ID NO: 107646 - DNA, 50 bp, homo sapien
ttcttgatattatcacttttcctcartctttgattacttattaaactctt

SEQ ID NO: 107647 - DNA, 50 bp, homo sapien
ccaaggggaaagttcatttccattayaggattagggtggagagaccagcc

SEQ ID NO: 107648 - DNA, 50 bp, homo sapien
gatatcttagttttgtagacacatayaggagtaattcagcctagaaatca

SEQ ID NO: 107649 - DNA, 50 bp, homo sapien
tgagaattagccattgacggcttaartggtgctaaagaatcttagaaaat

SEQ ID NO: 107650 - DNA, 50 bp, homo sapien
tcattgctaagccagtaaaagtaaaytgattggtatcttaggaattgatt

SEQ ID NO: 107651 - DNA, 50 bp, homo sapien
tagaataaataataacaatattaaakgctaaatcagagctaccttgtggg

SEQ ID NO: 107652 - DNA, 50 bp, homo sapien
ctgttatacctccaggattctcagcrcattatcactgcacatttggcaag

SEQ ID NO: 107653 - DNA, 50 bp, homo sapien
gcattcatcaaccaacaatgatttasgtttctcagtattactagaacact

SEQ ID NO: 107654 - DNA, 50 bp, homo sapien
ggggagctattgtaacatatcaacayattataatgtcatataccgaataa

SEQ ID NO: 107655 - DNA, 50 bp, homo sapien
agagctctcttaaaacatttcctgcraagatatttttcactttttaaaga

SEQ ID NO: 107656 - DNA, 50 bp, homo sapien
aatatagattaataaatagaatgtcraaaaagaagaacaaagttggagga

SEQ ID NO: 107657 - DNA, 50 bp, homo sapien
atacatacagaaaaaatatcaaacaygtatttagcaactgcatatgtgtg

SEQ ID NO: 107658 - DNA, 50 bp, homo sapien
acacaagtatttcctgccattttaarccattttgctcttatatgcttatt

SEQ ID NO: 107659 - DNA, 50 bp, homo sapien
acttaatagctcacttattggctaarcctgttttcctggatattggtaat

SEQ ID NO: 107660 - DNA, 50 bp, homo sapien
tatcattctgtcaaactatacggtascttttagcagattttaagagaaag

SEQ ID NO: 107661 - DNA, 50 bp, homo sapien
agatgatctgttgtatccgcaatagmatatctgaaggaaatttactagat

SEQ ID NO: 107662 - DNA, 50 bp, homo sapien
ggaacaaggctagactctctcttgaygttcctttgatgacctaaaatgtt

SEQ ID NO: 107663 - DNA, 50 bp, homo sapien
gaatgcaaattcttaacttcctcaayagacctttacttagcatctaaagt

SEQ ID NO: 107664 - DNA, 50 bp, homo sapien
tgcaaaatcagaaaaggcttatcaasctatgaaagaagagataaattggg

SEQ ID NO: 107665 - DNA, 50 bp, homo sapien
tccactttccttattgattttgagtmaatgcactgaagagtcctccaaaa

SEQ ID NO: 107666 - DNA, 50 bp, homo sapien
tgagggtgcataataatcaaagtaakattaaaactcagaaaaaaatgaat

SEQ ID NO: 107667 - DNA, 50 bp, homo sapien
agagcgctgcaaatggcacctatgamaataataaatgtgtatgatagcaa

SEQ ID NO: 107668 - DNA, 50 bp, homo sapien
tttgcttttaaggaactttgtggctsaagtattctaccacttactttggc

SEQ ID NO: 107669 - DNA, 50 bp, homo sapien
gtcaagtgagataatccagctgttakaaaatcacgatgtccaaaacaatg

SEQ ID NO: 107670 - DNA, 50 bp, homo sapien
gacagataagcctctttactttcatytatgtcatggtcagtcttttcttg

SEQ ID NO: 107671 - DNA, 50 bp, homo sapien
tgtgattaatatacatgtccaaataytatatagcactgggcacttttcac

SEQ ID NO: 107672 - DNA, 50 bp, homo sapien
gaacaaaatatgaattaggaccttgrataatatgttctactcttatgtca

SEQ ID NO: 107673 - DNA, 50 bp, homo sapien
tcatagttttatataatcaatgtaartaattatcgagtacccaccactct

SEQ ID NO: 107674 - DNA, 50 bp, homo sapien
gcatgattttatttctttgttaatgwcacctatagctgcttattctgacc

SEQ ID NO: 107675 - DNA, 50 bp, homo sapien
tgaacaatgccactataaacattcayggacaaggctttttgtggacatat

SEQ ID NO: 107676 - DNA, 50 bp, homo sapien
aaatctggaattcccagaggttatayattgcacctgaggccatctggcta

SEQ ID NO: 107677 - DNA, 50 bp, homo sapien
acgcctcagtgctccctcgaaggacractctggaatgccagtttttatct

SEQ ID NO: 107678 - DNA, 50 bp, homo sapien
cctttggaaactatgaaacactgtayagacgggaggtattagtatcactg

SEQ ID NO: 107679 - DNA, 50 bp, homo sapien
aaattcaacccttaggaagatttgaytaccaaaaagatgaaatctggtca

SEQ ID NO: 107680 - DNA, 50 bp, homo sapien
gccaatagaaattgaccttcatatakcccaaatgttggctttaatactag

SEQ ID NO: 107681 - DNA, 50 bp, homo sapien
gctgaactccagtcatgaaccgtcasctagctaatatctatcttctgtga

SEQ ID NO: 107682 - DNA, 50 bp, homo sapien
gtctgacatttcctacttaacgttaygccctctcaaaaaattacatattt

SEQ ID NO: 107683 - DNA, 50 bp, homo sapien
aataagggagactgttccttcctaargatttgaacactcagatggatcgc

SEQ ID NO: 107684 - DNA, 50 bp, homo sapien
aagataagattaccattcacgttccrgatattgggttagaattttgaaag

SEQ ID NO: 107685 - DNA, 32 bp, homo sapien
gaattttgtaattttcrttgctctccttgagc

SEQ ID NO: 107686 - DNA, 50 bp, homo sapien
aatctgtcactttttatatttgacaytgtactggaaggcaagtaaaagaa

SEQ ID NO: 107687 - DNA, 50 bp, homo sapien
ttagctcctatcactgaatgcgtacyaccaccagagagaggtgaggagat

SEQ ID NO: 107688 - DNA, 50 bp, homo sapien
atcaggaataccaaagaattaatctkaactaatgtgattttgtttgggga

SEQ ID NO: 107689 - DNA, 50 bp, homo sapien
gactcaccttgccagttcacgtttamaaaattggcacattataattttac

SEQ ID NO: 107690 - DNA, 50 bp, homo sapien
actccttccttctggacacattcatyacaggtgtgctcgaagcagcaaga

SEQ ID NO: 107691 - DNA, 50 bp, homo sapien
aaatacacaatcctatagagcatttsaggaatggataatctgggacccat

SEQ ID NO: 107692 - DNA, 50 bp, homo sapien; identical to SEQ ID NO: 107229

SEQ ID NO: 107693 - DNA, 50 bp, homo sapien
aaatttggggaatatatgtggaaatraaccctaaagtgttagatcagggt

SEQ ID NO: 107694 - DNA, 50 bp, homo sapien
ctgttaacaaggagtgtctcctcatsaaggtggcagccaccagaacgagg

SEQ ID NO: 107695 - DNA, 50 bp, homo sapien
tctattcttaagagctacctcttacraagtttgcagaaattgatcactga

SEQ ID NO: 107696 - DNA, 50 bp, homo sapien
gtttacatgttatgtgctgtaggcawaagagcatcttaagaagatactat

SEQ ID NO: 107697 - DNA, 50 bp, homo sapien
tgaacttgaaatcatatcctatgccrctatttatgactcagatcagaaag

SEQ ID NO: 107698 - DNA, 50 bp, homo sapien
tccaaaggggttcaagagttatttayaggtgattgcttatatagttggcc

SEQ ID NO: 107699 - DNA, 50 bp, homo sapien
gtctttgtgtgcttatctttatccaycacagcagttgattagcactgctt

SEQ ID NO: 107700 - DNA, 50 bp, homo sapien
tgaatgtcggggggcactctgaagaygtaattgtatcattgtgtcctgct

SEQ ID NO: 107701 - DNA, 50 bp, homo sapien
agtaggtgcctgaaaatatggaaatractgagtgcattctatctcaatag

SEQ ID NO: 107702 - DNA, 50 bp, homo sapien
aatgataaagtccaaatacctcttamctatgcattaattccagcatctcc

SEQ ID NO: 107703 - DNA, 50 bp, homo sapien
ttacaatattttcaatatgctgctckaaaaatgccatttatgtttataat

SEQ ID NO: 107704 - DNA, 50 bp, homo sapien
tatgcattatgtctgacggcaagtaygtatatttggaagctgttttggtt

SEQ ID NO: 107705 - DNA, 50 bp, homo sapien
ttgagttggaatttgctatcaagagyaaataggcgaagaaggagggtact

SEQ ID NO: 107706 - DNA, 50 bp, homo sapien
atataccacaatattgaaacagtacragttttaagcgatgaggatttaga

SEQ ID NO: 107707 - DNA, 50 bp, homo sapien
gcaggtcaagctgcgaaagaatgtcragcatggtagatggctcatagagt

SEQ ID NO: 107708 - DNA, 50 bp, homo sapien
ataaaacactatttaggcaaattcaycaatggacactgtgtactataact

SEQ ID NO: 107709 - DNA, 50 bp, homo sapien
ctctcttagaaggctcctaggaagaygtatgactacccaggtaactcagt

SEQ ID NO: 107710 - DNA, 50 bp, homo sapien
catccacaacagtaaagctaattacmcttgactgtagcatttctaataca

SEQ ID NO: 107711 - DNA, 50 bp, homo sapien
gcagtaaaactggctaaagacacaaygtgcagaatttcatttgtcaattt

SEQ ID NO: 107712 - DNA, 50 bp, homo sapien
tagaattgtaaaaactgtttatttcsaaagagtgcaaatatacacatatc

SEQ ID NO: 107713 - DNA, 50 bp, homo sapien
agtaaaaatagaagacactgtggacrgaatatgaagttttcatttatata

SEQ ID NO: 107714 - DNA, 50 bp, homo sapien
ttctggttcttctgtgattttctcartgacactagtcaatataaacatat

SEQ ID NO: 107715 - DNA, 50 bp, homo sapien
tagtaaaaattcatattcttgatcamctaaaatgtatccccattttaact

SEQ ID NO: 107716 - DNA, 50 bp, homo sapien
taccttcacagtatatccaggatcaygcacgccactcctcacttcactgc

SEQ ID NO: 107717 - DNA, 50 bp, homo sapien
cctctggtacaccatgtaaatcatastaagtgagacagaatatggaaaga

SEQ ID NO: 107718 - DNA, 50 bp, homo sapien
gataaggggtacactgtatcagctcrtcatctgcagttactagaatagct

SEQ ID NO: 107719 - DNA, 50 bp, homo sapien
gtgtctttcttgttgattgggaatayactacctccatatattgggtgaga

SEQ ID NO: 107720 - DNA, 50 bp, homo sapien
agtgagtggaatcaggaatgatcccractttctcattcatacaattcatg

SEQ ID NO: 107721 - DNA, 50 bp, homo sapien
ggtgaacgatcctatagtaatcacartaatggcagcatttgcccttaagg

SEQ ID NO: 107722 - DNA, 50 bp, homo sapien
tacctctacagacgaggtcttcagcratttagaataaagctttgtggtga

SEQ ID NO: 107723 - DNA, 50 bp, homo sapien
caagctggaattcactgagatgtacragggcccatttggtgtttagtttc

SEQ ID NO: 107724 - DNA, 50 bp, homo sapien
cattctttcatttattcaaattgatkaatgcgattatatggaaattaaaa

SEQ ID NO: 107725 - DNA, 50 bp, homo sapien
cattcatggagtgccagcaagatgayggaccttgtataggaacaggagta

SEQ ID NO: 107726 - DNA, 50 bp, homo sapien
tagtacagtacccagaaatagaagayggttaatagaaatatattttgaat

SEQ ID NO: 107727 - DNA, 50 bp, homo sapien
ggaaatagaagtgttccactaaccasagaactatagtctatgaacagtcc

SEQ ID NO: 107728 - DNA, 50 bp, homo sapien
gattcatttatattacaaataaaaayaatgtccattccctccatttcaga

SEQ ID NO: 107729 - DNA, 50 bp, homo sapien
tacagtaacaagattcaacgtatcamcttgggcagaattctcatattcag

SEQ ID NO: 107730 - DNA, 50 bp, homo sapien
ccagatgtacaaaacagagtgctgamagtgcccaagaaaaccactccagt

SEQ ID NO: 107731 - DNA, 50 bp, homo sapien
gggttaacaagtctggtcacatttarcaactctcatgaagcctagatggt

SEQ ID NO: 107732 - DNA, 50 bp, homo sapien
tttgttttttgcattgaggaattcaygcacatttagagttctatctgctt

SEQ ID NO: 107733 - DNA, 50 bp, homo sapien
gcccttgctttaggtccaactaggastattctgagtagaggaatagctaa

SEQ ID NO: 107734 - DNA, 50 bp, homo sapien
aggacatttgatgggcacaaagacayggagaattccaggtggagaataaa

SEQ ID NO: 107735 - DNA, 50 bp, homo sapien
cttgaatacaacctctggaatactcraacttgaattccttcaaggaactt

SEQ ID NO: 107736 - DNA, 50 bp, homo sapien
ataaatgacaggctaaaaagatcacraagattatacttaaaaggtgtata

SEQ ID NO: 107737 - DNA, 50 bp, homo sapien
agtttttttggttgctttaaatgaaygaatttctcctagcaaatagaagc

SEQ ID NO: 107738 - DNA, 50 bp, homo sapien
aacaagttaagcaataagcaggtgaycttctattcttttacttaccacct

SEQ ID NO: 107739 - DNA, 50 bp, homo sapien
cagatccaactacaattataagagcractaaaaatacaggtgggatgtaa

SEQ ID NO: 107740 - DNA, 50 bp, homo sapien
ctaagttttgttatttagtctgctayacatatgagaaagtaaactgacga

SEQ ID NO: 107741 - DNA, 50 bp, homo sapien
tcaataacccctctgaattctaagckcaaagcaattatcttggagaagcg

SEQ ID NO: 107742 - DNA, 50 bp, homo sapien
ctactgtagatacatgtacacaagasaatctaattttgaagtcttcattt

SEQ ID NO: 107743 - DNA, 50 bp, homo sapien
tagcaattagtacattatatatacayggatgcttccttttcataagtcag

SEQ ID NO: 107744 - DNA, 50 bp, homo sapien
ttggttaacaaagttattaaatagayacaatggcatcagcctaggctatc

SEQ ID NO: 107745 - DNA, 50 bp, homo sapien
ttcaggcagtttaccagttctattayaacaatgtgtagctgaggtggtgg

SEQ ID NO: 107746 - DNA, 50 bp, homo sapien
cctgagtatatgatcacacaatttgraatataatccattttgttttgtgt

SEQ ID NO: 107747 - DNA, 50 bp, homo sapien
caatgcaggcagattctggatacttkcagccagctctaaagcccattgtg

SEQ ID NO: 107748 - DNA, 50 bp, homo sapien
acttatgattttttatttcctggatyaatatagcatgtgaatacttctaa

SEQ ID NO: 107749 - DNA, 50 bp, homo sapien
tcagcagtatcccaccctctaactcsaactccccattttccaactcccat

SEQ ID NO: 107750 - DNA, 50 bp, homo sapien
cccgtcaattaacactctaatgggaratttcaacaatccatatgacagga

SEQ ID NO: 107751 - DNA, 50 bp, homo sapien
atgatgctgtgcatatatacataaarctaacagagattcagaagaacatt

SEQ ID NO: 107752 - DNA, 50 bp, homo sapien
tgctgttttaggtaaatgaaaaaaartatctctgaaacacgagtttcttc

SEQ ID NO: 107753 - DNA, 50 bp, homo sapien
cttccttagatgttcatggccggcascttaagaatcctaagacctcaact

SEQ ID NO: 107754 - DNA, 50 bp, homo sapien
gggctggtgagtcttcaatgaaatarctgagcagaaatgtttaaataatg

SEQ ID NO: 107755 - DNA, 50 bp, homo sapien
ggcgtgcagagaaaatggtccttaaygtcactccctgttgaccgcgcagg

SEQ ID NO: 107756 - DNA, 50 bp, homo sapien
gggtgtctattttggattggcatcargatcatccacccaatctatgagtg

SEQ ID NO: 107757 - DNA, 50 bp, homo sapien
gttttactttggactcagaagtggcygacttactaagaggtcttttccca

SEQ ID NO: 107758 - DNA, 50 bp, homo sapien
gacagggctatattttatatatctarggtaactcaggtatgcctattaga

SEQ ID NO: 107759 - DNA, 50 bp, homo sapien
agatggaagtttattcagtataaacragcatgaggtttcacataagtaat

SEQ ID NO: 107760 - DNA, 50 bp, homo sapien
catgaggcaggctctgataaagacargatttagagaagagctttctctta

SEQ ID NO: 107761 - DNA, 50 bp, homo sapien
cttatctgcagcttgctgttagtacyatctaccacttggagccatcctag

SEQ ID NO: 107762 - DNA, 50 bp, homo sapien
tgttatttctatctgatttcttgaasagcatgattaatttaagcagcaaa

SEQ ID NO: 107763 - DNA, 50 bp, homo sapien
aacccaggtgtcactgaagattgtayagatttggggaatgttgcagtatt

SEQ ID NO: 107764 - DNA, 50 bp, homo sapien
ttatcatcacaaacataaccatcacmgaaattagattttgctgtttcagg

SEQ ID NO: 107765 - DNA, 50 bp, homo sapien
atacaacttgctgtgataaaggaaakagcctactgttttagtgtttcatc

SEQ ID NO: 107766 - DNA, 50 bp, homo sapien
cttaaaaagtgcatctgcttctaaakagccataaatatctcctaaagccc

SEQ ID NO: 107767 - DNA, 50 bp, homo sapien
taactactaagttacacatatacacrgaggagaaaattctatgagactgg

SEQ ID NO: 107768 - DNA, 50 bp, homo sapien
attgcagattgggctgacaagaatckcttataaatagtcctaatgccccc

SEQ ID NO: 107769 - DNA, 50 bp, homo sapien
tatgaaaagagttgatattccttccratttttgatttggggatagtaaca

SEQ ID NO: 107770 - DNA, 50 bp, homo sapien
taaatacatttgtttaatatgctaayctaggtgaatttcagtttgttttc

SEQ ID NO: 107771 - DNA, 50 bp, homo sapien
ataagagatctaaaaatataatgtgkcccacagcagccctgacttcagtc

SEQ ID NO: 107772 - DNA, 50 bp, homo sapien
tattacatggattacagtgagttcayatttgcaaaccacagaggatacaa

SEQ ID NO: 107773 - DNA, 50 bp, homo sapien
tttacttattcatcatctattcagcrgaaatatgaactctacagttggtg

SEQ ID NO: 107774 - DNA, 50 bp, homo sapien
aaattgagagcaagcaccacatgagstctggcggaatacgtatgctttcc

SEQ ID NO: 107775 - DNA, 50 bp, homo sapien
tgtctacagcacattctgtgagtttycatttaatagttttcaaagcattt

SEQ ID NO: 107776 - DNA, 50 bp, homo sapien
gacctggggaagcttattaaggagaygatgttcttgtacatttctaatcc

SEQ ID NO: 107777 - DNA, 50 bp, homo sapien
tgaataaaagctcaggaatcacttcsagacattcgggatcagagcaggac

SEQ ID NO: 107778 - DNA, 50 bp, homo sapien
aaagcaaacaatttagttagcataamcaaatggataactaaaaattcaac

SEQ ID NO: 107779 - DNA, 50 bp, homo sapien
attttctgtagggcagttatgctaayaataaattctctcagtttttatta

SEQ ID NO: 107780 - DNA, 50 bp, homo sapien
aagatttatactttgggcaaatagcytaccctttctcatcctccattttc

SEQ ID NO: 107781 - DNA, 50 bp, homo sapien
agtagaaatgaatgtgcactaatgarctttattttctacacagttgcact

SEQ ID NO: 107782 - DNA, 50 bp, homo sapien
ttcttgtttggttggtcagttgttayatatttgtgtatagccagtaggat

SEQ ID NO: 107783 - DNA, 50 bp, homo sapien
gaccaatacacttgggacagatagartaaaaataaagggcaaaagtcttc

SEQ ID NO: 107784 - DNA, 50 bp, homo sapien
attcaaatgaacaagcactttgttawattactgctaaacattacggaaac

SEQ ID NO: 107785 - DNA, 50 bp, homo sapien
tttcttataacatggtctatactcargccaacaactttcatgcacaatca

SEQ ID NO: 107786 - DNA, 50 bp, homo sapien
tcacaaaatgaataaatatgttcacygaaaggcatgcacaagaacgttca

SEQ ID NO: 107787 - DNA, 50 bp, homo sapien
gctctccagggaattttacaatagcrgaaagttcagatctcccaaatttc

SEQ ID NO: 107788 - DNA, 50 bp, homo sapien
gccttgtttgaaactgttagaactaygtgattcaaaagaaagactattac

SEQ ID NO: 107789 - DNA, 50 bp, homo sapien
agaaggtagaattaatagtacataaygtgtggttggatatgggagctgat

SEQ ID NO: 107790 - DNA, 50 bp, homo sapien
tttgaattttttcctcaggattctayaattggtcattttcagttataagc

SEQ ID NO: 107791 - DNA, 50 bp, homo sapien
aacctgttgactagcttctgagatamatagatccctttgaaagtactacc

SEQ ID NO: 107792 - DNA, 50 bp, homo sapien
tcatcataaactcttattattaaaaktcagactacttgttgaaattttac

SEQ ID NO: 107793 - DNA, 50 bp, homo sapien
tatatgctgtatctgaaatatatacyggacttgttatgaataaaaaggtt

SEQ ID NO: 107794 - DNA, 50 bp, homo sapien
taaaggataatataagtgccgtaaaractccattgtaagcacagaaaatg

SEQ ID NO: 107795 - DNA, 50 bp, homo sapien
gcaccatcatgaaatatgacaatacrgataatgctcttggttagttcact

SEQ ID NO: 107796 - DNA, 50 bp, homo sapien
ccatatatctttaccctttcccattytactcaaagcatgattccactcaa

SEQ ID NO: 107797 - DNA, 50 bp, homo sapien
ttttcttctatcctcaaattggaaawagcttatgattccactggtgtcaa

SEQ ID NO: 107798 - DNA, 50 bp, homo sapien
tacattgaaaaccatgtaaccttctyggtcttgtaaaatatctttgctat

SEQ ID NO: 107799 - DNA, 50 bp, homo sapien
taaaagctgcagtatttaaaatatgragtcaattagggagggccctaatc

SEQ ID NO: 107800 - DNA, 50 bp, homo sapien
aatcgtgttctcttctattgtacacrctgaaggcttttgtttactacagc

SEQ ID NO: 107801 - DNA, 50 bp, homo sapien
atattgtaagtttaaattattttcayattgacagtggcctcaaatactag

SEQ ID NO: 107802 - DNA, 50 bp, homo sapien
tgacatgctcccagaggtgcctctcyaaacacatttctgacatgtaacag

SEQ ID NO: 107803 - DNA, 50 bp, homo sapien
tgctaaccccagtcttagaagacaawtccgtcctcagagcacacagaaga

SEQ ID NO: 107804 - DNA, 50 bp, homo sapien
ttgcacagcactgacctgaatggtayagcaattatgcgacctaagtgaga

SEQ ID NO: 107805 - DNA, 50 bp, homo sapien
caaacaataaaggattagatttagamatatcagcaggaatttaaaaagta

SEQ ID NO: 107806 - DNA, 50 bp, homo sapien
agaggtttggcaaatttaacatgtawgagttatagtccatttgtgttgaa

SEQ ID NO: 107807 - DNA, 50 bp, homo sapien
gtggatggacctttctatcgctacartatgtcaattcgagttcaatgctc

SEQ ID NO: 107808 - DNA, 50 bp, homo sapien
tgaatgaacataactaaagaagaaaygtcaaggctgagaaaaagaaaagc

SEQ ID NO: 107809 - DNA, 50 bp, homo sapien
ttagttgttagaactttgcaccctayaatttctattttgttcattttcat

SEQ ID NO: 107810 - DNA, 50 bp, homo sapien
ctcaagaagttgatcaaaatttgcarcactcatgtgggtcctatgaagtc

SEQ ID NO: 107811 - DNA, 50 bp, homo sapien
ttagatatgaaatggcttattacacrgatttgtgactcacaatcaagaag

SEQ ID NO: 107812 - DNA, 50 bp, homo sapien
tttcttgactggacttcgctccagaktcatgatccaggttaaacctaact

SEQ ID NO: 107813 - DNA, 50 bp, homo sapien
tatgtcctggcaaaagaggtcaatcrgatcactaatgactaagaaatata

SEQ ID NO: 107814 - DNA, 50 bp, homo sapien
actccattgcaaacatggccaaagastatctagcttatctttcttaagaa

SEQ ID NO: 107815 - DNA, 50 bp, homo sapien
ttaaaaaataactactgggaaattasgttagcatatgttaaaaccaagag

SEQ ID NO: 107816 - DNA, 50 bp, homo sapien
acacatatatgaatttgtacatacayctataacagaaattggtctttaaa

SEQ ID NO: 107817 - DNA, 50 bp, homo sapien
tcaaaagagatattccatgattaaartggcccctacaggacaaattgaga

SEQ ID NO: 107818 - DNA, 50 bp, homo sapien
gtgagttgcccaccatctaagagccrgaattaatatctctaccctccatt

SEQ ID NO: 107819 - DNA, 50 bp, homo sapien
tagaacctgaatcatattcagaacastaatttcattgaagtctgaaaagt

SEQ ID NO: 107820 - DNA, 50 bp, homo sapien
agttaacactttgttaggtcaagtargcatgagaaacaggagatggaaag

SEQ ID NO: 107821 - DNA, 50 bp, homo sapien
ttgcttctctggacttgtactctacmataaagcatgtgctcataagatta

SEQ ID NO: 107822 - DNA, 50 bp, homo sapien
tttagctcttaagtcttagaaaaaaktaagatcatcgttcttcctcgctc

SEQ ID NO: 107823 - DNA, 50 bp, homo sapien
atccccaagtctacatactgagggaratcaaaattaaaacaaggctgggc

SEQ ID NO: 107824 - DNA, 50 bp, homo sapien
gtttagagtagtcttgggcaaaataygttcttagcaagtgtctctggctg

SEQ ID NO: 107825 - DNA, 50 bp, homo sapien
accacacaacagaagtcacaatagamagtggttagcagagggagatacga

SEQ ID NO: 107826 - DNA, 50 bp, homo sapien
agagttgaaaactactagtctccaayataagaaaaatagaaaaattacac

SEQ ID NO: 107827 - DNA, 50 bp, homo sapien
attacattctctgcttctgcttaagwacattcctcttggtttccctcagt

SEQ ID NO: 107828 - DNA, 50 bp, homo sapien
ccacctattcaggaggcagaaaaatsatcagtggaccaaatttataaccc

SEQ ID NO: 107829 - DNA, 50 bp, homo sapien
ttctatggcaatggtaaaacaacaaygtatccatctgtctggctacataa

SEQ ID NO: 107830 - DNA, 50 bp, homo sapien
ctgacagtggtaaagaagcagattckcaagtagctaggaaacagagctta

SEQ ID NO: 107831 - DNA, 50 bp, homo sapien
tctgctttatgtaatcatgataagawaaaagtgttacaatatattaaata

SEQ ID NO: 107832 - DNA, 50 bp, homo sapien
aagactgttcaaaagccctgggaaaygggtccagaaagagaatttcaaga

SEQ ID NO: 107833 - DNA, 50 bp, homo sapien
atgtaaaagtaaagacagctgaatcscattactatttatgagttaattaa

SEQ ID NO: 107834 - DNA, 50 bp, homo sapien
agacatttaatttttataaagtcatsagatgcaaaatagtaaacagacat

SEQ ID NO: 107835 - DNA, 50 bp, homo sapien
tagctacttgagacaaaggattatasatacagatatttataaaaattaca

SEQ ID NO: 107836 - DNA, 50 bp, homo sapien
tatccatgaaaaagacatcttccaawataagggtaatctgaatttcctgg

SEQ ID NO: 107837 - DNA, 50 bp, homo sapien
gcatccttaaaacctctatgaccacrgatggagaaaggagaattaaagaa

SEQ ID NO: 107838 - DNA, 50 bp, homo sapien
tgttatgtatagatcttgtttcctaygacagaataattaatgcaatatag

SEQ ID NO: 107839 - DNA, 50 bp, homo sapien
gtactaaacgggaggaccaacacagrtaagtgcttcccaacccttccaga

SEQ ID NO: 107840 - DNA, 50 bp, homo sapien
tggagtgtgggtttaagactgctgcyaacctggatttccagtacagctct

SEQ ID NO: 107841 - DNA, 50 bp, homo sapien
attcatctcgtctttcacatggatcrctattctcttcttggaagccatga

SEQ ID NO: 107842 - DNA, 50 bp, homo sapien
ggaggtagagaaagaatatatgtacragtatttttatctagcgtatcttt

SEQ ID NO: 107843 - DNA, 50 bp, homo sapien
agtgggaagcactgatttacgcagamatatataaatggtgtgtgaaacag

SEQ ID NO: 107844 - DNA, 50 bp, homo sapien
cttcattctgtctttcatatgagggwaaaattctccatcaaaggtcaaca

SEQ ID NO: 107845 - DNA, 50 bp, homo sapien
tactctggtcattttcttctttatcrctgttccaagaccaccaggcaatt

SEQ ID NO: 107846 - DNA, 50 bp, homo sapien
tggttgctgactaattcaacaaatgwactaacagcagggttattgcttgg

SEQ ID NO: 107847 - DNA, 50 bp, homo sapien
agggttgatacccagtagatatttaycgaatgaatgaataaatgaatcta

SEQ ID NO: 107848 - DNA, 50 bp, homo sapien
ttgttctcttcttattcataaaggcrctaataggcatttctctttcaaca

SEQ ID NO: 107849 - DNA, 50 bp, homo sapien
ccattaaaaaccgctgtcctaaagartaatcgctaaaagcaacaacaaca

SEQ ID NO: 107850 - DNA, 50 bp, homo sapien
gttaattcaattgcaacttgtttggytcttcctcaacaatagccagtttt

SEQ ID NO: 107851 - DNA, 50 bp, homo sapien
gtatataactgaattaagtgtgtaasgtgtaacttgaagtaattaagttt

SEQ ID NO: 107852 - DNA, 50 bp, homo sapien
gtaagatcatgtaactactttgcttraaatcctctcccagtttcccatct

SEQ ID NO: 107853 - DNA, 50 bp, homo sapien
aaagttgaagttcttacaatgatcckagggccctacataatctgacctct

SEQ ID NO: 107854 - DNA, 50 bp, homo sapien
aagaactcgagcaaatcctgacaccwctctcataccatatacaaaaaaaa

SEQ ID NO: 107855 - DNA, 50 bp, homo sapien
aagactcgaagaagatttccttttgsagtggctgatcaaacatcttccac

SEQ ID NO: 107856 - DNA, 50 bp, homo sapien
cagagatactcatcatcttaaagacractgacagttataggcataagcct

SEQ ID NO: 107857 - DNA, 50 bp, homo sapien
aagctaaatagtaggtaaccactcartaatctggacccaggctccctgtt

SEQ ID NO: 107858 - DNA, 50 bp, homo sapien
tctaaggattaagtgaatggatataygtaaagcttgtagaacagaatctc

SEQ ID NO: 107859 - DNA, 50 bp, homo sapien
ttcctaaggccctacccacactgtaygaccagctccgcagtaaaacatgt

SEQ ID NO: 107860 - DNA, 50 bp, homo sapien
gggcccatttccttgggtgttcgtargcagctgcagctgtgggatagaga

SEQ ID NO: 107861 - DNA, 50 bp, homo sapien
tggtagctctgttttaagatctttamgaaatctccaaactgctttccaga

SEQ ID NO: 107862 - DNA, 50 bp, homo sapien
ctacctggctcaagatcatcttaaayggctcatagatttctgtttacctt

SEQ ID NO: 107863 - DNA, 50 bp, homo sapien
tctagaagttcaatgaacctcagcayagaataaacacaatgaaatccata

SEQ ID NO: 107864 - DNA, 50 bp, homo sapien
tgggacatattagcacatagattacyattacttttacagaatgatagtcc

SEQ ID NO: 107865 - DNA, 50 bp, homo sapien
tgaaaataagtagaagacaaactcarcatctgctattgaggtagattatt

SEQ ID NO: 107866 - DNA, 50 bp, homo sapien
ggcacttgctgtcagcaaattctcasagccaaagtaaaacattgatttgt

SEQ ID NO: 107867 - DNA, 50 bp, homo sapien
tttcagtcattcctatcagacactakgtttatcctggcacttgctgtcag

SEQ ID NO: 107868 - DNA, 50 bp, homo sapien
gtcaacctaatgaccttaccatttarctacatcaggtgccagtacataat

SEQ ID NO: 107869 - DNA, 50 bp, homo sapien
tgaagttacttttcacatttactaaragcgatgaccatcataaggggcta

SEQ ID NO: 107870 - DNA, 50 bp, homo sapien
aggactcactcccaattttactatarcaattaatcctggggaggaagaga

SEQ ID NO: 107871 - DNA, 50 bp, homo sapien
caaaagaactgcagatgtagtctccyaactgtatagcacattgctttcta

SEQ ID NO: 107872 - DNA, 50 bp, homo sapien
tagaataaatagaattatacctctaygtgttataagcctcttaacagcca

SEQ ID NO: 107873 - DNA, 50 bp, homo sapien
aaaacacgttctggaagtcttattaragaggttatagacaaattagattt

SEQ ID NO: 107874 - DNA, 50 bp, homo sapien
cacatttttaattttcataaaggccrataagttgtgaataaaaaaggttc

SEQ ID NO: 107875 - DNA, 50 bp, homo sapien
cactgtgatttcatcaaactttgccyatagccaatggctcttattacaca

SEQ ID NO: 107876 - DNA, 50 bp, homo sapien
attttgagtttaattctttttcttcrcataacacatttgaaatttattca

SEQ ID NO: 107877 - DNA, 50 bp, homo sapien
ggtaattgagatcccagcaaaatgaytttcaaaagaggatagaggaagag

SEQ ID NO: 107878 - DNA, 50 bp, homo sapien
gtcccaatgtccaagccttctttcartcaggacttttctgcttataatca

SEQ ID NO: 107879 - DNA, 50 bp, homo sapien
ctattctggatcatctggatttctaycttataatcactcagtgtcagagt

SEQ ID NO: 107880 - DNA, 50 bp, homo sapien
gacgctcttaaatatttttattcacmgtcatattgaaggatatttgtcta

SEQ ID NO: 107881 - DNA, 50 bp, homo sapien
gggaaggccaagacactattcacaartacagagagtttactgtttttagt

SEQ ID NO: 107882 - DNA, 50 bp, homo sapien
agatttagagtaatctcagctgaacyggaaaagagaattgctttgacatt

SEQ ID NO: 107883 - DNA, 50 bp, homo sapien
cagcttgtatttattctcagataacraactgtaaccatgaaaaatcaaac

SEQ ID NO: 107884 - DNA, 50 bp, homo sapien
acaggacactaactttggcctcatcratacctgtcagcctcttaagtttg

SEQ ID NO: 107885 - DNA, 50 bp, homo sapien
aaaaataaataaaatgtggtcctccrgcatactgattttttagtaacaat

SEQ ID NO: 107886 - DNA, 50 bp, homo sapien
cccaatttctttctaatgggcaggartcaaaggcgtagaatgttgttgaa

SEQ ID NO: 107887 - DNA, 50 bp, homo sapien
ttcacttacacaataggacacttcaycagcaaaatagcagtgtgaattta

SEQ ID NO: 107888 - DNA, 50 bp, homo sapien
agataatttgtcattgtttggatatyagctcaagcatcactccctcagaa

SEQ ID NO: 107889 - DNA, 50 bp, homo sapien
agaaattggagcaaaatgttatctgratatagaggtgtgaaccatttttt

SEQ ID NO: 107890 - DNA, 50 bp, homo sapien
catcttagcataataagatcattaayagagctgactgttttttacatttc

SEQ ID NO: 107891 - DNA, 50 bp, homo sapien
agagttgtagtttcagcagctaaaakgtaggtaactacactggcggtatc

SEQ ID NO: 107892 - DNA, 50 bp, homo sapien
aggctttttctctatattcttcataytactttcactattcttccatcttc

SEQ ID NO: 107893 - DNA, 50 bp, homo sapien
aaactacaatagtgagtaaaacagcsatggtccctgtccttaggaagctt

SEQ ID NO: 107894 - DNA, 50 bp, homo sapien
gtgaacatatatatattcaacatttkaaagtacaaagtcaagctgacttg

SEQ ID NO: 107895 - DNA, 50 bp, homo sapien
ctgaaactaggaaacttatagtacasaattcagactttttagctgttgga

SEQ ID NO: 107896 - DNA, 50 bp, homo sapien
catcttttatttccaaatatctcaaygcctcactcaaacatcacactatt

SEQ ID NO: 107897 - DNA, 50 bp, homo sapien
ttccaacagaagttgtaccaaggacwatttaggctaggatgataaaaata

SEQ ID NO: 107898 - DNA, 50 bp, homo sapien
aacatgttagtcttcatgtgatgacygggaaatttaagagcactccagct

SEQ ID NO: 107899 - DNA, 50 bp, homo sapien
atgaagggtcctccatgaagcgcgaygagaacgtatgtcaaatattggcc

SEQ ID NO: 107900 - DNA, 50 bp, homo sapien
tatataaacaactctcttcttaggawtattcatttttcatcagtttaact

SEQ ID NO: 107901 - DNA, 50 bp, homo sapien
aaagccaaagaaaagtagagtgagaytatgttgcaggttaggatacatat

SEQ ID NO: 107902 - DNA, 50 bp, homo sapien
attctagaacacttctcaataccttwtctaaatgccaatctctatccaag

SEQ ID NO: 107903 - DNA, 50 bp, homo sapien
aatcatattgacttaagaaatgttayccagacttttgttgatgttgcaat

SEQ ID NO: 107904 - DNA, 50 bp, homo sapien
aaagagtggataaagactttataagmcctgagtccgttagctaaaagcgc

SEQ ID NO: 107905 - DNA, 50 bp, homo sapien
gacacaaagtagtgaaaccgaggtgkataagatcttcttaaatgtaactt

SEQ ID NO: 107906 - DNA, 50 bp, homo sapien
taggattttttttaaggcaaatacaratgggataaatatatgttcttgga

SEQ ID NO: 107907 - DNA, 50 bp, homo sapien
ttgagtaaggtcagtcctttccataytaggcctttctagggatttggtaa

SEQ ID NO: 107908 - DNA, 50 bp, homo sapien
ttatatgtccattatcagccttttgmaactctcaatatatgtaatctcaa

SEQ ID NO: 107909 - DNA, 50 bp, homo sapien
atccaactttaattctctgtttctgraagtcctattcttcatattttgga

SEQ ID NO: 107910 - DNA, 50 bp, homo sapien
ctttagactttcttctaattctgacyggtatttccataatttactgattc

SEQ ID NO: 107911 - DNA, 50 bp, homo sapien
tagcaccatggattctgaaagtaacrataagaacagaaattcatcagata

SEQ ID NO: 107912 - DNA, 50 bp, homo sapien
atgttcatgattcaacaacctacacrgtacaatgtaagaattccacactg

SEQ ID NO: 107913 - DNA, 50 bp, homo sapien
attgaattatattaacaaatgtttawagttgctatgattgagaaatatta

SEQ ID NO: 107914 - DNA, 50 bp, homo sapien
tcaaagagtatttgctgaagcctacmctatgagataggtctaccatgtac

SEQ ID NO: 107915 - DNA, 50 bp, homo sapien
tactattttctgttaaatggagatawgatcttaattaattgaagatttct

SEQ ID NO: 107916 - DNA, 50 bp, homo sapien
aaagtggggctatattactgaagcartccgattaggaggattcataaaaa

SEQ ID NO: 107917 - DNA, 50 bp, homo sapien
tgttctgtcgcaaacacacactgaawctaagtaatacttttcagggcaaa

SEQ ID NO: 107918 - DNA, 50 bp, homo sapien
atatcaagaagataaagagtataaartgactgtagcagtttctacactta

SEQ ID NO: 107919 - DNA, 50 bp, homo sapien
acagccatttcaaagtagattataamgtacaagaaggaaaaatttaggga

SEQ ID NO: 107920 - DNA, 50 bp, homo sapien
cagagtatagttttcaaagtgactakcattgacaaaattttgagaatact

SEQ ID NO: 107921 - DNA, 50 bp, homo sapien
tctcaatctggaggcctaattcccaygggtaaacacttatgtcaggaaac

SEQ ID NO: 107922 - DNA, 50 bp, homo sapien
ttgcagtcatagccttcaatcccaawgactaggtttagcacctggaatga

SEQ ID NO: 107923 - DNA, 50 bp, homo sapien
tagttgtttttaaaatgcagttccartaataatttcaagctgtctccaat

SEQ ID NO: 107924 - DNA, 50 bp, homo sapien
tattgccatagattttcacatacaaygctttgataaactcttttgcgcct

SEQ ID NO: 107925 - DNA, 50 bp, homo sapien
atatgtttaataatttatgaataacwgttaaaaaggcagtatcataaggt

SEQ ID NO: 107926 - DNA, 50 bp, homo sapien
tcttcggggacattttattttgccargaacttctccatttcctctagatt

SEQ ID NO: 107927 - DNA, 50 bp, homo sapien
acagctccaatctgtcccatctcaayaaaagttcaagaagagactttttg

SEQ ID NO: 107928 - DNA, 50 bp, homo sapien
aaagaatttgatggttcattttaaaytattatgtgaattcttagcctaaa

SEQ ID NO: 107929 - DNA, 50 bp, homo sapien
cagttcagcccataatacacagtacscaattaagtaacatttattttgct

SEQ ID NO: 107930 - DNA, 50 bp, homo sapien
agcaaataatttccatttatatcacyagttgtaaaacaaggcttattacc

SEQ ID NO: 107931 - DNA, 50 bp, homo sapien
acagaatagacaatgtaataataacygaaatttggaaggatgtaacaaga

SEQ ID NO: 107932 - DNA, 50 bp, homo sapien
ctttgtatacatgaaaatgtatcagrcaattcaaagaacagaatagacaa

SEQ ID NO: 107933 - DNA, 50 bp, homo sapien
gccatcaacactggtgttacagttayagcaaatcgctggcttttgtggag

SEQ ID NO: 107934 - DNA, 50 bp, homo sapien
tagtataaggagcatgctggattaamggcctcattcaggaggcaaaacat

SEQ ID NO: 107935 - DNA, 50 bp, homo sapien
ggaaacaccaatgaattggcaatgarccttattacaaatcaatctttttt

SEQ ID NO: 107936 - DNA, 50 bp, homo sapien
ctgctgctggtaatccattgagatcyaggtatgcaaacataataatggta

SEQ ID NO: 107937 - DNA, 50 bp, homo sapien
ttgctgtaattactaaaggcactgtytgacaaaactttattaaagttcag

SEQ ID NO: 107938 - DNA, 50 bp, homo sapien
catcactaactagtcctcctggcagkatttgcctcctaactcgctccatc

SEQ ID NO: 107939 - DNA, 50 bp, homo sapien
acttccatcacttgattggcattagragatatgagtggtgttggttaatt

SEQ ID NO: 107940 - DNA, 50 bp, homo sapien
actttgctgtaatttctgtaccaacmatcaatatcactctgtaaagccat

SEQ ID NO: 107941 - DNA, 50 bp, homo sapien
tcgagtctattttctatgtctattcrgaaaacataatatatcctcaacca

SEQ ID NO: 107942 - DNA, 50 bp, homo sapien
tttttgagtaagactttaaagcatcyattgttacaaaatgtttttctttt

SEQ ID NO: 107943 - DNA, 50 bp, homo sapien
gctacttgtatatatttgcagataakgtactttaatgattgtgtataact

SEQ ID NO: 107944 - DNA, 50 bp, homo sapien
gtgtcttaattagtaaaatgaagaaygtaacactcctacttcatagggtt

SEQ ID NO: 107945 - DNA, 50 bp, homo sapien
caaggtaattaagcacacgtggcaarcagttcacataaataattaaatag

SEQ ID NO: 107946 - DNA, 50 bp, homo sapien
tctggggttgtttccttcctgtacakactggaccaaaacagctgtcagta

SEQ ID NO: 107947 - DNA, 50 bp, homo sapien
ttgaacaaccctagactttttcagcraaaccctaagactcctttgtcatc

SEQ ID NO: 107948 - DNA, 50 bp, homo sapien
aactggttccagcttgtaaagatcargtaagtaaatatctcaatacctaa

SEQ ID NO: 107949 - DNA, 50 bp, homo sapien
caaatgtagccgctaaagtctgtacycagctacctcagtgttcagttaat

SEQ ID NO: 107950 - DNA, 50 bp, homo sapien
cagctaaatttttttggtgatgtaamtgtacttgagaaaaaaatccatag

SEQ ID NO: 107951 - DNA, 50 bp, homo sapien
cacgtacaagtgggatctggcctccractttgtagaaaaccaaagtacac

SEQ ID NO: 107952 - DNA, 50 bp, homo sapien
cttttgaaatccaaagtgctttccayggcctgtaatactccatgtaatct

SEQ ID NO: 107953 - DNA, 50 bp, homo sapien
agtcctaagactataattatttagcyacaaagatctctgtaggtcatact

SEQ ID NO: 107954 - DNA, 50 bp, homo sapien
acctcaggacaggctattgatggtayggtaaacatggctgacaactagca

SEQ ID NO: 107955 - DNA, 50 bp, homo sapien
agactcgataaaattcttatgcagayggaataatcctggaatcaaatttg

SEQ ID NO: 107956 - DNA, 50 bp, homo sapien
aatctaaacactggaatattactcakgctaaatggaaatgaactatcaag

SEQ ID NO: 107957 - DNA, 50 bp, homo sapien
acaaatacttttttaattcaagtaaygtacactgcaactggatacgttct

SEQ ID NO: 107958 - DNA, 50 bp, homo sapien
tgctgagttcaactttcctttttctygtcacttgtagttgagtccttctt

SEQ ID NO: 107959 - DNA, 50 bp, homo sapien
atgaagaagcaaataacaaccagtayagtgagggtgttcagagggaggca

SEQ ID NO: 107960 - DNA, 50 bp, homo sapien
ggagctagaaaaatttgaaggacaakaaatgataaaagaaaaggtaagaa

SEQ ID NO: 107961 - DNA, 50 bp, homo sapien
aataaaaattctaaaagttgtaatamctgcatcaggtgaaatcacgttag

SEQ ID NO: 107962 - DNA, 50 bp, homo sapien
acaacttttagaatttttatttcaartgtaagtggtttatgccagactgt

SEQ ID NO: 107963 - DNA, 50 bp, homo sapien
ctcctatctaaccgaaattttatctsctttgagcaacatctctccagttc

SEQ ID NO: 107964 - DNA, 50 bp, homo sapien
ttccagataattctcaaaccacatgrcaggtgttactgaatgctggcagg

SEQ ID NO: 107965 - DNA, 50 bp, homo sapien
taaaactctcccaaggtgacagttayggaagtctaagctcttctgagggg

SEQ ID NO: 107966 - DNA, 50 bp, homo sapien
caaagaattggcaagatttttgtatkaatggttatctcttgcttttgagt

SEQ ID NO: 107967 - DNA, 50 bp, homo sapien
ggtttaatgtcacctcttacagtgayggtatttttctggccaatatgcat

SEQ ID NO: 107968 - DNA, 50 bp, homo sapien
aggactagcacaccagaaataattckatctgcctgtattgttcattaatt

SEQ ID NO: 107969 - DNA, 50 bp, homo sapien
tgtataaccccaggaatctaatacamtcttcaggtgggagaaaagggttt

SEQ ID NO: 107970 - DNA, 50 bp, homo sapien
tttgtcctctatttacaatagagtasgaggtaggataaaagaatgtttaa

SEQ ID NO: 107971 - DNA, 50 bp, homo sapien
tctccaaaacctagggcttaattaakgaacaatacaggcagatagaatta

SEQ ID NO: 107972 - DNA, 50 bp, homo sapien
tcaatccttgaagaaatatctggcakcaagtttatgttttctacagatat

SEQ ID NO: 107973 - DNA, 50 bp, homo sapien
gtgagactgtgtcaaaattatcttaygtaaataatgcaacaaatatataa

SEQ ID NO: 107974 - DNA, 50 bp, homo sapien
tgtaaacagactcatttcttccaaarttgtttcacacaaatcatagttct

SEQ ID NO: 107975 - DNA, 50 bp, homo sapien
attaaaaagtatttgggtcaacaacygttagtattcatttgtatagcttt

SEQ ID NO: 107976 - DNA, 50 bp, homo sapien
tttagttactaacttacaatttaaastatgataaagtaattgctgcataa

SEQ ID NO: 107977 - DNA, 50 bp, homo sapien
cttttttgttcattgcgtctttttaycttatagctacaatgaaaataaaa

SEQ ID NO: 107978 - DNA, 50 bp, homo sapien
tgaaggaggaaagcacagagtgttamatagaaacaggagatctggataaa

SEQ ID NO: 107979 - DNA, 50 bp, homo sapien
aaacagtcagacaggacctctagcamcaaggagaaagcatgcaggctgga

SEQ ID NO: 107980 - DNA, 50 bp, homo sapien
ctcaattctctcacaacagataagargatactctccagagaaagacagct

SEQ ID NO: 107981 - DNA, 50 bp, homo sapien
aatgggctcatggaaaacatagctargtcagtcagagtcagattctattg

SEQ ID NO: 107982 - DNA, 50 bp, homo sapien
ttttggatattagagggtttttcagrcattcaggaagtagtgacctctca

SEQ ID NO: 107983 - DNA, 50 bp, homo sapien
cataaccatgcctgtctcttataagwaagttagtggaaagaaagggaccc

SEQ ID NO: 107984 - DNA, 50 bp, homo sapien
acaacacacactgaaatggaagcaamgatgaaggaaaattgccaagttaa

SEQ ID NO: 107985 - DNA, 50 bp, homo sapien
caagacctttcatcttccaaataacycttgattccatcttcatctaccat

SEQ ID NO: 107986 - DNA, 50 bp, homo sapien
ggctctagagatgatattggcaaacyatgtgttgttattattatcatgac

SEQ ID NO: 107987 - DNA, 50 bp, homo sapien
ggtgtttgtgttggctctaaacaaaycagttcttgcaatcctggccagtt

SEQ ID NO: 107988 - DNA, 50 bp, homo sapien
tagaatcaccaggtcttggaactgaygggaagttgagaaagatggcaaca

SEQ ID NO: 107989 - DNA, 50 bp, homo sapien
gatctgttgatctgataatcgagackgctactgagtaactagtgtggggg

SEQ ID NO: 107990 - DNA, 50 bp, homo sapien
atgacccaagatgacctttctctcamgttactctccttatcatcccagga

SEQ ID NO: 107991 - DNA, 50 bp, homo sapien
tagtcccccttcatccccagagataygttccaggactccaagtggatgcc

SEQ ID NO: 107992 - DNA, 50 bp, homo sapien
ggcaagagtataagatacatttttawatcttaagtgctgaattcactgct

SEQ ID NO: 107993 - DNA, 50 bp, homo sapien
taagacataaatgtaaccagatctayagttaaatgatccctctaacaaca

SEQ ID NO: 107994 - DNA, 50 bp, homo sapien
catgcatttagaccttgctataaccyagtaaatcaatccagaatgatctt

SEQ ID NO: 107995 - DNA, 50 bp, homo sapien
gtaaatgtcttatttgttagtataartcaagtatagtcatgcagcattta

SEQ ID NO: 107996 - DNA, 50 bp, homo sapien
tctacctaatgcttatagtcatcaawcgtatacctcagaagtggtgagat

SEQ ID NO: 107997 - DNA, 50 bp, homo sapien
agtgtctagagacattaattctaacsagttgtttgcttttaaatgagtga

SEQ ID NO: 107998 - DNA, 50 bp, homo sapien
aatgcagagtttaaaaattagccaaygataggctttcatgccaaatattg

SEQ ID NO: 107999 - DNA, 50 bp, homo sapien
acacttcacttgaagtggtaaaacayatacgccttataaaactaagcagg

SEQ ID NO: 108000 - DNA, 50 bp, homo sapien
ctctaagtcacagatgtgtcactgawtaagaagggtcgaagttaatatac

SEQ ID NO: 108001 - DNA, 50 bp, homo sapien
atgaaaattccttcttggtggctagmaagtttgaaaatttctgaatttat

SEQ ID NO: 108002 - DNA, 50 bp, homo sapien
ttaagaatgtatttatttattagtaygagtaaatcagagcaagcatattg

SEQ ID NO: 108003 - DNA, 50 bp, homo sapien
atgataatcattagtgatctagtgaktagtgaccaaacactggatcctct

SEQ ID NO: 108004 - DNA, 50 bp, homo sapien
actagatcactaatgattatcatacmaaaggatacctccaaatattgtga

SEQ ID NO: 108005 - DNA, 50 bp, homo sapien
gagcatactgaaaacttcacaccaasgaacttcgactttgaatctatgtc

SEQ ID NO: 108006 - DNA, 50 bp, homo sapien
tacaaaaggacatctcaatggatcarcctaagaattctcagtaacaagag

SEQ ID NO: 108007 - DNA, 50 bp, homo sapien
cccatttaagtctgaaatgattgtamctatgctctgagataaaactggat

SEQ ID NO: 108008 - DNA, 50 bp, homo sapien
ttagattcatctataatgtaggccastgcaataattttgcccttaaatta

SEQ ID NO: 108009 - DNA, 50 bp, homo sapien
tttattgaacatctgctctctttaargcacaactataagaaccacgagaa

SEQ ID NO: 108010 - DNA, 50 bp, homo sapien
tttatcttgcttaatagaaacttacrcccattgattagtagcttcccatt

SEQ ID NO: 108011 - DNA, 50 bp, homo sapien
atctctctgacttaatgtaaggctcmattgcttataataaagacctgata

SEQ ID NO: 108012 - DNA, 50 bp, homo sapien
gaaagaaattccctgcttcacactakttattggactatctgcttggcccc

SEQ ID NO: 108013 - DNA, 50 bp, homo sapien
acagaaaatgctctacgaatgtaaasaacaatatgtaaggtaccaatagt

SEQ ID NO: 108014 - DNA, 50 bp, homo sapien
ccactgctggcacaacagaattgtcraggtctggaacatggggtaacaga

SEQ ID NO: 108015 - DNA, 50 bp, homo sapien
agtatttttttgccataataagtcayagccatgagcacaactatgtgcag

SEQ ID NO: 108016 - DNA, 50 bp, homo sapien
taataggcagtcctcgtgtcaaaaayagcacaccagtgggttctgcataa

SEQ ID NO: 108017 - DNA, 50 bp, homo sapien
tccagaaaagcagattatcactcaargtctcatagataggcatagataag

SEQ ID NO: 108018 - DNA, 50 bp, homo sapien
ctgttctcttccattagtacacttawctatctttctaaacaaatagcata

SEQ ID NO: 108019 - DNA, 50 bp, homo sapien
attttatcttttaaagtcttgctaaktgtattttctgaggctttaaaaat

SEQ ID NO: 108020 - DNA, 50 bp, homo sapien
cctctcacatactctatactcagcaytgaattacaagatccatagttagt

SEQ ID NO: 108021 - DNA, 50 bp, homo sapien
tctgcatgctgaccaaaatttatgaytatgttgtctctaaaaacatgtat

SEQ ID NO: 108022 - DNA, 50 bp, homo sapien
tcaggcccatgatgatccttcctaayattctacccaaatcttgctcctcc

SEQ ID NO: 108023 - DNA, 50 bp, homo sapien
tcacagcagttcaggcgtaaaattayctgcaatttgtgagcaggtcttag

SEQ ID NO: 108024 - DNA, 50 bp, homo sapien
ctgtgagaagaacaagttcccttcarcttttggagcactggtcctcaacc

SEQ ID NO: 108025 - DNA, 50 bp, homo sapien
cgtgtgtagctggaacagacagtatytatcaacagggcaacagaagagaa

SEQ ID NO: 108026 - DNA, 50 bp, homo sapien
acaaactgatcaatgaaaccaaatasagagctgaaatataaacccacatg

SEQ ID NO: 108027 - DNA, 50 bp, homo sapien
aaaataacatcctgattaattttccyaacataaaaacactcatcatttta

SEQ ID NO: 108028 - DNA, 50 bp, homo sapien
tgtgaaaatttaatgaattgctaaaygaattctacaggtagttatagcca

SEQ ID NO: 108029 - DNA, 50 bp, homo sapien
tttaattaattattaataattaacaygaggttctagtggggatgatgact

SEQ ID NO: 108030 - DNA, 50 bp, homo sapien
atatattatcatttattcctcaaaaytacctgaaaatgacattgttataa

SEQ ID NO: 108031 - DNA, 50 bp, homo sapien
gtagaataactccttcttgagtgtayctgaccaagagtctgcttttcctt

SEQ ID NO: 108032 - DNA, 50 bp, homo sapien
ataacaacttattgaattggttttayggaccttatcagttaattgccaaa

SEQ ID NO: 108033 - DNA, 50 bp, homo sapien
catccactaatacgaggcagacatcygagaactatcttcggcacttctac

SEQ ID NO: 108034 - DNA, 50 bp, homo sapien
tttacggaccttatcagttaattgcyaaatatcaccaatagaccagggta

SEQ ID NO: 108035 - DNA, 50 bp, homo sapien
gtcttttagaaagaactcagaaaaarcatgaaacataaaaagaaaaaaaa

SEQ ID NO: 108036 - DNA, 50 bp, homo sapien
taaaagtatgcaaaaagatctgttakgtggttgttgcagaagaaagaaga

SEQ ID NO: 108037 - DNA, 50 bp, homo sapien
cttgaggatgacaagagagactataygcttactatgtaatttatcaaaac

SEQ ID NO: 108038 - DNA, 50 bp, homo sapien
aaactaattcatacatgcttctccamatgaacaaacaaaaaacttaaaag

SEQ ID NO: 108039 - DNA, 50 bp, homo sapien
tgtagctttccattcctcatgttcakttgatagctgcagtcaagccagag

SEQ ID NO: 108040 - DNA, 50 bp, homo sapien
ggatcctcattatgtgtaccaaatcrgaagccagagggcaaaggagccca

SEQ ID NO: 108041 - DNA, 50 bp, homo sapien
cagaaagaagtgctattttccgggaygaaatctctctggcctatcagttc

SEQ ID NO: 108042 - DNA, 50 bp, homo sapien
ttcctagaacattggctggttatcarggttattctttttttctctttagt

SEQ ID NO: 108043 - DNA, 50 bp, homo sapien
agttttattaatttttcaaaataaarcatagcagattgtattacctattg

SEQ ID NO: 108044 - DNA, 50 bp, homo sapien
gtggccacagctgtattggatcctgraaaatcttccttctgcctttgtga

SEQ ID NO: 108045 - DNA, 50 bp, homo sapien
agttctagagaatactacagtaacaytcttgacaatgaaaacggaattca

SEQ ID NO: 108046 - DNA, 50 bp, homo sapien
agtgattgaataaatgagtttattayagaatgattgggtttttaaaaata

SEQ ID NO: 108047 - DNA, 50 bp, homo sapien
aggtcaccgtatttgtctctaggaaraaaaatcctaatttattatgccaa

SEQ ID NO: 108048 - DNA, 50 bp, homo sapien
tcaagggaatagatctttattttgckaataatcagttgacaacatgttac

SEQ ID NO: 108049 - DNA, 50 bp, homo sapien
gttgcatctagattgattaaccaaarcaagtgtcattggtgtgaactgat

SEQ ID NO: 108050 - DNA, 50 bp, homo sapien
caagtgaatgcatgttcaggttaagragcaacaatataaatgagtatcaa

SEQ ID NO: 108051 - DNA, 50 bp, homo sapien
acatgatcaaaagcaatataatggarctagaaatcttttgaacaaatagt

SEQ ID NO: 108052 - DNA, 50 bp, homo sapien
actgcatagctatcagccctatgcartgatagctgtgaaggacaacaaat

SEQ ID NO: 108053 - DNA, 50 bp, homo sapien
tacaaaagttatctaagttaatccargataaaaactgtgtctagagttta

SEQ ID NO: 108054 - DNA, 50 bp, homo sapien
aactatacgtgtctttcagtggttgragcatttacaatttttatacttca

SEQ ID NO: 108055 - DNA, 50 bp, homo sapien
attcaacaaatatttaattttaatasgtgcctactaggtgctaagaaatg

SEQ ID NO: 108056 - DNA, 50 bp, homo sapien
atctaaatgctgctcagttttacaamataaagtttccaatttgatctttt

SEQ ID NO: 108057 - DNA, 50 bp, homo sapien
aagcagccttaagtgttttgtgtaayaaggtgagtcatagatggaaatta

SEQ ID NO: 108058 - DNA, 50 bp, homo sapien
gttcacctaattacgtatttcaaagsaccaatgatacatcaactatacgc

SEQ ID NO: 108059 - DNA, 50 bp, homo sapien
tggaaggactgtgaacaaaattaacyctgtgtgtattgaggagaggagag

SEQ ID NO: 108060 - DNA, 50 bp, homo sapien
atagatgataatttttgttactacaktggaacatcctatttatttaagaa

SEQ ID NO: 108061 - DNA, 50 bp, homo sapien
ccacagttaacaagttctagcacacrcttccaaagatattcaaagcatgt

SEQ ID NO: 108062 - DNA, 50 bp, homo sapien
attttagtagaaaagatccatttcaycactgaattttagcatatgtaaac

SEQ ID NO: 108063 - DNA, 50 bp, homo sapien
tttattatgaaagaacctctgtcccratggacttgttaagtgatatatta

SEQ ID NO: 108064 - DNA, 50 bp, homo sapien
agatgaaaagagttttttctatggcrgaataatatctggggctatttgtt

SEQ ID NO: 108065 - DNA, 50 bp, homo sapien
atatgtgtatttctataactggaaamaatgcttcacccactctgaaaaag

SEQ ID NO: 108066 - DNA, 50 bp, homo sapien
tagtttcctcacaacagatttattcragatataatgagagtagacattgg

SEQ ID NO: 108067 - DNA, 50 bp, homo sapien
atcctacccatatgacttagctagawataaattttaaattaaagtatcat

SEQ ID NO: 108068 - DNA, 50 bp, homo sapien
agaaaggagagagaaatactaatcaycacagtacttgctgagacatttta

SEQ ID NO: 108069 - DNA, 50 bp, homo sapien
tgatttttccatagtaataatatcawggcacaatagtctcagtaaaatct

SEQ ID NO: 108070 - DNA, 50 bp, homo sapien
gcaagattttttgtgtaaatatagaygagattattctaaaattattatgc

SEQ ID NO: 108071 - DNA, 50 bp, homo sapien
cctgatgaagaatttcaagtctaaayttcctatcctggcctatctttttc

SEQ ID NO: 108072 - DNA, 50 bp, homo sapien
cagaaagtgaaagccattaagttaartgatacaatgctcatagtgatggc

SEQ ID NO: 108073 - DNA, 50 bp, homo sapien
gaaattcttcatcaggactgtccaayagaacttctgaagcaataaaaatt

SEQ ID NO: 108074 - DNA, 50 bp, homo sapien
ctcactcttaatgtactacatatcartgaagcctcagtggtgtaatcttc

SEQ ID NO: 108075 - DNA, 50 bp, homo sapien
caagactatttctgagtacctgttayaaaattctgaggttctttaagact

SEQ ID NO: 108076 - DNA, 50 bp, homo sapien
ttacatagatgatgcttttattctgmagtctttactgagatttaatgaat

SEQ ID NO: 108077 - DNA, 50 bp, homo sapien
aaggaagtgtacatgtttacctaaakttgggtatgtattaaatagttgtt

SEQ ID NO: 108078 - DNA, 50 bp, homo sapien
taaatgatatggaggtattataaacractgtgaagcaaaaatgtgtatca

SEQ ID NO: 108079 - DNA, 50 bp, homo sapien
ataaggcttaacattagcacagataygccttaagtatgctgaatgaccaa

SEQ ID NO: 108080 - DNA, 50 bp, homo sapien
agatgtttcattaattttttatgcartagtcacataagttcaattaataa

SEQ ID NO: 108081 - DNA, 50 bp, homo sapien
aaatatttgcattccactgaattcayataactgtagaaaagagcatcata

SEQ ID NO: 108082 - DNA, 50 bp, homo sapien
gaatatgagcttagcataaatagaartaaggactgcagattagacagaaa

SEQ ID NO: 108083 - DNA, 50 bp, homo sapien
tataaagagtaaacaaattaaatccmataaaataatgcacataactggtt

SEQ ID NO: 108084 - DNA, 50 bp, homo sapien
aataacatttactaactgaaccagasaaagggagaacaacctatcaggtg

SEQ ID NO: 108085 - DNA, 50 bp, homo sapien
ttggaagaggattcataaagaaggcragatttaagcaaagacttcaactt

SEQ ID NO: 108086 - DNA, 50 bp, homo sapien
gactcctgcttttgctgtcccatgtkaagtagctaaaacagtcatctcta

SEQ ID NO: 108087 - DNA, 50 bp, homo sapien
ttctatacttggaaactaatatagcrgattatcttggttaagctgtacag

SEQ ID NO: 108088 - DNA, 50 bp, homo sapien
ggtgtcttttgatttatttgaaatckacacagtgctatcaattatatttt

SEQ ID NO: 108089 - DNA, 50 bp, homo sapien
ctaagaaactatctgtaaaatattgwatgagcttagatagcttcctagct

SEQ ID NO: 108090 - DNA, 50 bp, homo sapien
agttttaatgatgtaatactttgaarttatataaaagttcttgtcagcag

SEQ ID NO: 108091 - DNA, 50 bp, homo sapien
taagctattttttgatgtgtacaggrcataaacacttaaaagacacttag

SEQ ID NO: 108092 - DNA, 50 bp, homo sapien
ctccagatcctgcaatttattatccraaggttgtctgattctctctgctt

SEQ ID NO: 108093 - DNA, 50 bp, homo sapien
gccctcctctgagctacacattcaartatccatcctcttctacatagatg

SEQ ID NO: 108094 - DNA, 50 bp, homo sapien
gtgtgggaagcagatttatagtgaarccgttaactgggctacagagcgca

SEQ ID NO: 108095 - DNA, 50 bp, homo sapien
ccaagagaacactgtaataatcatcrctcatgacaagaaggttttttttt

SEQ ID NO: 108096 - DNA, 50 bp, homo sapien
ttaataccatctcacaaaatgggaartgagtatatcaagcagcaaataaa

SEQ ID NO: 108097 - DNA, 50 bp, homo sapien
tcggaggatatcttgtctttgctcayggaatcatttacactcaagtgagc

SEQ ID NO: 108098 - DNA, 50 bp, homo sapien
ttcccatgtgaccaggctgtacctaygatttctcttaaaacttgaatgta

SEQ ID NO: 108099 - DNA, 50 bp, homo sapien
tttacttatttgatatacctacaaaytggttttctgcagcaagctcattt

SEQ ID NO: 108100 - DNA, 50 bp, homo sapien
caatgtttggcacttagtgagtaccrattacactttatctattctaatta

SEQ ID NO: 108101 - DNA, 50 bp, homo sapien
aacactaaaacaactcatacacgaargtttgtgattaacattacctttcc

SEQ ID NO: 108102 - DNA, 50 bp, homo sapien
tgagttatatactttctgcccttcakatttcatataccttgtacctctgt

SEQ ID NO: 108103 - DNA, 50 bp, homo sapien
gcagtgaaagtcatagattttctatrataatgatgatgatgatagcttat

SEQ ID NO: 108104 - DNA, 50 bp, homo sapien
ggtttttataaatcttccaaaatacwcctcattctggttatggcttagta

SEQ ID NO: 108105 - DNA, 50 bp, homo sapien
taatcctataagtttgtgaagggttraacagtcaagctcttcttctttag

SEQ ID NO: 108106 - DNA, 50 bp, homo sapien
ctgtataagttgttctcattcctcaytactccctgtattcacacttgttg

SEQ ID NO: 108107 - DNA, 50 bp, homo sapien
caaataattatcagacatgtaataamacgccagagatcttaacagttctg

SEQ ID NO: 108108 - DNA, 50 bp, homo sapien
agatatggctccaagggacatctcawaggaatttaatagccgtttaccca

SEQ ID NO: 108109 - DNA, 50 bp, homo sapien
tttgtttttgtttttccagtcgctgyatggaccatcatatgtaaaagtgg

SEQ ID NO: 108110 - DNA, 50 bp, homo sapien
aggtatggctcttaaaatgctataartacaattaaataactaaaaaataa

SEQ ID NO: 108111 - DNA, 50 bp, homo sapien
ttcctttgacaacatgttttgtaccragctttttagtgcccttcttttaa

SEQ ID NO: 108112 - DNA, 32 bp, homo sapien
aaattggccaaacaacrggaatacaggcccca

SEQ ID NO: 108113 - DNA, 50 bp, homo sapien
taggccaaggactatttttatacaastgtcagctaagaatggtgtttcac

SEQ ID NO: 108114 - DNA, 50 bp, homo sapien
atatgcagttttaatgccaaagcagraagggtcaaattgatttaaaaaat

SEQ ID NO: 108115 - DNA, 50 bp, homo sapien
gaaaattaacggatttgtaaaattgycaatattatctaattttagaacat

SEQ ID NO: 108116 - DNA, 50 bp, homo sapien
ccattgaagggtccttgatttagggmaagttgttttaatctatccaaact

SEQ ID NO: 108117 - DNA, 50 bp, homo sapien
cttaacttttccacggttggctgaastaagaattggtgtcctggctagag

SEQ ID NO: 108118 - DNA, 50 bp, homo sapien
ctccataacaactgtttgcacatgarattcaaagaaagttcatagtacat

SEQ ID NO: 108119 - DNA, 50 bp, homo sapien
acacttcctattttaatgtctctctstgttccttctattagttatgtact

SEQ ID NO: 108120 - DNA, 50 bp, homo sapien
ttgcaggaatatcaggattgtcaaakttattgataatagggattaaaagt

SEQ ID NO: 108121 - DNA, 50 bp, homo sapien
ctgtacatctctcaagagacacttcsaactaatatccctgaaaatccatc

SEQ ID NO: 108122 - DNA, 50 bp, homo sapien
aacagcatgccaaaagaaatcttgaygggtttaagagcagtgtggggata

SEQ ID NO: 108123 - DNA, 50 bp, homo sapien
ttttgttcagtaaaacgatataatayggaaaggatcttaagaaagagaaa

SEQ ID NO: 108124 - DNA, 50 bp, homo sapien
caagaatttcatcatttcatcaagcmaatactttaaagaggtcgaaaggt

SEQ ID NO: 108125 - DNA, 50 bp, homo sapien
catgatatctacaactgggaaccacrttaaggtatatactcacagaagaa

SEQ ID NO: 108126 - DNA, 50 bp, homo sapien
ctctaaatcagttggctgagtgcgaygttcctgattactcattacaaaga

SEQ ID NO: 108127 - DNA, 50 bp, homo sapien
tgtgacaactgagcactgaacagtayatagtgcaatggagaaactataaa

SEQ ID NO: 108128 - DNA, 50 bp, homo sapien
tgctttattcttctaagattgacaasatacagtggtgttaaaagaaagcc

SEQ ID NO: 108129 - DNA, 50 bp, homo sapien
tgtagtcccttttgacatttaattarggcttccaatctgcaaagcctgag

SEQ ID NO: 108130 - DNA, 50 bp, homo sapien
attcttaaatgtataaaaaacggtaygtctgatagaagagttaaactatt

SEQ ID NO: 108131 - DNA, 50 bp, homo sapien
agttgttactataattatagataggmatacaagagcttcttgtgtcccaa

SEQ ID NO: 108132 - DNA, 50 bp, homo sapien
tctctcagacttcctttatgagggcrctaatgctatccatgagggttccc

SEQ ID NO: 108133 - DNA, 50 bp, homo sapien
gaaagtcttcaggaaactatcctgarcgaatgcatctagtgaacagtaca

SEQ ID NO: 108134 - DNA, 50 bp, homo sapien
ataagaggggagcagtgctgtatgaygctaagacaatatgggtagaattg

SEQ ID NO: 108135 - DNA, 50 bp, homo sapien
atgttgttcaagagtcaactgtataygtttattatcaaaagtttaattca

SEQ ID NO: 108136 - DNA, 50 bp, homo sapien
tgaacttctgtcttcttgaatttaaraaatacgtctcaggagaaactgta

SEQ ID NO: 108137 - DNA, 50 bp, homo sapien
tataccacattagctgctgggagtasattttaacaagattcagcagctga

SEQ ID NO: 108138 - DNA, 50 bp, homo sapien
ctttgcatataatttgtatgaattasattttaaatacattggtcagctgc

SEQ ID NO: 108139 - DNA, 50 bp, homo sapien
aaacatacacatatacatacaattayctctctgacaaaaactgcagcata

SEQ ID NO: 108140 - DNA, 50 bp, homo sapien
gcaaagtctctttatatatgggtacragtaaagatttagtaaagtttaca

SEQ ID NO: 108141 - DNA, 50 bp, homo sapien
ataattcccagtcttcatcgatataycatttatagttacacaacttctcg

SEQ ID NO: 108142 - DNA, 50 bp, homo sapien
ctatagattaagtgcacttaaattgrataattggagactgagtgatacaa

SEQ ID NO: 108143 - DNA, 50 bp, homo sapien
atgagagtgttagaagttccaaccawtaaatctagttctcaatcaactat

SEQ ID NO: 108144 - DNA, 50 bp, homo sapien
tttcaagtatgttggataaatattargtttaaaggccaagatacttataa

SEQ ID NO: 108145 - DNA, 50 bp, homo sapien
acaaaatctcatagaggcagtcggaraaaaagaaagtgaagagcaccaag

SEQ ID NO: 108146 - DNA, 50 bp, homo sapien
agtgatgaggaaaacagtgaactcarggatactaattcccggcttcagaa

SEQ ID NO: 108147 - DNA, 50 bp, homo sapien
tctaactttttttttttaactaataygggatcagtagtcttgtctcatga

SEQ ID NO: 108148 - DNA, 50 bp, homo sapien
ctttagttcaaaattctgtgatatayaaataactcgaaataactgctaac

SEQ ID NO: 108149 - DNA, 50 bp, homo sapien
aagtaaattctacatggagttaattragcacaaaatgtgttttactatat

SEQ ID NO: 108150 - DNA, 50 bp, homo sapien
catagaattgatcttgaagacatacrcagaattaattttaaaaattctat

SEQ ID NO: 108151 - DNA, 50 bp, homo sapien
attttggacttaagtttggcagtctygttctctataaaacaaacaaactt

SEQ ID NO: 108152 - DNA, 50 bp, homo sapien
agggagtatgcgagcaaacaaggtargaactggagtgcatgagcgctgga

SEQ ID NO: 108153 - DNA, 50 bp, homo sapien
ggaagttggtttttgctaagcgtcartaaacagcatcctcaaaaatctga

SEQ ID NO: 108154 - DNA, 50 bp, homo sapien
agtagttggtaaatctctctcttccraccttaaaaagatccagaaaagac

SEQ ID NO: 108155 - DNA, 50 bp, homo sapien
caatattaactgaatggatcaaacartggtgaaaaattgagttatctgac

SEQ ID NO: 108156 - DNA, 50 bp, homo sapien
tacacctaggtgtttgctatgtcgartaattcattgtatggcaaattcat

SEQ ID NO: 108157 - DNA, 50 bp, homo sapien
ttagtgaatacagagactaatattasagttgatttctccataaatattga

SEQ ID NO: 108158 - DNA, 50 bp, homo sapien
accaacttgtatcctgttatctttaygagagtcagacattagtgaataca

SEQ ID NO: 108159 - DNA, 50 bp, homo sapien
ttaatgacatgcacaatggactttaracagatacactgatatttagtgtc

SEQ ID NO: 108160 - DNA, 50 bp, homo sapien
ttcgtagagagttccattttggcacrcattcatttaaggctgtgaaatag

SEQ ID NO: 108161 - DNA, 50 bp, homo sapien
ccccaaaatacttttcatgccattaygagggttagtttttaatacaaatt

SEQ ID NO: 108162 - DNA, 50 bp, homo sapien
gacttctcagaggtatttcttgagcygagactttttgtttcctagtggtg

SEQ ID NO: 108163 - DNA, 50 bp, homo sapien
tttaaagttaaaatttatatatttayggaagaggctaaaatatactaatg

SEQ ID NO: 108164 - DNA, 50 bp, homo sapien
aaatcatgacttacattttgccttaktaaccacataaacaaaaggtctcc

SEQ ID NO: 108165 - DNA, 50 bp, homo sapien
tacatgtgaggtacttagaataggaygtgacatagagtaataattcagta

SEQ ID NO: 108166 - DNA, 50 bp, homo sapien
aggggtaaaggcatatgaattcagaracatttggttgacttttgctgaaa

SEQ ID NO: 108167 - DNA, 50 bp, homo sapien
aaaggagacaattatatcaaaggtayggagcctgctatttatgagatatt

SEQ ID NO: 108168 - DNA, 50 bp, homo sapien
gtttcacttactttaacaggtttcartctaagatataaaggttataattg

SEQ ID NO: 108169 - DNA, 50 bp, homo sapien
gctcttactacctatcactgtcatastaaagttatagtgggatgttcatc

SEQ ID NO: 108170 - DNA, 50 bp, homo sapien
ttgttttattatcaggattcctttcyataacatttccaaacagttgaatc

SEQ ID NO: 108171 - DNA, 50 bp, homo sapien
agataaatccacaagtgttttataayaacatacttccaataaaagtagaa

SEQ ID NO: 108172 - DNA, 50 bp, homo sapien
atttctttcagttgtttttcacgtgycactgtttccaaatatttcttgta

SEQ ID NO: 108173 - DNA, 50 bp, homo sapien
tataataaagaaggccatcttgtacygcaaacaaaaaaaacatcaaaata

SEQ ID NO: 108174 - DNA, 50 bp, homo sapien
taattatacctactctattttatcawgctttgagtttccttttacactgt

SEQ ID NO: 108175 - DNA, 50 bp, homo sapien
aaaagatcctattaatctattaatcragccagaatgtgttttgtgtggtc

SEQ ID NO: 108176 - DNA, 50 bp, homo sapien
gaaactacacaactggaagaatatcragtagaaatgcttaaaaataactg

SEQ ID NO: 108177 - DNA, 50 bp, homo sapien
acttctagatatattttgctcataarctgaagaactgttcttttgtttgc

SEQ ID NO: 108178 - DNA, 50 bp, homo sapien
ctcgtagaacaggaaggcaatcttasaaatagagtactgacagtcacaaa

SEQ ID NO: 108179 - DNA, 50 bp, homo sapien
agaaaaactggaagagagtatattaygtttgacaaaggatttcaaagact

SEQ ID NO: 108180 - DNA, 50 bp, homo sapien
gctaacagactgatctaagtcactayggcacacaggaaactattacaata

SEQ ID NO: 108181 - DNA, 50 bp, homo sapien
tggagacattccaaatgagctggtayatctttagtgagcatcattaacct

SEQ ID NO: 108182 - DNA, 50 bp, homo sapien
gaatttctttattctctgttctgaayaactaaatgttaacattatattta

SEQ ID NO: 108183 - DNA, 50 bp, homo sapien
caacttatgatggggttccatcccartaaagccatcatacgtcataaata

SEQ ID NO: 108184 - DNA, 50 bp, homo sapien
cggatttagagaaaaagtgctttaawatctcagaaacataacgtgtgtgt

SEQ ID NO: 108185 - DNA, 50 bp, homo sapien
gtcactgcgatttttccagaagatarggaagttctttttctttaaaatgt

SEQ ID NO: 108186 - DNA, 50 bp, homo sapien
cctactgttcatgaggtgtcatagayaataattactaatacagggaatgc

SEQ ID NO: 108187 - DNA, 50 bp, homo sapien
ccaaataggtgatataatgaaggaaygggactgagaagagagcatgatga

SEQ ID NO: 108188 - DNA, 50 bp, homo sapien
tttatatcctccccaacagtgcctamtacagcattttttatgtagtaggg

SEQ ID NO: 108189 - DNA, 50 bp, homo sapien
ggagaaaatgaaatcaataatgtggragttaaaactgagaaaatgcccta

SEQ ID NO: 108190 - DNA, 50 bp, homo sapien
ctaaatgtatgtttgtatgccttgamgctttggaccacatagtaacagtt

SEQ ID NO: 108191 - DNA, 50 bp, homo sapien
gtgtgcctttaaattaatgtgcaccraagttttttgcttccagccatgag

SEQ ID NO: 108192 - DNA, 50 bp, homo sapien
agagccaggctaaagtggtgtaagayagtaaaataaaggtatcttttgga

SEQ ID NO: 108193 - DNA, 50 bp, homo sapien
ttataggtagactgtggttaattaaragcttatagatacatcctaatttt

SEQ ID NO: 108194 - DNA, 50 bp, homo sapien
aaattaggtaagacaaagggaatacrgagatgaataagatagagctcctc

SEQ ID NO: 108195 - DNA, 50 bp, homo sapien
ggtatattttatttccagtttctaartgcaatgaacatattcagacatag

SEQ ID NO: 108196 - DNA, 50 bp, homo sapien
atactcctgacttcagggatggaaarttcatgagcattggtttactggga

SEQ ID NO: 108197 - DNA, 50 bp, homo sapien
attaaaagcagaatagcctcatggtytgcttgtcctccagataggagtgg

SEQ ID NO: 108198 - DNA, 50 bp, homo sapien
cagaggaagctctccatgtaacacamagtgcagtgaggagtgagaaccac

SEQ ID NO: 108199 - DNA, 50 bp, homo sapien
acaagatgaatactgaagcaacagcratcgtattcatagtcagggcatgc

SEQ ID NO: 108200 - DNA, 50 bp, homo sapien
aaggaggaattcagatggagccttamagaagactagaatctaacctttat

SEQ ID NO: 108201 - DNA, 50 bp, homo sapien
ggttgaaaagctgattgtggctaacrctatatcaacattatgtgaaaaga

SEQ ID NO: 108202 - DNA, 50 bp, homo sapien
ataatagagtcttctaatccatgaasttatgtccactaacttagatcttc

SEQ ID NO: 108203 - DNA, 50 bp, homo sapien
ctgcagtgtatctccttgtcaatacygtatggctaatatttgagcatttc

SEQ ID NO: 108204 - DNA, 50 bp, homo sapien
aacgagccaccagaacagtaagaaayaacataatgaagactaagaaacta

SEQ ID NO: 108205 - DNA, 50 bp, homo sapien
cccttagatataagcattcagtgtamcattgctatgtgggatgaagcact

SEQ ID NO: 108206 - DNA, 50 bp, homo sapien
ttggatttgagtagtacatgtcttayggcaaacaactttcccaacaagat

SEQ ID NO: 108207 - DNA, 50 bp, homo sapien
ttgatattaatatataaagaaagatmagcataaaattgaaaggtccctgg

SEQ ID NO: 108208 - DNA, 50 bp, homo sapien
agaaagagagactgacttaccatacraaattgacttaagtgattgtaatg

SEQ ID NO: 108209 - DNA, 50 bp, homo sapien
tgggacagataatgtgttttatttawctttgcatatccattacttaaaac

SEQ ID NO: 108210 - DNA, 50 bp, homo sapien
cttgaaactctggtctatgtttccayatctattacttacatgactagagc

SEQ ID NO: 108211 - DNA, 50 bp, homo sapien
ttgaagacggcaaagcaaaaatccargaggagtctggatctctgatgatc

SEQ ID NO: 108212 - DNA, 50 bp, homo sapien
catttttaaagcttaaagaaagaaasttgtgcaactgtcaaaacgtcatc

SEQ ID NO: 108213 - DNA, 50 bp, homo sapien
tcctataacccagagcttatcagagsatttatgtccccaaagagaaatgt

SEQ ID NO: 108214 - DNA, 50 bp, homo sapien
taagcatttactaaagaagcttcatytatttctccagctttttcatattg

SEQ ID NO: 108215 - DNA, 50 bp, homo sapien
aggatcttttcaaggtgagtttatartaagtggtctttccttctttgggt

SEQ ID NO: 108216 - DNA, 50 bp, homo sapien
acaaaggaatcatttccaaaacccayagcaaatagctgggctaacagaaa

SEQ ID NO: 108217 - DNA, 50 bp, homo sapien
ccatttcagaccatctatttcagatktggaatcgcgacattttaacctcc

SEQ ID NO: 108218 - DNA, 50 bp, homo sapien
tcaaattcaagcagttaattggtgasaggccaaatacgaaaacaggttct

SEQ ID NO: 108219 - DNA, 50 bp, homo sapien
gatgttctaatatctgtatgcattawggaatggctaaatcaggcaaatta

SEQ ID NO: 108220 - DNA, 50 bp, homo sapien
atcccagtcattttcagggtattgakgaccacctataagttaataatttt

SEQ ID NO: 108221 - DNA, 50 bp, homo sapien
ggttcacaagtcttgcttgatacacrctagaatcacctggagcactttta

SEQ ID NO: 108222 - DNA, 50 bp, homo sapien
gcttttatcatttattcgatatttcyatttggcagtagatatttgattgt

SEQ ID NO: 108223 - DNA, 50 bp, homo sapien
atgaagagaaaggtctcatgcttagracagtgaggatctacttctcactg

SEQ ID NO: 108224 - DNA, 50 bp, homo sapien
gactttttcaagaccacaaccactcraggaaagcttcccatttcagtaat

SEQ ID NO: 108225 - DNA, 50 bp, homo sapien
tatcctctctattttgtaggctggcrattattagctttttttcttaacta

SEQ ID NO: 108226 - DNA, 50 bp, homo sapien
tctccttgacacttagcctgatgacytacttaatgttcaatctgccaagt

SEQ ID NO: 108227 - DNA, 50 bp, homo sapien
tggtaggtgattgcatgaataagtaygtaatattgttaatttctaaaaac

SEQ ID NO: 108228 - DNA, 50 bp, homo sapien
tgccataaagataatcaaataaatamcctgttgcttacaaagagtaaata

SEQ ID NO: 108229 - DNA, 50 bp, homo sapien
gatgctaagtgaatggattctaacasctctagtagtttaagtagctgagt

SEQ ID NO: 108230 - DNA, 50 bp, homo sapien
aacctgaaatcaccagtctctgcaayggttcccaggtggctgttttatat

SEQ ID NO: 108231 - DNA, 50 bp, homo sapien
gcataggaaccatattattgtcacaraggaattagaactatgttgagaag

SEQ ID NO: 108232 - DNA, 50 bp, homo sapien
cttctctccctttctcacctgctaayccattcttaaagatgcaactcaag

SEQ ID NO: 108233 - DNA, 50 bp, homo sapien
tctactcagaacaataatttagatcyaattggctgagtgcagtggctcac

SEQ ID NO: 108234 - DNA, 50 bp, homo sapien
tgcctatcttgcattttattctgtcrcacggaactaaacaaatgctgtct

SEQ ID NO: 108235 - DNA, 50 bp, homo sapien
ttactgctttgatttctttgaacgayaaacaagcatgtatagaagagaga

SEQ ID NO: 108236 - DNA, 50 bp, homo sapien
gccctaaactatgtctctgctacccrctacacttcctccttccccaacaa

SEQ ID NO: 108237 - DNA, 50 bp, homo sapien
agtcgtaccagcaagcttctcaccartggtacatgatcagtgcctttagg

SEQ ID NO: 108238 - DNA, 50 bp, homo sapien
cttctgactctgccacctctgagacraaaagatcgactccttctcttcct

SEQ ID NO: 108239 - DNA, 50 bp, homo sapien
aaataatataggaggttaaggagaaycatctgggtaaaatgatgtctgag

SEQ ID NO: 108240 - DNA, 50 bp, homo sapien
tgccacttaataactttagataaacrgtcagttgggcattttgttttaat

SEQ ID NO: 108241 - DNA, 50 bp, homo sapien
aaatgtgaagcctgtgatgcactgamggtgaattccaatattacaacacc

SEQ ID NO: 108242 - DNA, 50 bp, homo sapien
actagttgaaaagctgtgacttactragaggtattttcctgatggatttg

SEQ ID NO: 108243 - DNA, 50 bp, homo sapien
aagaatagactattaacaacaaagayatatttaggatgttgcttgagcat

SEQ ID NO: 108244 - DNA, 50 bp, homo sapien
atatttaggatgttgcttgagcatakaataaaaaatgtttaataattaac

SEQ ID NO: 108245 - DNA, 50 bp, homo sapien
gccttttcacatgctggtcctttgayctaggattatcttctctccctttc

SEQ ID NO: 108246 - DNA, 50 bp, homo sapien
aatgcccttatttttgagtcacagaygtacaactaataaggagtgtgtta

SEQ ID NO: 108247 - DNA, 50 bp, homo sapien
gtgcacgtaccgttcaatccatttcmatcctgtgatcctgcttcctgtta

SEQ ID NO: 108248 - DNA, 50 bp, homo sapien
atataactccttgtgttgatcactaycaggtaatatgatgatttatatta

SEQ ID NO: 108249 - DNA, 50 bp, homo sapien
cggatactaagtccaaaagtctaaartagaacataaatggaaaacaaaat

SEQ ID NO: 108250 - DNA, 50 bp, homo sapien
tgctgacattttgtgtaatacttccratatcatattcattgtcctttccc

SEQ ID NO: 108251 - DNA, 50 bp, homo sapien
cccctactaaaaccatatctattacrttacccagcatagtaaagattgat

SEQ ID NO: 108252 - DNA, 50 bp, homo sapien
ccttaggagactactagctaactaayaacacaagaggcactgtcaaccca

SEQ ID NO: 108253 - DNA, 50 bp, homo sapien
aactctttttaagtgtacaagtcaayggaatataatacagtggtagtttt

SEQ ID NO: 108254 - DNA, 50 bp, homo sapien
ttatcaacttctgagggtgtagaaascttttagagagccaaaaattccag

SEQ ID NO: 108255 - DNA, 50 bp, homo sapien
ctaactccaggcaacatagctataaytctgggagtgactccttctgcttg

SEQ ID NO: 108256 - DNA, 50 bp, homo sapien
tatagaggatactcttacaagctaayctatatacaatactttatgtaagt

SEQ ID NO: 108257 - DNA, 50 bp, homo sapien
tttctttgtatttttattcatgaaasaaaaaggccagatttgttagaagt

SEQ ID NO: 108258 - DNA, 50 bp, homo sapien
agcccaaagtgttgtgccagatgaaytgtgtgatataagcagaagtttaa

SEQ ID NO: 108259 - DNA, 50 bp, homo sapien
ccatttacttatttgtaaagcaagcragagagtgactcatgaggggtttg

SEQ ID NO: 108260 - DNA, 50 bp, homo sapien
gccttttaagtggctttgcaaaaggratagaagtacataattgacaagat

SEQ ID NO: 108261 - DNA, 50 bp, homo sapien
catttgtggaccatcagcagcactargatagaatacaccggtgagcttcg

SEQ ID NO: 108262 - DNA, 50 bp, homo sapien
ctactctagtcactttggacattacyggagatgttttgtttgttatggta

SEQ ID NO: 108263 - DNA, 50 bp, homo sapien
ggactttcataatgctggaaatagamgctcgtaaaatctttttcttatta

SEQ ID NO: 108264 - DNA, 50 bp, homo sapien
gtggtgacagccttccacccaggggraccacagtatatagagaatttaca

SEQ ID NO: 108265 - DNA, 50 bp, homo sapien
atatattgctcccagtgcaatctagyatagtatttttatattgatttatt

SEQ ID NO: 108266 - DNA, 50 bp, homo sapien
ggtttgatataaagggtatctggccraaatggaaagaaaagaagcatttt

SEQ ID NO: 108267 - DNA, 50 bp, homo sapien
caaggaatacattttatgaaaattamaactcaatgctggttatgactcaa

SEQ ID NO: 108268 - DNA, 50 bp, homo sapien
tgtttctaacttcggaaatttcaaasagtagctacaatgttattcctttt

SEQ ID NO: 108269 - DNA, 50 bp, homo sapien
tcttatatattgcttgtggccaaaayaatataataatcacatgagtggaa

SEQ ID NO: 108270 - DNA, 50 bp, homo sapien
ccagaattttgcttaagtcatactayggacctttctgacttgaaatcatt

SEQ ID NO: 108271 - DNA, 50 bp, homo sapien
aaatgttcataaagaatcaacctaayttactaccaagatgttcagtggat

SEQ ID NO: 108272 - DNA, 50 bp, homo sapien
aagctgtaaattcagaaataaatggrccaagaaataaacatcaatgcatt

SEQ ID NO: 108273 - DNA, 50 bp, homo sapien
atagaatatgtatttcagtttcaccrgcatgagagaatatgttttcaggg

SEQ ID NO: 108274 - DNA, 50 bp, homo sapien
ttttgctttttggaactttgtgagaytatttttcctaatacttctatcca

SEQ ID NO: 108275 - DNA, 50 bp, homo sapien
aacaagtggataatataagcagtcaytaatgtacatttaaaaaatcttta

SEQ ID NO: 108276 - DNA, 50 bp, homo sapien
cttgaaataggccctgttaagaccastagtattagaaaagaagtctatag

SEQ ID NO: 108277 - DNA, 50 bp, homo sapien
ggtaacaataaattactagaaaaaaygatcttgtggcttgacatggtgga

SEQ ID NO: 108278 - DNA, 50 bp, homo sapien
gagacaaaaataaggcttcagttggyaattaaaagagaataaggttgtca

SEQ ID NO: 108279 - DNA, 50 bp, homo sapien
aaacattttttcatttcaaaacaggraactacaaccatcagtttgcaagg

SEQ ID NO: 108280 - DNA, 50 bp, homo sapien
ctgataggtgtgcatgagaagagctraacgagtagaaaattaacagaatg

SEQ ID NO: 108281 - DNA, 50 bp, homo sapien
ctctaatttttaagtgtgggttgtayacagaaagttcttaccaaagagga

SEQ ID NO: 108282 - DNA, 50 bp, homo sapien
taactcaaaagccattaaatttcctytgtagcttgtaaagggggaaaaaa

SEQ ID NO: 108283 - DNA, 50 bp, homo sapien
agatgtccctcagttggggtttatawgatgttgattagcctgagttatga

SEQ ID NO: 108284 - DNA, 50 bp, homo sapien
tttctagctgcttttttgaaaatgaygtgctaagtctcatttcttgatac

SEQ ID NO: 108285 - DNA, 50 bp, homo sapien
gtatattgctaaaataggaatgagtsaaacctataccataatattatttt

SEQ ID NO: 108286 - DNA, 50 bp, homo sapien
acagtaggataaactcaattgccaakttccttcaaatcatttatgggata

SEQ ID NO: 108287 - DNA, 50 bp, homo sapien
ggtaggaggatgctgggttaaccaayttgaagctttctagtcctagtgac

SEQ ID NO: 108288 - DNA, 50 bp, homo sapien
ggggtctgttcacataactggtagaygcttattattcaatcatttatttg

SEQ ID NO: 108289 - DNA, 32 bp, homo sapien
aaaaggtgaaatagcaragtaagtatattttt

SEQ ID NO: 108290 - DNA, 50 bp, homo sapien
ggtcacaagtaggttcagttccacasacatctttttttccagtgtgagca

SEQ ID NO: 108291 - DNA, 50 bp, homo sapien
ctctccattatatgagaattgagtcraggacaataaagcaccaccatatc

SEQ ID NO: 108292 - DNA, 50 bp, homo sapien
agactctttatggaaaccatagtccsgagatctgatgttcaggtgccccc

SEQ ID NO: 108293 - DNA, 50 bp, homo sapien
taagtgtttggtaaaattctaaagtraagccattggattctagacttttc

SEQ ID NO: 108294 - DNA, 50 bp, homo sapien
acagacatatagtaagtgcttaatamtactcagtttgacacaatttaatt

SEQ ID NO: 108295 - DNA, 50 bp, homo sapien
acataaattctgtggtgtcattgtaygatttatacctgaaagtctgtaac

SEQ ID NO: 108296 - DNA, 50 bp, homo sapien
aaactttgagctgcctagaagtaatraactaacaggaactgagattttaa

SEQ ID NO: 108297 - DNA, 50 bp, homo sapien
tgacttgtcaaagttagtttaaatarcaggtcagtctagccataaagcat

SEQ ID NO: 108298 - DNA, 50 bp, homo sapien
aggaaaaaagctaaggttacagtaaygatctggctaaaacagtatctaat

SEQ ID NO: 108299 - DNA, 50 bp, homo sapien
tgactcatgctgtccctgtattgttyttagaatgtatgtcttagaaaaat

SEQ ID NO: 108300 - DNA, 50 bp, homo sapien
gacagtccattattctttatctggaygtagcaatgagaaacacactactt

SEQ ID NO: 108301 - DNA, 50 bp, homo sapien
aagaatctgaatttctaaatactgaygcatttcttttaactttaccctgt

SEQ ID NO: 108302 - DNA, 50 bp, homo sapien
agtacttaattgaagaactgcttgaraaataaatcaaccactcatggcta

SEQ ID NO: 108303 - DNA, 50 bp, homo sapien
tgaattcatattgctattaatctacraatatgataagaaacaatgggaga

SEQ ID NO: 108304 - DNA, 50 bp, homo sapien
atgtttgaaataggacaacctttaastcatattgttaagtagaaaaaata

SEQ ID NO: 108305 - DNA, 50 bp, homo sapien
ctctctcttttttctctgttaaaaakttggttattgcaaagtgaaacatt

SEQ ID NO: 108306 - DNA, 50 bp, homo sapien
agggcatctattagaggcaggtcaarcatcatacatgataaattttcaac

SEQ ID NO: 108307 - DNA, 50 bp, homo sapien
ttttctaaactgtggccacatcataytacgcttacttttaaaaactcact

SEQ ID NO: 108308 - DNA, 50 bp, homo sapien
gtaattcccacaatttttaaagagcraatgcttgtagatcacaatctatg

SEQ ID NO: 108309 - DNA, 50 bp, homo sapien
tagacaaggacttttcccagataacygtatgtaacaaagttcaaatactt

SEQ ID NO: 108310 - DNA, 50 bp, homo sapien
aaccatgctgtggttgaaggatgtarcatagtttgaaacaaaaataaggg

SEQ ID NO: 108311 - DNA, 50 bp, homo sapien
tttatcactactaaatatacacaccrgataatttaacctccttataagcc

SEQ ID NO: 108312 - DNA, 50 bp, homo sapien
tcctcaaagatttgcaatatctttgragctgcctataggtggcaaaaaca

SEQ ID NO: 108313 - DNA, 50 bp, homo sapien
aaagttctctaagatgcatcaaaatmattgaattaggagtgtgagagacg

SEQ ID NO: 108314 - DNA, 50 bp, homo sapien
cattttctgtatggtatattatgcamactgtaagctgctacatatttatt

SEQ ID NO: 108315 - DNA, 50 bp, homo sapien
tggactcctggcaaattctaattcaycctttcaagactgcttagatgcta

SEQ ID NO: 108316 - DNA, 50 bp, homo sapien
ttctcactcaggctttgtagtttcakgtatgttggtttacaacatggttt

SEQ ID NO: 108317 - DNA, 50 bp, homo sapien
gtttttcctggaaatattgggaagtraaagttctctttgcacaaagttta

SEQ ID NO: 108318 - DNA, 50 bp, homo sapien
acatattctggagaagagttgcaatraaatatgtagtaacaacattgcat

SEQ ID NO: 108319 - DNA, 50 bp, homo sapien
aaatccactggctctgagtcctgcawagcactaaaaattgcagtcctcat

SEQ ID NO: 108320 - DNA, 50 bp, homo sapien
tctactttatctgtggaattttaaamactgcctggtacatgagtagaaac

SEQ ID NO: 108321 - DNA, 50 bp, homo sapien
ttatgactttgtggtagttacaaagwagattcttaatgaaagccagttgt

SEQ ID NO: 108322 - DNA, 50 bp, homo sapien
ccagtcagcatgttactgcactgaartctttcctcatatgtgaatcgaaa

SEQ ID NO: 108323 - DNA, 50 bp, homo sapien
tttattcatttttcatgattaaattyagctctggtgtagtttgtttgttt

SEQ ID NO: 108324 - DNA, 50 bp, homo sapien
tccagttccaagggtacaacattccraggaacatagtttagagccttgac

SEQ ID NO: 108325 - DNA, 50 bp, homo sapien
tgaaatctttcctcatatgtgaatcraaagttcctattatatagagattc

SEQ ID NO: 108326 - DNA, 50 bp, homo sapien
tggtctaaattaatctaagaagaaayatgtttgaggccacaaagatgcct

SEQ ID NO: 108327 - DNA, 50 bp, homo sapien
acataaacaaaatagagacttaaaamatataaaagatcaatgaaacaaag

SEQ ID NO: 108328 - DNA, 50 bp, homo sapien
actagaaattgtaaagttcctcctcrgaaataactgacaatcagactcat

SEQ ID NO: 108329 - DNA, 50 bp, homo sapien
ggggggaagttggaggaatgtaagargaatctgctgggaaaactacagcc

SEQ ID NO: 108330 - DNA, 50 bp, homo sapien
aaaatgggtatgtctgatactaaaayggaggtacaacaattctttctaca

SEQ ID NO: 108331 - DNA, 50 bp, homo sapien
atcttcacccaacttgttaactctcytgtgttcatctgtgctttcagagt

SEQ ID NO: 108332 - DNA, 50 bp, homo sapien
gtagaaaggttgacagtgtactgaaygatgcaggctatcttcacccaact

SEQ ID NO: 108333 - DNA, 50 bp, homo sapien
aataaaacgaatgtatttaagtgtaygatttaatgtgtgcatgtgtgtgc

SEQ ID NO: 108334 - DNA, 50 bp, homo sapien
aacaaagtgcatagtgggtacttaayaaatgttactagttgagagcactt

SEQ ID NO: 108335 - DNA, 50 bp, homo sapien
ctgaagaatgctaagcaaagactggyataaatacataagtgtattagaga

SEQ ID NO: 108336 - DNA, 50 bp, homo sapien
attctccaaatgtatcaggctatccrgctatttcatttcttatttgcata

SEQ ID NO: 108337 - DNA, 50 bp, homo sapien
atagtatctaaaatttagaagtcaaraattacaataagagtatgttatct

SEQ ID NO: 108338 - DNA, 50 bp, homo sapien
ctctctaccctttctcctcccgatayctttcatttattcattttcattca

SEQ ID NO: 108339 - DNA, 50 bp, homo sapien
aatatttacataatgataacgttgamtacctctaaaatatgatatttata

SEQ ID NO: 108340 - DNA, 50 bp, homo sapien
agtaggtatgtagctcacccttggaygaaaccatattaaagtagagttgg

SEQ ID NO: 108341 - DNA, 50 bp, homo sapien
agtagactttagcacatatctttaargcacataaaagatagctgcttttt

SEQ ID NO: 108342 - DNA, 50 bp, homo sapien
tacatgttttctaataacgtggtgtrtctgttcttactttcaagcatcaa

SEQ ID NO: 108343 - DNA, 50 bp, homo sapien
ttagtgtgttatgtatggccttaaakttatcaaagcatttttccacattt

SEQ ID NO: 108344 - DNA, 50 bp, homo sapien
ataggcaagtttatcatattcatacrctttctgagtaggttgaaattgtt

SEQ ID NO: 108345 - DNA, 50 bp, homo sapien
aaattcacatttaatggaagtacatragtataatttcctttgtaaagaaa

SEQ ID NO: 108346 - DNA, 50 bp, homo sapien
aaagagtgaaaatatgtacttgatcyatggctgttgcaataaaggccatt

SEQ ID NO: 108347 - DNA, 50 bp, homo sapien
tgatatgcattttgcctaaattctaygtgtttctggtaactttgacctgc

SEQ ID NO: 108348 - DNA, 50 bp, homo sapien
aagctgcctgttactagataagaaartaatccactcttcaagaaaaaaaa

SEQ ID NO: 108349 - DNA, 50 bp, homo sapien
ttactttttattctttgacagacctragagagaaggcagatgctccctgg

SEQ ID NO: 108350 - DNA, 50 bp, homo sapien
cagccaccacaatgtcgctggacaaygaaacactgcagctggaaagagcg

SEQ ID NO: 108351 - DNA, 50 bp, homo sapien
taaatatattatgtaggtgacctgaygatgtgccacacacattccctctt

SEQ ID NO: 108352 - DNA, 50 bp, homo sapien
gcaccaagtgttagcataggggaacwccaggtgatttgtatgctcagaaa

SEQ ID NO: 108353 - DNA, 50 bp, homo sapien
aaatacagcacaagtgtaatgaaaayaattctggtactggtgcaagcaaa

SEQ ID NO: 108354 - DNA, 50 bp, homo sapien
cattgtaagcagtttatatggcaaargattataagtacactagtaactaa

SEQ ID NO: 108355 - DNA, 50 bp, homo sapien
gttcaatgaaaataatcaccaagtargataatgaagtaaaacactgctta

SEQ ID NO: 108356 - DNA, 50 bp, homo sapien
ccccacacattaacaagtttattcgyactttgtccagaagtccctactga

SEQ ID NO: 108357 - DNA, 50 bp, homo sapien
ttttcaaaaatcaattgccaagaacygcaatgatttaatcagtagggact

SEQ ID NO: 108358 - DNA, 50 bp, homo sapien
tatttcaggtagaagagtaaattgawccctattactacacaacaaacaaa

SEQ ID NO: 108359 - DNA, 50 bp, homo sapien
aaagtttgcgatgcttgcttggaacygaatcattttgatatgactaatta

SEQ ID NO: 108360 - DNA, 50 bp, homo sapien
atgatttttattaactattacagtcmactatctatatctgttggttctgc

SEQ ID NO: 108361 - DNA, 50 bp, homo sapien
agcatgttaaactatctcatgggaakgcaatagacccaagaatctgggaa

SEQ ID NO: 108362 - DNA, 50 bp, homo sapien
agaaaaatgtaaccatattctctatraagattgccatgtattattagaaa

SEQ ID NO: 108363 - DNA, 50 bp, homo sapien
aacctgtttctagaacagttatcaartcttcttggctttgggaaatagat

SEQ ID NO: 108364 - DNA, 50 bp, homo sapien
ttattattataatgtcttccaaacakaaagatcagggccaaagattatta

SEQ ID NO: 108365 - DNA, 50 bp, homo sapien
aatagaaactgtctacattcccgaartcttttgcaatggaaactcttggc

SEQ ID NO: 108366 - DNA, 50 bp, homo sapien
caaaaggtgaaaagataaagccaagrcaatattaggatttcacttccttc

SEQ ID NO: 108367 - DNA, 50 bp, homo sapien
gtaggcagaatgagacccacaaatayggtaattgtatctgaatattatat

SEQ ID NO: 108368 - DNA, 50 bp, homo sapien
ttgagaaccattaggttatatggatkaattgaaggaactctcttaaatta

SEQ ID NO: 108369 - DNA, 50 bp, homo sapien
attcaataccactctaataactgcaygatgaatctcaaaagggactcaca

SEQ ID NO: 108370 - DNA, 50 bp, homo sapien
agaatatcaatttattaatttacaaygcaagtagaagttcttgacaaact

SEQ ID NO: 108371 - DNA, 50 bp, homo sapien
aaatttgattttgtcaacattcccgragtgagtcaattgctgaagatgag

SEQ ID NO: 108372 - DNA, 50 bp, homo sapien
gcaaacaggaacactgacagaaccaytatgaaaaggatgcaaatccacac

SEQ ID NO: 108373 - DNA, 50 bp, homo sapien
gagagataatcttcgtgaaatcgaakgtagttattttgtattttatagga

SEQ ID NO: 108374 - DNA, 50 bp, homo sapien
ttctttccatgggcagatgtcggccragtttactttggtttttctttcag

SEQ ID NO: 108375 - DNA, 50 bp, homo sapien
ttactaaagagagctgacctagcaaraagtttatatgtaaagtatctcaa

SEQ ID NO: 108376 - DNA, 50 bp, homo sapien
gaaattgaaagtctgaacaggcctayaaccagtaaggagattgaatcagt

SEQ ID NO: 108377 - DNA, 50 bp, homo sapien
taaattcttagaaccatataacttaycgagactgaatcatgaagaaattg

SEQ ID NO: 108378 - DNA, 50 bp, homo sapien
ataactgatgccacagaattaaaaamgtatcataagagactagtataaat

SEQ ID NO: 108379 - DNA, 50 bp, homo sapien
tatttgcattttcatgtttgcttttyatttgtcagtgaatatagatttta

SEQ ID NO: 108380 - DNA, 50 bp, homo sapien
ctctcttgggttccgccaatagaagrcatccataggagatctgagggcag

SEQ ID NO: 108381 - DNA, 50 bp, homo sapien
tgcataggagaaggaagctactatasgttaagtcctttctatttgttctg

SEQ ID NO: 108382 - DNA, 50 bp, homo sapien
gctgtaagtaccaatagctcaagaartgctgttataataacccactttat

SEQ ID NO: 108383 - DNA, 50 bp, homo sapien
actgcaggggaaaaggaattttatcrtttttctgatcctaccaagatact

SEQ ID NO: 108384 - DNA, 50 bp, homo sapien
atttaataccacacgtactgtcaaartcagatttgaaattcagttgcctg

SEQ ID NO: 108385 - DNA, 50 bp, homo sapien
ttcagataagagttcatcagattccraaatcttagcatctatcttcacaa

SEQ ID NO: 108386 - DNA, 50 bp, homo sapien
tgcccctggaaagacatcttatttgmagaatcaaactcaaacaaaaattc

SEQ ID NO: 108387 - DNA, 50 bp, homo sapien
gaatcaactttttgagattagaagtraaagacgagataggaaggattgaa

SEQ ID NO: 108388 - DNA, 50 bp, homo sapien
cattactacaatatctgttcttttaygtgttatcttgtctggttcagttc

SEQ ID NO: 108389 - DNA, 50 bp, homo sapien
tttaaaaatcagcttaaatcagaaaygtccttggagatgataatctagaa

SEQ ID NO: 108390 - DNA, 50 bp, homo sapien
tccaaacatcatgtgctgttctttasaggaggtttcagagttaaagtgga

SEQ ID NO: 108391 - DNA, 50 bp, homo sapien
ccattttttcccttctcctattgtartaaagctttatctgagcatgtggc

SEQ ID NO: 108392 - DNA, 50 bp, homo sapien
agtgtgtatgtgtgaattgaataacygaaaaatctcatatccttcctaga

SEQ ID NO: 108393 - DNA, 50 bp, homo sapien
taatataatttttcacactctacatwagtgctcaaaaagtagtttggggt

SEQ ID NO: 108394 - DNA, 50 bp, homo sapien
cctggtttcctatttctgaccttctmattcctttctttagcaacagtaag

SEQ ID NO: 108395 - DNA, 50 bp, homo sapien
aaaataattctttccaaggactctgkgtcagcagctgtgaagcctctaaa

SEQ ID NO: 108396 - DNA, 50 bp, homo sapien
ttattagcagaatcctacatataccyattctaacaggagccatggtgaca

SEQ ID NO: 108397 - DNA, 50 bp, homo sapien
attgaacagatatttttgaacagcarctctgtgtacctggcactacatta

SEQ ID NO: 108398 - DNA, 50 bp, homo sapien
tttggtgacactgacaggataaaaargtctctctgaagtttgcaatgagg

SEQ ID NO: 108399 - DNA, 50 bp, homo sapien
agatgataaagaatgcttctaccacrctgaatcaatttatggcaaaccaa

SEQ ID NO: 108400 - DNA, 50 bp, homo sapien
agggaaaaaaaataggagcattaaaycttaccaaggaaagggtacaagaa

SEQ ID NO: 108401 - DNA, 32 bp, homo sapien
ttatagaaggtagggcrctacagaacaagtca

SEQ ID NO: 108402 - DNA, 50 bp, homo sapien
tgaaggtagaaaagactataaaatayaactcgtcttcccgaaactcaatc

SEQ ID NO: 108403 - DNA, 50 bp, homo sapien
gtaacttagtctatcttgcttcttargtgtatttatagaaggtagggcgc

SEQ ID NO: 108404 - DNA, 50 bp, homo sapien
atgatgtctgatacatagtttggtgycaatttttgtgatacttatatcct

SEQ ID NO: 108405 - DNA, 50 bp, homo sapien
atcatttagtccattggagacaatamgctcttgagtgtttgctgtgtgta

SEQ ID NO: 108406 - DNA, 50 bp, homo sapien
tgtccttactagagttgataattaaytgtccctgacttgaaagataccta

SEQ ID NO: 108407 - DNA, 50 bp, homo sapien
ctttacctaacacacagttgtagcayattaaagcaattaacattggttga

SEQ ID NO: 108408 - DNA, 50 bp, homo sapien
ggaggagattaggtatagcttcaaargaaggaatcttagtttacaaggaa

SEQ ID NO: 108409 - DNA, 50 bp, homo sapien
gctaattactagttgcaaataataaraataatgactaaggttacaatgca

SEQ ID NO: 108410 - DNA, 50 bp, homo sapien
ctacactgtaaggctgctatgtaacrgggagagattataatgaatactgg

SEQ ID NO: 108411 - DNA, 50 bp, homo sapien
tatgaaataagtgttcacaaccctaygagagcagcaaatgcagttttttt

SEQ ID NO: 108412 - DNA, 50 bp, homo sapien
attgaaaagaactaaaattttcataycattgaagtaagttaataaattca

SEQ ID NO: 108413 - DNA, 50 bp, homo sapien
cttggttctggacatgattcttctarcaatgcaggcaaaattgcatgagc

SEQ ID NO: 108414 - DNA, 50 bp, homo sapien
ttaagtgtttattaaaaagtagaggraaagttgagaaattagaaataaat

SEQ ID NO: 108415 - DNA, 50 bp, homo sapien
atattttgggaaaggcagaattatasgaaaataccaaaagtacatctgaa

SEQ ID NO: 108416 - DNA, 50 bp, homo sapien
aatcttgaatcagtctctaaagtaaycaagtcaattcactataactatta

SEQ ID NO: 108417 - DNA, 50 bp, homo sapien
ctgacaggaaactggattgtgtcaaygtcatttactacacttaaaataag

SEQ ID NO: 108418 - DNA, 50 bp, homo sapien
cagggccagaaagacctgtgaccaarttcatgatagctattttctaaaca

SEQ ID NO: 108419 - DNA, 50 bp, homo sapien
ttagaaaaatgaataggattcatcaragattaagaaggagtagccaatac

SEQ ID NO: 108420 - DNA, 50 bp, homo sapien
tgctctaagttacaagttggttccaratctactccacctgtctttcatct

SEQ ID NO: 108421 - DNA, 50 bp, homo sapien
aagggagagacttcatgtggacaaayattatagccaagctgtaacccata

SEQ ID NO: 108422 - DNA, 50 bp, homo sapien
cctaagtggcagaaaggatttgagckctggcaatataggtacaacttctg

SEQ ID NO: 108423 - DNA, 50 bp, homo sapien
gttctttgcatggctgagttaaagasctagaacgtatataaaagcttagt

SEQ ID NO: 108424 - DNA, 50 bp, homo sapien
ttatttttttacaatactcttgtaargaaagcacagagagattaaaatga

SEQ ID NO: 108425 - DNA, 50 bp, homo sapien
taaaaatgagacttcctgaaaagcartaactaggaaatggaacaatggag

SEQ ID NO: 108426 - DNA, 50 bp, homo sapien
aaattgtaaatacttgtcaatataasattacaggaggattagaaggtata

SEQ ID NO: 108427 - DNA, 50 bp, homo sapien
accaatcttctcacatcaaaaactgyagtcactagcactaactgctaaat

SEQ ID NO: 108428 - DNA, 50 bp, homo sapien
ctgctatgtataatacaatgttttaygttcaccagacctgtaacaaaatt

SEQ ID NO: 108429 - DNA, 50 bp, homo sapien
taaaagtttctcttgcctatatttaygtgctctctttgtccccagtgcaa

SEQ ID NO: 108430 - DNA, 50 bp, homo sapien
gaccaaagtagtagtgtataaagcargtgattatgacattttatggtgca

SEQ ID NO: 108431 - DNA, 50 bp, homo sapien
atgtgagctctaactactgttctcaytcaccttttcaagtagctctttcc

SEQ ID NO: 108432 - DNA, 50 bp, homo sapien
ctatttgaggagtacactcaataaawcctgttaataactaataactctca

SEQ ID NO: 108433 - DNA, 50 bp, homo sapien
aataatatttagtagccataatatartaattgctttttgaattgatatta

SEQ ID NO: 108434 - DNA, 50 bp, homo sapien
ggagagtcagggtcagaaaaggagaygtgattaatgacccagaggtcaga

SEQ ID NO: 108435 - DNA, 50 bp, homo sapien
aaaaagaataaaattcatatgtccaygacaaagtctcaactagtcagttt

SEQ ID NO: 108436 - DNA, 50 bp, homo sapien
tgaccaaaaacctgttttaagtttargatagccacaaggagaactgggag

SEQ ID NO: 108437 - DNA, 50 bp, homo sapien
gtcgggcagccttttaatgtgcttaygaagataaagtgtaaataaaatct

SEQ ID NO: 108438 - DNA, 50 bp, homo sapien
tctttagcttttttgaaaaaacaaawtctcatatttagtcaaaacttcta

SEQ ID NO: 108439 - DNA, 50 bp, homo sapien
tgtgaataaaatttttttcctataaratcatgtaatctatcaattttcag

SEQ ID NO: 108440 - DNA, 50 bp, homo sapien
gaagggtagcaaaatataattcagakagggacgctcttctcatgagcttt

SEQ ID NO: 108441 - DNA, 50 bp, homo sapien
caatgagctagattgatgtttgagaygaaatcaactactttaatacctat

SEQ ID NO: 108442 - DNA, 50 bp, homo sapien
catagataaaaaagcactctttactyaattcctagctcctgggctcttcc

SEQ ID NO: 108443 - DNA, 50 bp, homo sapien
ttataactactgcactaagcagccaygttcaggtgaatatctatgtctct

SEQ ID NO: 108444 - DNA, 50 bp, homo sapien
atggctggagttctagttcatgaggygttaagaaggagaggtcaagatat

SEQ ID NO: 108445 - DNA, 50 bp, homo sapien
aaagagtccattttatacataaagawaaaagagaatgttttaagaatttt

SEQ ID NO: 108446 - DNA, 50 bp, homo sapien
tctaagagttattggccttaaggagsagatagataaattaggatagaaag

SEQ ID NO: 108447 - DNA, 50 bp, homo sapien
gctgcagtggccaaagatgtggatcrcaacacttaatttcctttgaatat

SEQ ID NO: 108448 - DNA, 50 bp, homo sapien
atatttttgagttagtctcagcatasattcttacttatggcagagaaagt

SEQ ID NO: 108449 - DNA, 50 bp, homo sapien
agaagagggaagagtaatgagacctytgtattataacttgaatgtcagct

SEQ ID NO: 108450 - DNA, 50 bp, homo sapien
atttatttttgaaaaatattatatcraggacaatctagaattgtcatatg

SEQ ID NO: 108451 - DNA, 50 bp, homo sapien
ctccaatcaattaggcatggcatagwcacagaaaaacaatctgtagaaag

SEQ ID NO: 108452 - DNA, 50 bp, homo sapien
agaagtaattaaccaagagacgatamctttagtaaaaagaatactctctt

SEQ ID NO: 108453 - DNA, 50 bp, homo sapien
tattctagtagattgtgaaagagaamtgtatctacttgcagagttcaaac

SEQ ID NO: 108454 - DNA, 50 bp, homo sapien
ttaacataaatcactaagaaaaatcygtagactgtgagaatataaaaatc

SEQ ID NO: 108455 - DNA, 50 bp, homo sapien
atcaccaggtttgatgggaagtctawcttactttctgtgataagtaggat

SEQ ID NO: 108456 - DNA, 50 bp, homo sapien
gcccttttcacatggaacaaatacaraatggactatcgaattccacaact

SEQ ID NO: 108457 - DNA, 50 bp, homo sapien
tagttagaatttaacttgcacaagaktaactagagttcaggccagaacag

SEQ ID NO: 108458 - DNA, 50 bp, homo sapien
cccttatatttggaataatgaatgaygtgtacaaataccttcccagatat

SEQ ID NO: 108459 - DNA, 50 bp, homo sapien
gaaaaggagacactcctgtacatggsatatagaactagctaactctggag

SEQ ID NO: 108460 - DNA, 50 bp, homo sapien
aatgggtaatgtgtacactcttcaamggttttcttcttaaagagtaaagg

SEQ ID NO: 108461 - DNA, 50 bp, homo sapien
tcagcgccttcctcattaccaccaaygcaggcttcagagaccaaggtgat

SEQ ID NO: 108462 - DNA, 50 bp, homo sapien
gggtgctcaaagatcaggttcacatyagagtggaggatatcctcttgggg

SEQ ID NO: 108463 - DNA, 50 bp, homo sapien
atcatgtattttgagtttgcaaagaratagctggacagtccagaagctat

SEQ ID NO: 108464 - DNA, 50 bp, homo sapien
gctatttctttaaaaaaacatttgcyctttctgtatctcctcattgctta

SEQ ID NO: 108465 - DNA, 50 bp, homo sapien
agagaaggtggctgccaatgactaaratataaaaaaggccacaaaggaga

SEQ ID NO: 108466 - DNA, 50 bp, homo sapien
tgttctggaagctctacttcaatggracttatcctctgtaggaatcttgc

SEQ ID NO: 108467 - DNA, 50 bp, homo sapien
attacaaacctatttggaaccagtgwaactcataggacccagaagaggca

SEQ ID NO: 108468 - DNA, 50 bp, homo sapien
aaacatttatttttcgtatgactttyggttcttttttatctcataaattg

SEQ ID NO: 108469 - DNA, 50 bp, homo sapien
tcttttgtttttaacaaatatacacmataaactgagatttcctgttttgg

SEQ ID NO: 108470 - DNA, 50 bp, homo sapien
caggcattttaaatataaagaaaacragaggtagtgatagtctaggaagt

SEQ ID NO: 108471 - DNA, 50 bp, homo sapien
aattcattgactacgaccaagaaaayctcttatgagaatgcagataacac

SEQ ID NO: 108472 - DNA, 50 bp, homo sapien
tctggattcaatacaaatcaggtaakgaatacaggtgtgtccctctttga

SEQ ID NO: 108473 - DNA, 50 bp, homo sapien
aatttagagttcgtgccactgcagaycaaatggttttgaagaaaaatggc

SEQ ID NO: 108474 - DNA, 50 bp, homo sapien
aacttaatgggtattgcagaagtgartaaagctggggcacctgatgattt

SEQ ID NO: 108475 - DNA, 50 bp, homo sapien
ttcatgggacatcttgttgaataaarccaggtatgggcccagagtttggt

SEQ ID NO: 108476 - DNA, 50 bp, homo sapien
gaaatgcaaagcaataaatggggctwaaaacatgggccggttcggttcca

SEQ ID NO: 108477 - DNA, 50 bp, homo sapien
agaatgtctcattaaagcctctttayacaatctaatccaaatcagtatca

SEQ ID NO: 108478 - DNA, 50 bp, homo sapien
gatggaaaaaaatatttgaaacatawaccttgattgatactgatttggat

SEQ ID NO: 108479 - DNA, 50 bp, homo sapien
tagacattagaaaatgtttaacccaygtatttgtgcttatttttaaatac

SEQ ID NO: 108480 - DNA, 50 bp, homo sapien
gtgctcaattaatatatgttaataartgaatgcatcaaaaaagaaataga

SEQ ID NO: 108481 - DNA, 50 bp, homo sapien
tattgccttattctgtttctataaargaggaaaataagcacaaatatgtg

SEQ ID NO: 108482 - DNA, 50 bp, homo sapien
gactttagaaaccctctctccaaaaytgattcaagcacagcctcatatgg

SEQ ID NO: 108483 - DNA, 50 bp, homo sapien
aatacttgaatacagttttattgacrcaaacatcctgttgccacagaaag

SEQ ID NO: 108484 - DNA, 50 bp, homo sapien
aaagacataaagcgattggaaaatgraagcaagatgtccttaaatggaga

SEQ ID NO: 108485 - DNA, 50 bp, homo sapien
caggcactgtcaccatcccattatgmaagaggaagtccagcccgtgtgcc

SEQ ID NO: 108486 - DNA, 50 bp, homo sapien
cacaagaaaaaaatggcctgagtacygtaatatttgcaagagttctgtat

SEQ ID NO: 108487 - DNA, 50 bp, homo sapien
gagaaagctcaaaagtggcaaaggaycatcaatctatttcaaagatgtgt

SEQ ID NO: 108488 - DNA, 50 bp, homo sapien
aaacctttttaaatgacattttccaytatgtactccaagttgtcttttca

SEQ ID NO: 108489 - DNA, 50 bp, homo sapien
ttcagtttctcctgcacgtccagaaraatgattttgcatgcatggtctac

SEQ ID NO: 108490 - DNA, 50 bp, homo sapien
ccacaggaaatcacagccaatagctraccatttgtaattgagtgtctatc

SEQ ID NO: 108491 - DNA, 50 bp, homo sapien
ttttcaggacaggtatgatgtgttargccaaggagttgaggcaggatgct

SEQ ID NO: 108492 - DNA, 50 bp, homo sapien
aaaaggaacaacatatgtgctatcayaaaggtgggcatgacccatttcca

SEQ ID NO: 108493 - DNA, 50 bp, homo sapien
aagactgtattttattgaaatggtastaagtggagagatgattttgaatc

SEQ ID NO: 108494 - DNA, 50 bp, homo sapien
aaatgccatttatttgccgttgaccrctgggagacttacctgacgcagtg

SEQ ID NO: 108495 - DNA, 50 bp, homo sapien
ttgcttggtaaatgaagttgaataakataacacatagaagacatttaaca

SEQ ID NO: 108496 - DNA, 50 bp, homo sapien
tcttaagtagaaattctttttaaaakatgaaccagtgatctattttttat

SEQ ID NO: 108497 - DNA, 50 bp, homo sapien
cttaaaagtacacaccgacatgcgakatgttgctctgtcacttgctatgt

SEQ ID NO: 108498 - DNA, 50 bp, homo sapien
ctgtctcctgtctgactccatacagyctacctcttgggtaaatggtgtca

SEQ ID NO: 108499 - DNA, 50 bp, homo sapien
gttttcccaaaggtgagagttaagcrcttggggacccaatttaatgctgc

SEQ ID NO: 108500 - DNA, 50 bp, homo sapien
atgctgttctctgctgtctgatgttycttgcagccctcaagctgatctgc

SEQ ID NO: 108501 - DNA, 50 bp, homo sapien
ctgtggagttgccaccatccttgaayggacaggcaatcgtcttgttcttt

SEQ ID NO: 108502 - DNA, 50 bp, homo sapien
ggtcagtgtgattgggcccagaaggytctaagtggcaaggccgagtctgc

SEQ ID NO: 108503 - DNA, 50 bp, homo sapien
ttctggtggcctgacactatttcccrgaaaagaacaagacgattgcctgt

SEQ ID NO: 108504 - DNA, 50 bp, homo sapien
tgatttgttctttttgtacatgcgaygggtatgatcatactagttataat

SEQ ID NO: 108505 - DNA, 50 bp, homo sapien
tataccctatcaatatctattgcttyaacggctaaaaattaagaattgtc

SEQ ID NO: 108506 - DNA, 50 bp, homo sapien
aaggagcccagaaagatgattcaagycagagaataattccaggtcaccct

SEQ ID NO: 108507 - DNA, 50 bp, homo sapien
ccaagaattctggagtgatgccaccrttgacttcagttgagggcagggtc

SEQ ID NO: 108508 - DNA, 50 bp, homo sapien
aagcctccaatctgctcttgctccaygtttttagaggcaactctgtctgc

SEQ ID NO: 108509 - DNA, 50 bp, homo sapien
gccacaaaaaggaaggaaaacctccraacatcagcaaaggaacatccctc

SEQ ID NO: 108510 - DNA, 50 bp, homo sapien
acactgccacccagaaagaactcacsatgatctgaggagctatcagcctc

SEQ ID NO: 108511 - DNA, 50 bp, homo sapien
tagcagttttaccctgcagcatgtakaattatgaaagaatggatcaccag

SEQ ID NO: 108512 - DNA, 50 bp, homo sapien
cagctttaccaatcagacatgagagraggcccgtgaggaagcttctagaa

SEQ ID NO: 108513 - DNA, 50 bp, homo sapien
catgtgggtgctacaatgtttcaatygctaaaaccaagtacataatactg

SEQ ID NO: 108514 - DNA, 50 bp, homo sapien
tttccaccgagatacacagtattctyggtagtcctgtagagttctctgag

SEQ ID NO: 108515 - DNA, 50 bp, homo sapien
ctcttccatataatcttagcttccayatacttatcatcaatgagttgtgt

SEQ ID NO: 108516 - DNA, 50 bp, homo sapien
catcttcccaatcactacagagctawcctaaaggcagatgtgagatacgc

SEQ ID NO: 108517 - DNA, 50 bp, homo sapien
caaaaacaaacaaacaaaaatgagaytcaacctcctcccatctctctgct

SEQ ID NO: 108518 - DNA, 50 bp, homo sapien
gacttccccggtccctccttgcaaawtagtagctcccttctgtgaatttc

SEQ ID NO: 108519 - DNA, 50 bp, homo sapien
ttttgaatgattttcttctttctgtyaaatctcccagtttctgtacttgt

SEQ ID NO: 108520 - DNA, 50 bp, homo sapien
actactcagccttcttgcaataactsttgatggaaagaaatccagaattt

SEQ ID NO: 108521 - DNA, 50 bp, homo sapien
cccagaggctgacctacacatacacmcaagagacatgccttctgagcgtg

SEQ ID NO: 108522 - DNA, 50 bp, homo sapien
tccctctttcgctctactggattcayagttcccctctttctccctctgat

SEQ ID NO: 108523 - DNA, 50 bp, homo sapien
atgccactaataccttcctaagtaaragtcaatgcacaaaagcaccacaa

SEQ ID NO: 108524 - DNA, 50 bp, homo sapien
atcatcagatttaccctgcttgccakatagcatctagtcttcactcaggt

SEQ ID NO: 108525 - DNA, 50 bp, homo sapien
gtacaaggcagctagttggtagtagmctggaattccttttagaaagagct

SEQ ID NO: 108526 - DNA, 50 bp, homo sapien
aggatcctgggtcctatagctttcargtaatatctgggggtgttgtgata

SEQ ID NO: 108527 - DNA, 50 bp, homo sapien
caatgagcatatttcttctccatacrgatgctgaaattaaattattaatg

SEQ ID NO: 108528 - DNA, 50 bp, homo sapien
cacagggattattagtcctaggaaascaactgtgactatggatctttcta

SEQ ID NO: 108529 - DNA, 50 bp, homo sapien
agatgcacttggtatatgcaaataasaaaatatagtcactgcagagaggg

SEQ ID NO: 108530 - DNA, 50 bp, homo sapien
ctttcataaaaatgtatttgcatacytatagctctttctgttaaattttt

SEQ ID NO: 108531 - DNA, 50 bp, homo sapien
gaaggatttcatagagggatataagmggaaattttaaaatacttcaacaa

SEQ ID NO: 108532 - DNA, 50 bp, homo sapien
atataagctatataatgaaagctatraaattgttgctaaattaaaaaatt

SEQ ID NO: 108533 - DNA, 50 bp, homo sapien
cctttttattttacttaacagaattktaatcatgcagaaatgtcctttag

SEQ ID NO: 108534 - DNA, 50 bp, homo sapien
cttcgatcctcagtgggtgagccccraaccattacaaacaggagttagta

SEQ ID NO: 108535 - DNA, 50 bp, homo sapien
gctttctggcttaagtaactgggtaygtgtgatggcattaaccaagccag

SEQ ID NO: 108536 - DNA, 50 bp, homo sapien
gattctttttttcacagatctattaraagtatttctcttgataagtaaaa

SEQ ID NO: 108537 - DNA, 50 bp, homo sapien
acaaagctgtttttcctaaactgcamttcctccagaatctgaaaaacact

SEQ ID NO: 108538 - DNA, 50 bp, homo sapien
gtcacatgggctggtttcgtcatccygaccttttcgcatcattggatcta

SEQ ID NO: 108539 - DNA, 50 bp, homo sapien
cataaaatgctgagacagctgcacamggtaccatggggaaacagaggcac

SEQ ID NO: 108540 - DNA, 50 bp, homo sapien
aactgacaaattttagtgggacttaragcaagaaaagttccttcagctgg

SEQ ID NO: 108541 - DNA, 50 bp, homo sapien
caggaaagtagaatcccttctctaawctggaatcatgtggcaggaagttc

SEQ ID NO: 108542 - DNA, 50 bp, homo sapien
tgatgtcagtaagaaagattagttaygaagttaatgtataactttgcaag

SEQ ID NO: 108543 - DNA, 50 bp, homo sapien
tatgtacttatgaaagagttactccyagaaataagcaaagagtttagatg

SEQ ID NO: 108544 - DNA, 50 bp, homo sapien
ttctagactgagaaacgttactcttraaagcatattgctttgggaatgat

SEQ ID NO: 108545 - DNA, 50 bp, homo sapien
tttaaaaaattttaatatctttaaayctttctacaatggagtcatttttt

SEQ ID NO: 108546 - DNA, 50 bp, homo sapien
tagttattcaacatccatcaaataarataatatcagaaatatgcatacca

SEQ ID NO: 108547 - DNA, 50 bp, homo sapien
aagttgtctagaaataatgctcaagratagatttgaactcagaagagatc

SEQ ID NO: 108548 - DNA, 50 bp, homo sapien
tggctgccagtctgcagtaagataargaacttgtactagaacattaatca

SEQ ID NO: 108549 - DNA, 50 bp, homo sapien
tgagcaatgggtctttggtcaaccakaataactgttggatcactcagtgt

SEQ ID NO: 108550 - DNA, 50 bp, homo sapien
aataggattcttttgagaatcacaartaggaaagccatgagctcacaaaa

SEQ ID NO: 108551 - DNA, 50 bp, homo sapien
agagtaactagtaaattttacgctasagtccttaaaaataaaaaagattg

SEQ ID NO: 108552 - DNA, 50 bp, homo sapien
gcaaaaaaccagtcataattcttgayggtatgattcactaacttctaccc

SEQ ID NO: 108553 - DNA, 50 bp, homo sapien
gctgggtgctgggtgcagaagaggartaatgtccctgctgtcagggtact

SEQ ID NO: 108554 - DNA, 50 bp, homo sapien
gttgtttcctgtttctttggtgttaytaacaatgaagttacaaatacatg

SEQ ID NO: 108555 - DNA, 50 bp, homo sapien
tgaaagatatccccgtctgcacttamggaaagccagaatgaaattttcct

SEQ ID NO: 108556 - DNA, 50 bp, homo sapien
gccgtggtaggccaggctattaccarctatgcaagccctcaggaaatcat

SEQ ID NO: 108557 - DNA, 50 bp, homo sapien
tggtaatatagactttttcactaaaycctaatatgccagacctagaggat

SEQ ID NO: 108558 - DNA, 50 bp, homo sapien
ttaggattaagcatgcagattaatgracgtatttgaactggaaataatca

SEQ ID NO: 108559 - DNA, 50 bp, homo sapien
agcaggtactttactcaaatcgtaarcatccaatttatatcaaatacacc

SEQ ID NO: 108560 - DNA, 50 bp, homo sapien
agcatcagaaaacacaaaggcttcaycggttttggtcacaatctagacac

SEQ ID NO: 108561 - DNA, 50 bp, homo sapien
aaatgaggctcttcttcaatataaaygaaagcccttgtgtttttcgctac

SEQ ID NO: 108562 - DNA, 50 bp, homo sapien
ccctatgttcactgggctggaacccraactgaatccagctctagggaaaa

SEQ ID NO: 108563 - DNA, 50 bp, homo sapien
tccatgtatattaattcatttagcayctgactactccattgtgagctcct

SEQ ID NO: 108564 - DNA, 50 bp, homo sapien
tctccacctccttaagcatcactcamagctcctcttgatattgcccctgt

SEQ ID NO: 108565 - DNA, 50 bp, homo sapien
ttgtacgttcctcaaaagatgtctaygtacagccaagattgagactttct

SEQ ID NO: 108566 - DNA, 50 bp, homo sapien
gagtggagtcagatcaatgtattcaygtaagcttaataagataactcctt

SEQ ID NO: 108567 - DNA, 50 bp, homo sapien
gatgtctatgtacagccaagattgaractttctcacgttaagtcttagga

SEQ ID NO: 108568 - DNA, 50 bp, homo sapien
gcctagaaactaacatactggtccasaactggtaaaactagtggggtgtt

SEQ ID NO: 108569 - DNA, 50 bp, homo sapien
tattgatgtcttcttataagcaaacmaagtaagaaatagtcagttcgaga

SEQ ID NO: 108570 - DNA, 50 bp, homo sapien
ctgcaaatgacttaacacaggggtawcaattagaggatttgtttaccata

SEQ ID NO: 108571 - DNA, 50 bp, homo sapien
ttattcattcattcaattgaatatgktcaattggcatcatgaatctaaca

SEQ ID NO: 108572 - DNA, 50 bp, homo sapien
agcacagtacttagcttgggatagayacttaacaaatgcttgataattgg

SEQ ID NO: 108573 - DNA, 50 bp, homo sapien
aatttaggcctcttgggttcatgacmgtggctagaggtgatgagctaaaa

SEQ ID NO: 108574 - DNA, 50 bp, homo sapien
gtatggtaagactgcaaggaataccmaggcaatatcctcaaatctgtctg

SEQ ID NO: 108575 - DNA, 50 bp, homo sapien
caccaatacagataatataaacgcawatgaaacaatcaggtcatctgttt

SEQ ID NO: 108576 - DNA, 50 bp, homo sapien
gaaatctaccatcattaccaagctcratgaataaatgatatagatatggc

SEQ ID NO: 108577 - DNA, 50 bp, homo sapien
ccttcatgcaactattcaataaacasgataatgtgctcaaactgtacagg

SEQ ID NO: 108578 - DNA, 50 bp, homo sapien
ccgtggtgaaaaccctcctacctagwgcttcgccctcatcacgattatcc

SEQ ID NO: 108579 - DNA, 50 bp, homo sapien
ggatgaaagtgatgccaatgaaaatsatcaataatttcgtggttttacag

SEQ ID NO: 108580 - DNA, 50 bp, homo sapien
aggaaaaaaggatataaccgagggaygtcaacattttttgggaagatgca

SEQ ID NO: 108581 - DNA, 50 bp, homo sapien
gttcttcagtggtttctagtggcccrcgggatataaagtccaaacccctt

SEQ ID NO: 108582 - DNA, 50 bp, homo sapien
ttaggtctgttcctcctgttaaaagrcttcatcattttgtatgtatacag

SEQ ID NO: 108583 - DNA, 50 bp, homo sapien
tcagtgtagatgaaacaactttatayaggaagaagacgccatctagaact

SEQ ID NO: 108584 - DNA, 50 bp, homo sapien
gacatccagccatattacttactaaytggtccacaccaagggcctctcac

SEQ ID NO: 108585 - DNA, 50 bp, homo sapien
gtcactttggtttatttggacaaaaygcttctaattcattattcctcctg

SEQ ID NO: 108586 - DNA, 50 bp, homo sapien
ggtggcaacaaagagtcatgatttayaatctcagatgcttggggttaata

SEQ ID NO: 108587 - DNA, 50 bp, homo sapien
actcaggtctacaaaatccaggcccrctgttcttttaatggcacctcagt

SEQ ID NO: 108588 - DNA, 50 bp, homo sapien
ttttgaaggccattctgggttttctygtccatttcttcacaccctagggt

SEQ ID NO: 108589 - DNA, 50 bp, homo sapien
gttcttagctgacttcttgaagaaaygaaggtgggagaggtagataggac

SEQ ID NO: 108590 - DNA, 50 bp, homo sapien
aaattctatatagattaaaggcctasatgtaatacagaaaaattaaacaa

SEQ ID NO: 108591 - DNA, 50 bp, homo sapien
cccattgagactgtgaaaatcctcargcacgagagggtgcaactgctggt

SEQ ID NO: 108592 - DNA, 50 bp, homo sapien
aacataatgtgctccaattctatccrcattacttcaaataactggatttc

SEQ ID NO: 108593 - DNA, 50 bp, homo sapien
tcctggcttaattcacttaacataaygtgctccaattctatccgcattac

SEQ ID NO: 108594 - DNA, 50 bp, homo sapien
gcttataagaaactgaaagactgagraatttgtggcttaaaaatgtacag

SEQ ID NO: 108595 - DNA, 50 bp, homo sapien
caggatattagggtctctcatcttasattaatttgaataactttagaaac

SEQ ID NO: 108596 - DNA, 50 bp, homo sapien
gtatatataagattaagtatatttaragcatattagaataagagagtaga

SEQ ID NO: 108597 - DNA, 50 bp, homo sapien
ccacaaccagaattttaaaaattgarattcagcgccatagaaaatatcag

SEQ ID NO: 108598 - DNA, 50 bp, homo sapien
ctgttttactattcaagttcagaaaygttagaattagagaataaagtagc

SEQ ID NO: 108599 - DNA, 50 bp, homo sapien
tagcctttatcaatttaatgcttaayaccaaaatgctattcatattttta

SEQ ID NO: 108600 - DNA, 50 bp, homo sapien
tggagcaagtccatgccatcagcagmagataatttaatgtcttttgaaaa

SEQ ID NO: 108601 - DNA, 50 bp, homo sapien
aaatctaaacatatatgatacttttwaaaaaatgcatctataattctttt

SEQ ID NO: 108602 - DNA, 50 bp, homo sapien
ggccagggccagtgagtcttcattcrcagagaggtggtagtgaatctccc

SEQ ID NO: 108603 - DNA, 50 bp, homo sapien
gaaacaagtcgtattttctctgaackgtgggaaagatggccaaagtccag

SEQ ID NO: 108604 - DNA, 50 bp, homo sapien
tcactcttagtacttctggcacataygcttagggccagggccagtgagtc

SEQ ID NO: 108605 - DNA, 50 bp, homo sapien
agactatcacaggaaagctatctaaraggaaacaaattagctcccatcca

SEQ ID NO: 108606 - DNA, 50 bp, homo sapien
atttcttatcacttgctgaaacttasgtaacttaacatcatgccttacaa

SEQ ID NO: 108607 - DNA, 50 bp, homo sapien
agaaaatatttcctcgtaaaatttawctgcttactgtgaatgattcataa

SEQ ID NO: 108608 - DNA, 50 bp, homo sapien
ataaactagattccagttaagctggwcacaaagacatttctggatcatta

SEQ ID NO: 108609 - DNA, 50 bp, homo sapien
atctagaatactaccattaggaatayaccaagaaagtctcttactacctc

SEQ ID NO: 108610 - DNA, 50 bp, homo sapien
agatgcagctgttcttttacagtctkcagagaaaaatgctgacttgatgt

SEQ ID NO: 108611 - DNA, 50 bp, homo sapien
aacaaagcaatgtcagtaaacgccayggaaccgctaggttgtcagataac

SEQ ID NO: 108612 - DNA, 50 bp, homo sapien
gagtttatgcttagtttttgccttaygataatgtgtttgaatattttgta

SEQ ID NO: 108613 - DNA, 50 bp, homo sapien
aagagaaatatgcatagtcaaaaaamctctgtacacatgttcctcaactt

SEQ ID NO: 108614 - DNA, 50 bp, homo sapien
agatttaatatattttgccatgacaygctcttagtggtgatggcttttac

SEQ ID NO: 108615 - DNA, 50 bp, homo sapien
tagcctgtctttctatgtggacatcygatatatttgtccctatcttttct

SEQ ID NO: 108616 - DNA, 50 bp, homo sapien
ctgcatctcagctccataaagaacaytggctccttacgtcactctaatgc

SEQ ID NO: 108617 - DNA, 50 bp, homo sapien
ccttaccctttagagatttcttttgwcagcttacagaagccaaatctgtc

SEQ ID NO: 108618 - DNA, 50 bp, homo sapien
ggtaactcacattaatgtccacaaaratgcactgggttgtaagaggacac

SEQ ID NO: 108619 - DNA, 50 bp, homo sapien
tgtctacacttatgacctttcagcaytatatccattcttaaactttgcta

SEQ ID NO: 108620 - DNA, 50 bp, homo sapien
caggttctcacatctttttagatgcratcaggaaaataggtggatagaat

SEQ ID NO: 108621 - DNA, 50 bp, homo sapien
acctgccttttagatctccgcttagkatagaccattgtagcatgacaatt

SEQ ID NO: 108622 - DNA, 50 bp, homo sapien
gggattccagggatcctcaccaacaygattcaacataattcccaagttgt

SEQ ID NO: 108623 - DNA, 50 bp, homo sapien
ctcaaacccatagcaattattgaaarctctttgtttctgttcaattaatt

SEQ ID NO: 108624 - DNA, 50 bp, homo sapien
gtgaggaaatctttctcttatcacartcactttatatacagtcatccctt

SEQ ID NO: 108625 - DNA, 50 bp, homo sapien
tctgagctgggtcactctgattttargttctataatttagatatatgtgt

SEQ ID NO: 108626 - DNA, 50 bp, homo sapien
tcaattataaatcattttacctggcrctctatgaggcactaaataatttt

SEQ ID NO: 108627 - DNA, 50 bp, homo sapien
atactctgaatgctccttaaatatgractaaaacttattagagagattca

SEQ ID NO: 108628 - DNA, 50 bp, homo sapien
ataaatcttaggaaacgtaacttgaratatttagtaaaagcatgccctaa

SEQ ID NO: 108629 - DNA, 50 bp, homo sapien
attgtgggtcccaccctcagagtttyggaatcagtaggtctggggcgcac

SEQ ID NO: 108630 - DNA, 50 bp, homo sapien
ggaactgagttccttgctgtaacacygaggcctttttatctttcctgctg

SEQ ID NO: 108631 - DNA, 50 bp, homo sapien
tgcaagattatttaggtacgtaccayatttggtgttaatgtctctttaaa

SEQ ID NO: 108632 - DNA, 50 bp, homo sapien
tcttgaaggccaaacttgagactagracttcatcagctcatgttccagcc

SEQ ID NO: 108633 - DNA, 50 bp, homo sapien
tgtcctttatgttgataaaattgcasaaactgctgtagtgcaatgtcctt

SEQ ID NO: 108634 - DNA, 50 bp, homo sapien
agatgtactcccaaaagctgtgtaargcaaaaagaaagggaaggcaggat

SEQ ID NO: 108635 - DNA, 50 bp, homo sapien
ttgaccaagatcacagaattagcagktggcagaccccagtttcaaaccca

SEQ ID NO: 108636 - DNA, 50 bp, homo sapien
tcctttctcttcattatttttgctayataaactctagtatcttttttttt

SEQ ID NO: 108637 - DNA, 50 bp, homo sapien
aaggcaactcaaattctcgtaactcrattgataaaacagcatgaaaaatg

SEQ ID NO: 108638 - DNA, 50 bp, homo sapien
tcttttctgggcatacattttataayaataatcttgcactcagattttaa

SEQ ID NO: 108639 - DNA, 50 bp, homo sapien
gttccatttttggaatcccatagacsatgctctgtgataagaggagcagt

SEQ ID NO: 108640 - DNA, 50 bp, homo sapien
tgaaaatcatttctcctttttaacayatctctattattaaaatctgagtg

SEQ ID NO: 108641 - DNA, 50 bp, homo sapien
cacaaatttgctaattgtttttctgyagatgtgagctgtcaaccggtgga

SEQ ID NO: 108642 - DNA, 50 bp, homo sapien
tttgcttgtttaatgtgtaaaccaaygataattcacaaatttgctaattg

SEQ ID NO: 108643 - DNA, 50 bp, homo sapien
tctttcagttttgctttgagtaataraaccatacaaatacaactgaagaa

SEQ ID NO: 108644 - DNA, 50 bp, homo sapien
aaaaatagctccatttattaatgaamaacaatatcctgtaatcaagacac

SEQ ID NO: 108645 - DNA, 50 bp, homo sapien
attatgcaggtggtcctggagactgscacataatggtgactgagatatga

SEQ ID NO: 108646 - DNA, 50 bp, homo sapien
tagggagaaggggttgccaataggaragtggaattcctgagcacctcgtc

SEQ ID NO: 108647 - DNA, 50 bp, homo sapien
ttgaacatggctgctcctcccactgmaaatccacctaaatccatctaatg

SEQ ID NO: 108648 - DNA, 50 bp, homo sapien
ttagttcttggttatttttgtacaasagctgatacagcaactggactaga

SEQ ID NO: 108649 - DNA, 50 bp, homo sapien
ggggggttggttaaaatttcagttamgttttcatagtctctgagagtgtg

SEQ ID NO: 108650 - DNA, 50 bp, homo sapien
tgaaagcacctctattccagccattrtcattatccattatcattaatgat

SEQ ID NO: 108651 - DNA, 50 bp, homo sapien
tgaaatgccagtgctgttaaaattayattagtttgatctcaactaggaag

SEQ ID NO: 108652 - DNA, 50 bp, homo sapien
taagtacaaagacaaagaaaggttayacatattgaaagatatctaaaaat

SEQ ID NO: 108653 - DNA, 50 bp, homo sapien
gcccatgaaatgtaagtagtcagacyggaaatgtactataagtgtgaaat

SEQ ID NO: 108654 - DNA, 50 bp, homo sapien
gatctctacatgtctgcaaaggatcrcgtgggtctattttgaatttggac

SEQ ID NO: 108655 - DNA, 50 bp, homo sapien
cccatggctatttccttagtttctcrcttttcaatgttctccttttctga

SEQ ID NO: 108656 - DNA, 50 bp, homo sapien
tggattacatactcatgaaaatttayagttagtcatgtttatttatggac

SEQ ID NO: 108657 - DNA, 50 bp, homo sapien
taagtatttctctgacttatcagtckcttaataccataaaaaatgatgaa

SEQ ID NO: 108658 - DNA, 50 bp, homo sapien
gtcggtaaccttgtgcctattggcarcttctcaatgagaacactgtagag

SEQ ID NO: 108659 - DNA, 50 bp, homo sapien
cttccaagcagaagttcttttcataygtcttatctcaaactatgttattt

SEQ ID NO: 108660 - DNA, 50 bp, homo sapien
tgggacagaaggcatatagtctacawcagctctgtagatcctagcagcaa

SEQ ID NO: 108661 - DNA, 50 bp, homo sapien
ttttttttttttaacagccacataaygaacacctgttaaatatcaggtgc

SEQ ID NO: 108662 - DNA, 50 bp, homo sapien
tgaacaatatgtaatactagcaaacragtttaaattgcatatcaaaggtt

SEQ ID NO: 108663 - DNA, 50 bp, homo sapien
agaagttgggtagtacataaaacagwctacttcatgtattccttcaacca

SEQ ID NO: 108664 - DNA, 50 bp, homo sapien
aacaatataattgtggttgcagaaaracctaaggaatctattaaaaaaaa

SEQ ID NO: 108665 - DNA, 50 bp, homo sapien
tcatagcagcgatagtgttacccaaygcctgaaaacatttactgctgctg

SEQ ID NO: 108666 - DNA, 50 bp, homo sapien
taagtttgatcaaatgccaaggtagmatagtggcacagtcttgagtagac

SEQ ID NO: 108667 - DNA, 50 bp, homo sapien
tataaatggaggttttaaagcctcawctaattctgatagcagtcatagtc

SEQ ID NO: 108668 - DNA, 50 bp, homo sapien
tttaatattcaattccataactgagmaatcagcataagcaatgtaaattt

SEQ ID NO: 108669 - DNA, 50 bp, homo sapien
aggcactgagaatacacattgcactragggaaaatgaagtcactgatgat

SEQ ID NO: 108670 - DNA, 50 bp, homo sapien
gaagtccagtcaacagggcttccctyaggagatgttctctaaactgtgtt

SEQ ID NO: 108671 - DNA, 50 bp, homo sapien
cgatgagtaccgtgaggctctaccaygaagaatacatttctgagtgtgaa

SEQ ID NO: 108672 - DNA, 50 bp, homo sapien
taacaaatggcagcttttatcattayggcatcatcgtcatcttcttcttc

SEQ ID NO: 108673 - DNA, 50 bp, homo sapien
ggattcaccatattttatggatacasaaattactccagtattattcaaaa

SEQ ID NO: 108674 - DNA, 50 bp, homo sapien
tttctctgttttgctacaatgaagaraagaagcaagaataagtagttgaa

SEQ ID NO: 108675 - DNA, 50 bp, homo sapien
ggaaaagcatatgtcatattagtaamcataaaagcttgagtggctatatt

SEQ ID NO: 108676 - DNA, 50 bp, homo sapien
gggaaattggaaaggaccaagtccgmattataaagcaacaagagaaagta

SEQ ID NO: 108677 - DNA, 50 bp, homo sapien
atctggaacttactgtaaaggtttaygcaatagtgtctttaacagaagaa

SEQ ID NO: 108678 - DNA, 50 bp, homo sapien
tttattctagaattttctatcatagycctaaaaagcctcaattctctgca

SEQ ID NO: 108679 - DNA, 50 bp, homo sapien
aattatgattttgagaagtggcccakcgagggttttgtcttttcattatt

SEQ ID NO: 108680 - DNA, 50 bp, homo sapien
gcattttatcaagctgtacccttaargtttgtgtgcagtgctagatgtga

SEQ ID NO: 108681 - DNA, 50 bp, homo sapien
tgttaatatgcaacagatgatcaaayggtcaaaatgtcttgtgtcctgag

SEQ ID NO: 108682 - DNA, 50 bp, homo sapien
gttcaactgaatgaaagtgccataartcatatgagtagtcaccttttgat

SEQ ID NO: 108683 - DNA, 50 bp, homo sapien
aggcttacacgatgagaacacaccaygaaaccataaggcaataaagggga

SEQ ID NO: 108684 - DNA, 50 bp, homo sapien
aattttaatgaacagtatttcttggycatgtacaggtgaaatactttatg

SEQ ID NO: 108685 - DNA, 50 bp, homo sapien
ggaatggtagcgttattatttcccaygctcactgaagtgggtgctcttcc

SEQ ID NO: 108686 - DNA, 50 bp, homo sapien
agatgacggggtagaagtccacttaycatacactcctgctgggccaattg

SEQ ID NO: 108687 - DNA, 50 bp, homo sapien
attacttacttattctttatgtataycacattgcaatattctagtaggtc

SEQ ID NO: 108688 - DNA, 50 bp, homo sapien
tcctagaaagacataagagtaactcragaaaaaaagccacatgtctggat

SEQ ID NO: 108689 - DNA, 50 bp, homo sapien
acatcctctggcctttgagttgcatygaacctgaaatgtagagaagaaag

SEQ ID NO: 108690 - DNA, 50 bp, homo sapien
caagaagtgactctgagatgtaaacyaatttcaggccacaactccctttt

SEQ ID NO: 108691 - DNA, 50 bp, homo sapien
tagcaagtggtaagcactcaataacraataaagtcatttataaaggcata

SEQ ID NO: 108692 - DNA, 50 bp, homo sapien
aactctgggatggtgtttgtgtaacrggtcgaatgtgaaacccagcttgc

SEQ ID NO: 108693 - DNA, 50 bp, homo sapien
ggccaatgattctggcctaatcacayatgaaaaatctatgctcaaaagca

SEQ ID NO: 108694 - DNA, 50 bp, homo sapien
tcatattcaaaccatctttatttacraaatactatcctgagaactattat

SEQ ID NO: 108695 - DNA, 50 bp, homo sapien
caactagctacatagggaagcagtayagcacagtacattttttggtcttc

SEQ ID NO: 108696 - DNA, 50 bp, homo sapien
gtgtttaaggcaaaagtcattgagcyactatcactgaatatcaggctaat

SEQ ID NO: 108697 - DNA, 50 bp, homo sapien
gcctcctgcaagattctcgatgggayatatgaagacaattatcctgtttg

SEQ ID NO: 108698 - DNA, 50 bp, homo sapien
tggatactaatcatattaggaaagaratatatagatgagcaaataaatga

SEQ ID NO: 108699 - DNA, 50 bp, homo sapien
aggttgttatgaagctggtaacctgracagatgaggtaatgtctctccct

SEQ ID NO: 108700 - DNA, 50 bp, homo sapien
tgtcggtgactttagagagagcttgyagaatgttaatattgctttaaaaa

SEQ ID NO: 108701 - DNA, 50 bp, homo sapien
agattaaaagaaataggcaatgggayagtaaactggaaaatatatttgaa

SEQ ID NO: 108702 - DNA, 50 bp, homo sapien
gaaatgtgaaaacaaagccttcaccrattctaaaataggaagatgcagaa

SEQ ID NO: 108703 - DNA, 50 bp, homo sapien
atgaactaacaattagctatgtattsaaagaagcatacagaaaatacaaa

SEQ ID NO: 108704 - DNA, 50 bp, homo sapien
ttaaatctgtctgtataataatttakgaggtaattggttaaaataagcca

SEQ ID NO: 108705 - DNA, 50 bp, homo sapien
aacctgaaaatctcacaacaggttgraactatctttagtatttctgcata

SEQ ID NO: 108706 - DNA, 50 bp, homo sapien
tgtttgtgaactttgaagacagttgsattgaatgagagtcacagatctga

SEQ ID NO: 108707 - DNA, 50 bp, homo sapien
gaggataaattattttaatagaatgycataaccacaagggtaaatactag

SEQ ID NO: 108708 - DNA, 50 bp, homo sapien
ataaatactaagaatggtaatatgcycaactaaaatcagatgagagagga

SEQ ID NO: 108709 - DNA, 50 bp, homo sapien
attagaactggagaagaataaattasaaagactgatgaaaaagctgaaga

SEQ ID NO: 108710 - DNA, 50 bp, homo sapien
aagtgacagcaggtatgaatttaaaragaatggacattgaaaaagaacaa

SEQ ID NO: 108711 - DNA, 50 bp, homo sapien
acaaggacaaaggcagacaggttcaragtctacaaaataatgaagcatat

SEQ ID NO: 108712 - DNA, 50 bp, homo sapien
aaatgaaaaaaactttcttaacttayatgagtgacatgctgtatagtaag

SEQ ID NO: 108713 - DNA, 50 bp, homo sapien
ttggctatagtattcccacttttaawcaaatgtcaattaaggtgcaggtt

SEQ ID NO: 108714 - DNA, 50 bp, homo sapien
ataaaaaaataaacaatttagaacamagtgaattcagtacattcagtggt

SEQ ID NO: 108715 - DNA, 50 bp, homo sapien
tgattttaagacccatggactcttcyaaaatcctaaatataataaggaaa

SEQ ID NO: 108716 - DNA, 50 bp, homo sapien
atattacttttccactcagctcaagmaagggaagtgctccgtttttctgt

SEQ ID NO: 108717 - DNA, 50 bp, homo sapien
tatatgggaaaaatagagagccaaaygttttcttaccagaagtctagact

SEQ ID NO: 108718 - DNA, 50 bp, homo sapien
tgacttccagaaaaaaaagtatttartagcaattacgtgttttgttatgt

SEQ ID NO: 108719 - DNA, 50 bp, homo sapien
cccagatggtggaagctccgccatcytgagttcctgtgtgactgaggtga

SEQ ID NO: 108720 - DNA, 50 bp, homo sapien; identical to SEQ ID NO: 108694

SEQ ID NO: 108721 - DNA, 50 bp, homo sapien
ggcccagtgttgtctacccaagcagraggaaagctgaacacatagccagc

SEQ ID NO: 108722 - DNA, 50 bp, homo sapien
cgtgaagggccttttacaaagaatcraacaggctgctttagaaaactact

SEQ ID NO: 108723 - DNA, 50 bp, homo sapien
ttccctccctgagagccgggatgcgyagcttttagatccgcttagttaca

SEQ ID NO: 108724 - DNA, 50 bp, homo sapien
agatgcttagaatctttgttatctaygtatgagggtcaattatatcttgg

SEQ ID NO: 108725 - DNA, 50 bp, homo sapien
tgttccaatcactcatttgtgaagarcactctaaatctgaaaggaaggca

SEQ ID NO: 108726 - DNA, 50 bp, homo sapien
gtcacaaaagtgttaagtgtctacartgatcagttatgctatgtagttat

SEQ ID NO: 108727 - DNA, 50 bp, homo sapien
aaaacatacatcagtacatacaacgyaaagtcttggtcacgttactgctg

SEQ ID NO: 108728 - DNA, 50 bp, homo sapien
gcagattgccacatatctattacagracatcattgcctaaattaggcact

SEQ ID NO: 108729 - DNA, 50 bp, homo sapien
agaaaagaatgggactctgcaactcrgaacggggatgtgtgggaggagcc

SEQ ID NO: 108730 - DNA, 50 bp, homo sapien
gagttggcacaaggtggtcaaattayggtgaaatctgggtgtaagacaga

SEQ ID NO: 108731 - DNA, 50 bp, homo sapien
cttcattaagtgagggatgctgataktaagtgtgttataccttgttcttt

SEQ ID NO: 108732 - DNA, 50 bp, homo sapien
gtattcacaattccgtctaataatarctatatacatctcatttaacagtt

SEQ ID NO: 108733 - DNA, 50 bp, homo sapien
taaggctaccagggttcccatagacmgcgtacttcccttcagtggcaagc

SEQ ID NO: 108734 - DNA, 50 bp, homo sapien
tcccgggaaggaagtgactctcccasaaataaaatgattgaatgaactct

SEQ ID NO: 108735 - DNA, 50 bp, homo sapien
tcaaattcaacaatacattaaaagaycattcatatgcaaatcattcagtg

SEQ ID NO: 108736 - DNA, 50 bp, homo sapien
cctttccatggaaaatgggttatgayagctcagaatctgtatcctctttc

SEQ ID NO: 108737 - DNA, 50 bp, homo sapien
tggttcgtgttctttcaggtattcarctttagcggggcattatgtatgtt

SEQ ID NO: 108738 - DNA, 50 bp, homo sapien
gaaaacttaaaatgtactcttaaatyaggcatacgttgaagacataataa

SEQ ID NO: 108739 - DNA, 50 bp, homo sapien
tattgttgtctgttttgttgattcayagagtaggatacttcaaaaacaaa

SEQ ID NO: 108740 - DNA, 50 bp, homo sapien
tcaaatatttggaaacaactctatcmcactcttaattatctgctttacaa

SEQ ID NO: 108741 - DNA, 50 bp, homo sapien
cctcaaccctttttggaatgatatakgtcataaaaactagcagcgtagtt

SEQ ID NO: 108742 - DNA, 50 bp, homo sapien
ataaagctaaaaatgttagataatcrgagtttttctgcaatgtacaattt

SEQ ID NO: 108743 - DNA, 50 bp, homo sapien
aacgatcagagcagaaataaatgaaractaacaacaataaaagcatcaaa

SEQ ID NO: 108744 - DNA, 50 bp, homo sapien
gtactcgcgagtggttggtgtagtayaaggtgacagatgatgcctttcgg

SEQ ID NO: 108745 - DNA, 50 bp, homo sapien
cattgtattaatcactgtgcctaatsactgtactattcttattcatatgt

SEQ ID NO: 108746 - DNA, 50 bp, homo sapien
tggagacaggctcaactcccgaatcrcgtggcatgttgactaccaacagc

SEQ ID NO: 108747 - DNA, 50 bp, homo sapien
aacaggaaaaaaagtagaaaatacamtgtagtgaagaagaagcaaggtca

SEQ ID NO: 108748 - DNA, 50 bp, homo sapien
acttgggaatcatggaggtatgcaaygggaatccaccgatggctacagaa

SEQ ID NO: 108749 - DNA, 50 bp, homo sapien
aaagaataataaattgatgttaaaasgacatgagagaccgtttaaaggag

SEQ ID NO: 108750 - DNA, 50 bp, homo sapien
taaagttattcagattcccacttgartatacttgagaaaacaatattttt

SEQ ID NO: 108751 - DNA, 50 bp, homo sapien
acgctgcgaaaacactgggttaaatraagctgaacaggtttctttattaa

SEQ ID NO: 108752 - DNA, 50 bp, homo sapien
cctcccctgcatttatgtacagagargagatggctgtgcagcactgtgga

SEQ ID NO: 108753 - DNA, 50 bp, homo sapien
aacgggaaaatattatagacagtaarggcactgaaaaactttcagagtct

SEQ ID NO: 108754 - DNA, 50 bp, homo sapien
aggcctttccatacagaaatgtggaygtaaactgaagcgatccatataac

SEQ ID NO: 108755 - DNA, 50 bp, homo sapien
cacaacggtttttttattccattcamctctcgtttatcactcacttctga

SEQ ID NO: 108756 - DNA, 50 bp, homo sapien
gtcaccagactgagaaccaccgctayatgtactggtatcgacaagacccg

SEQ ID NO: 108757 - DNA, 50 bp, homo sapien
gggctctgggtgattccagcatccaygtgtcctgtaatagaaaacaacag

SEQ ID NO: 108758 - DNA, 50 bp, homo sapien
atacaatttgtatattgttttatgcyctgtcacattagttcacctcacag

SEQ ID NO: 108759 - DNA, 50 bp, homo sapien
tctcttacctgggcctcaaatgatasttatgactttaaaagtgcattttc

SEQ ID NO: 108760 - DNA, 50 bp, homo sapien
acagtggaatgctacacagccattaracatgaacctgggtctctgcatct

SEQ ID NO: 108761 - DNA, 50 bp, homo sapien
cactctgttcctggcttaaaaggccrgagactttcaaacattgacataca

SEQ ID NO: 108762 - DNA, 50 bp, homo sapien
tgtcacccatacagaattggagaaarggttatattctgcttttgctaatg

SEQ ID NO: 108763 - DNA, 50 bp, homo sapien
taatgatttataaggtgggcacttamactcaaaatcttatagcccttatt

SEQ ID NO: 108764 - DNA, 50 bp, homo sapien
cacagccaaaccgtatcagtaataaragaatgaaagtgggagggaatgat

SEQ ID NO: 108765 - DNA, 50 bp, homo sapien
cttctagaaacatcaattgtatgacrccaggatcatatgctttgcatgtc

SEQ ID NO: 108766 - DNA, 50 bp, homo sapien
ctttagagggaaaaatatagttccaytctagttgataagataaaccacca

SEQ ID NO: 108767 - DNA, 50 bp, homo sapien
tggtaaatgttcctgcattctaaaaytaggaggatcttattttctttgaa

SEQ ID NO: 108768 - DNA, 50 bp, homo sapien
actggccaatcttgaaaaatgaagarcagatattgaaaggccgtctgagt

SEQ ID NO: 108769 - DNA, 50 bp, homo sapien
ttggtgtcttgcatatggaagtcacyattatagacggcatttgaagccat

SEQ ID NO: 108770 - DNA, 50 bp, homo sapien
tatgtcctgaagccctgagtactacrcttaaatcaatatgatacaaaatg

SEQ ID NO: 108771 - DNA, 50 bp, homo sapien
ctggtatggaatatttgttcagagcmctttaatagttctgctttgtccac

SEQ ID NO: 108772 - DNA, 50 bp, homo sapien
aagttagcagaattcataaacactcrcaataggcagcctgaaggtttaaa

SEQ ID NO: 108773 - DNA, 50 bp, homo sapien
tcataaaaaaacaacatgcttttcamattagtaccaagattataaagact

SEQ ID NO: 108774 - DNA, 50 bp, homo sapien
gatatgacacattttatacttcagamcttaaacatgttagatgcatacaa

SEQ ID NO: 108775 - DNA, 50 bp, homo sapien
tcttgatcccactcattcctccaaaygctgtattggctcttccatcttca

SEQ ID NO: 108776 - DNA, 50 bp, homo sapien
tttgatttcctattttgtagcatcamttgtttcatttcctcttttatgga

SEQ ID NO: 108777 - DNA, 50 bp, homo sapien
aaactgaaatatttggaaattgaatsaacagtgccacgttaggcagccta

SEQ ID NO: 108778 - DNA, 50 bp, homo sapien
aatgtaaatgttttaagtgaacaagygagattttaatagctcaacaggca

SEQ ID NO: 108779 - DNA, 50 bp, homo sapien
gaatgggctaatacagtaaatgcagygagaagaatgagtagaaattaata

SEQ ID NO: 108780 - DNA, 50 bp, homo sapien
aacagagaatgagccattgtcaacaygtgaaagtaaagggcacctgcctg

SEQ ID NO: 108781 - DNA, 50 bp, homo sapien
ctgccaaagcaatatcttctaaatamtccacccaatgccccatgaattac

SEQ ID NO: 108782 - DNA, 50 bp, homo sapien
ctggtagtcttggtgttatactactsaaaaaacaggattgtaaaatgtaa

SEQ ID NO: 108783 - DNA, 50 bp, homo sapien
aaaggtactctggttgacccttctgkatctattcactcctaagtttacaa

SEQ ID NO: 108784 - DNA, 50 bp, homo sapien
ggttaaatagattttctaagttgaarcagtgtcttaatggcttcaatatt

SEQ ID NO: 108785 - DNA, 50 bp, homo sapien
atttctttcagctcttgtcattcagkttaaagagaaaccatttgacattc

SEQ ID NO: 108786 - DNA, 50 bp, homo sapien
tttacatgggaaagtagcagagaaasgaaaaacattaaaagacagatatt

SEQ ID NO: 108787 - DNA, 50 bp, homo sapien
actttgccctcacttccgctcatttycagtgatccactcccattggcaca

SEQ ID NO: 108788 - DNA, 50 bp, homo sapien
tttatggcatgaagacagtggctcarcctgataaaggaggtggttgagag

SEQ ID NO: 108789 - DNA, 50 bp, homo sapien
aataaaacaacagcaaatattacaarcaggtagagttaataactgtcaat

SEQ ID NO: 108790 - DNA, 50 bp, homo sapien
ttatagacctacgtgctcagtataargaagtccaagacatggtccctaca

SEQ ID NO: 108791 - DNA, 50 bp, homo sapien
taagtgggtaccaggctatgtgctamgtatgttattccacttaaccagcc

SEQ ID NO: 108792 - DNA, 50 bp, homo sapien
caatatttttattagttcagtagtckatcagtttgcacagagaagtggat

SEQ ID NO: 108793 - DNA, 50 bp, homo sapien
ctccagccaaactggtatactggtaraaccccgataagataagcaagtaa

SEQ ID NO: 108794 - DNA, 50 bp, homo sapien
tgaggtgtttgaaaatgattactagraaaccagaaatttttaacagaaat

SEQ ID NO: 108795 - DNA, 50 bp, homo sapien
cagaaaagccaggcaaatgatgaacycaaataaccaaaatacaagccatt

SEQ ID NO: 108796 - DNA, 50 bp, homo sapien
gaggatttctattttctccatgaaayaagaggtcagaggtttcctgaagc

SEQ ID NO: 108797 - DNA, 50 bp, homo sapien
aatgaataaaactccctaactctgasgataccaagtactgccaaagatgg

SEQ ID NO: 108798 - DNA, 50 bp, homo sapien
attattagtcatgtatcttttttccmgatcactaggaactagatggaaat

SEQ ID NO: 108799 - DNA, 50 bp, homo sapien
ctgctattttgcaaggtgctcgtgargattaaatgcattaatgtcatgta

SEQ ID NO: 108800 - DNA, 50 bp, homo sapien
ggtccagaacggttacttcagaacaractactcgaattaatatcactgtg

SEQ ID NO: 108801 - DNA, 50 bp, homo sapien
aaaaaatctgaaaagatcatgatcgkgtaaagagattgattccacaataa

SEQ ID NO: 108802 - DNA, 50 bp, homo sapien
tattggcacaaactctgctagtatcraccatttccaatattagaaataga

SEQ ID NO: 108803 - DNA, 50 bp, homo sapien
acgatggacatccagaactggagtaraaagaagcgttggaataccctttc

SEQ ID NO: 108804 - DNA, 50 bp, homo sapien
tgtctggtttaaattccaactaccaytcttgccagaagaaaatcgtttcg

SEQ ID NO: 108805 - DNA, 50 bp, homo sapien
ctgtatgctttgagagcaataaaacracattaaatactcttcacctcaga

SEQ ID NO: 108806 - DNA, 50 bp, homo sapien
agattttgaaaagtcctgtagaaacraaatactgtatatttttcaacatt

SEQ ID NO: 108807 - DNA, 50 bp, homo sapien
aatcttgatattttaaaggtacataygatgccaatgttgccgtatagctc

SEQ ID NO: 108808 - DNA, 50 bp, homo sapien
ggaaatgctttttatatcagtgcatmaacagttgcccgtatttctttcta

SEQ ID NO: 108809 - DNA, 50 bp, homo sapien
tatgaattgaatgatttaaagaaccrataagaagtgttctcatggcaagg

SEQ ID NO: 108810 - DNA, 50 bp, homo sapien
aaaacaagtgttggaaaaattgcaayggtgctgaactttactaagaggca

SEQ ID NO: 108811 - DNA, 50 bp, homo sapien
aaaagagcttggtataaaagacctcraaatagtaggacaggggttgccac

SEQ ID NO: 108812 - DNA, 50 bp, homo sapien
attttaagcttcttgaatacagagamcagattcaacattcattgttgtct

SEQ ID NO: 108813 - DNA, 50 bp, homo sapien
ttccatgtttgagtccaaatgaaaakgactcatattgagtgtttaaattg

SEQ ID NO: 108814 - DNA, 50 bp, homo sapien
acaccaagtgcccgagaccttttcayatatcaatcgttgagatggctttt

SEQ ID NO: 108815 - DNA, 50 bp, homo sapien
tataagtggcagaatgactatcagtyaaatcttaatagtgagaaatcata

SEQ ID NO: 108816 - DNA, 50 bp, homo sapien
ccagattggagatccagtttccttcyaacttggtttgctcttgatccaag

SEQ ID NO: 108817 - DNA, 50 bp, homo sapien
aggataataccaagagtttggagtaygcgccttacccagtgttcccatga

SEQ ID NO: 108818 - DNA, 50 bp, homo sapien
tgtgttgaatttctcacttagattayaaattgttttcctgatttcttaaa

SEQ ID NO: 108819 - DNA, 50 bp, homo sapien
tttttccatttgatatttaccgtgarctgacctgtctatgctcacccagc

SEQ ID NO: 108820 - DNA, 50 bp, homo sapien
ttgttgagccaactactaacgcagtracagtacaaagatgaatcagacca

SEQ ID NO: 108821 - DNA, 50 bp, homo sapien
actcagaataacatcttattccgaawatcttcctcaagcaatcttgaata

SEQ ID NO: 108822 - DNA, 50 bp, homo sapien
ccacatcctatcacatgtgtctgtayactttctgtttttaaaaagtctta

SEQ ID NO: 108823 - DNA, 50 bp, homo sapien
cttgaaacagaaaataatactgacaycagaatagaggtgcagaaagggaa

SEQ ID NO: 108824 - DNA, 50 bp, homo sapien
aaagaagatttttgtcaataaaatarctctatttgtgtaatggatgtctt

SEQ ID NO: 108825 - DNA, 50 bp, homo sapien
gtctcaaaaaaaaagaaatccacacycaagactgagagaaatgtccagaa

SEQ ID NO: 108826 - DNA, 50 bp, homo sapien
acagactgaggctcatactgtccggrccacttagggccactcggggttcc

SEQ ID NO: 108827 - DNA, 50 bp, homo sapien
taatattggggctttggctaaatcaytaaggtcccacctagctctaaaac

SEQ ID NO: 108828 - DNA, 50 bp, homo sapien
ctgtctttgccaatgcctcgtgacaygtttccagcgatgcctccctaggt

SEQ ID NO: 108829 - DNA, 50 bp, homo sapien
attaagtaattgagggtaattatgaygacaaaagtaaaatatcatatgta

SEQ ID NO: 108830 - DNA, 50 bp, homo sapien
cagaccatttctttcagttctctaascttttagttgctctcagttttttt

SEQ ID NO: 108831 - DNA, 50 bp, homo sapien
tcaaaaacaccaggaagacatgaggrattgccctaagactctagactaca

SEQ ID NO: 108832 - DNA, 50 bp, homo sapien
tcaaaattaaggaagtaaggaggcaytaatagaagatacaggaggactat

SEQ ID NO: 108833 - DNA, 50 bp, homo sapien
ggcagtgctgggtggccaccatcatycatacagagagggcagtcagcagc

SEQ ID NO: 108834 - DNA, 50 bp, homo sapien
actactcccctgaggtgggcagagaracaatcacagaatcatattctgca

SEQ ID NO: 108835 - DNA, 50 bp, homo sapien
tctgaaaaaccagagagagaattgascaacctgtcgaatcactactttca

SEQ ID NO: 108836 - DNA, 50 bp, homo sapien
aacaataaagttcttgagatttcacragtaatttattgatgtccagaatt

SEQ ID NO: 108837 - DNA, 50 bp, homo sapien
atcagcaaaaatagtgacaataataytacctctcctaagcaattcctgag

SEQ ID NO: 108838 - DNA, 50 bp, homo sapien
tggctcatttaggtgtattcccttcyaaatactattctaattattccaac

SEQ ID NO: 108839 - DNA, 50 bp, homo sapien
tgcccaaaaagggaaagttagcataraagagtcttggtgatttcaatcac

SEQ ID NO: 108840 - DNA, 50 bp, homo sapien
cagatagtttagagatagacccacaratttatggtaaattgttttttgac

SEQ ID NO: 108841 - DNA, 50 bp, homo sapien
aaatatctgtgtttttaatacaaacsgtaatacacagtgagtctataagt

SEQ ID NO: 108842 - DNA, 50 bp, homo sapien
ttctggggtacatctgataactacaytgaggaattgagagatttcatgag

SEQ ID NO: 108843 - DNA, 50 bp, homo sapien
cctccctgggtaatcacattttaggrcaatcacgaacaggttgattctat

SEQ ID NO: 108844 - DNA, 50 bp, homo sapien
tcatgggtttaacttaggatcatagyaggacaatcataacagctctttca

SEQ ID NO: 108845 - DNA, 50 bp, homo sapien
taaaagcaaatataataaacattcartacaaagtcgttcatatggaagaa

SEQ ID NO: 108846 - DNA, 50 bp, homo sapien
gttgtgaaattgtcatggaaaaagayaggtcatggttaataagtaagtgt

SEQ ID NO: 108847 - DNA, 50 bp, homo sapien
gaattaattaagttaaaattacctaygatatgctctatagattacattct

SEQ ID NO: 108848 - DNA, 50 bp, homo sapien
gcattatgctttcttcaaaggtcacratttttctgcttagatgttcagac

SEQ ID NO: 108849 - DNA, 50 bp, homo sapien
aagatgcttaacgccaaagtgtttcrggaaaaatcaatagcagcctttag

SEQ ID NO: 108850 - DNA, 50 bp, homo sapien
tttctgctacctataaagccaatggyatcagaaagtacacaaggtttgaa

SEQ ID NO: 108851 - DNA, 50 bp, homo sapien
tctgataccattggctttataggtarcagaaaataatcttttgtgactag

SEQ ID NO: 108852 - DNA, 50 bp, homo sapien
aataacatgaggaaagtcaacatgaraaaaaataatgcacattcataatt

SEQ ID NO: 108853 - DNA, 50 bp, homo sapien
atgagaaaaaataatgcacattcatmattgcaaaattcagacagctacaa

SEQ ID NO: 108854 - DNA, 50 bp, homo sapien
aaacagaaagactctgaagcagtgargtggaaccctggccttgagggcca

SEQ ID NO: 108855 - DNA, 50 bp, homo sapien
gtccagctcccttctgaagatcggayattcttttaaaggcaaataagacg

SEQ ID NO: 108856 - DNA, 50 bp, homo sapien
gtaggaaagtcagtattaatattacrtaacatgaggtcaaaggcagaact

SEQ ID NO: 108857 - DNA, 50 bp, homo sapien
aatatagaagtaactgacaagagtcratccagtgatatagagaagatggt

SEQ ID NO: 108858 - DNA, 50 bp, homo sapien
ttttcccctagacaatatcaggttascgtcaacattaatccatttaaaag

SEQ ID NO: 108859 - DNA, 50 bp, homo sapien
aatttttcccttataactatgaactkaacacatcgtagatacgcataaaa

SEQ ID NO: 108860 - DNA, 50 bp, homo sapien
tggggactaaatagctgtttagaggmcaaagcaaattcatattgttagag

SEQ ID NO: 108861 - DNA, 50 bp, homo sapien
gcgttaagtcacacaggcgaacataytacaagtttattatttcctaaaat

SEQ ID NO: 108862 - DNA, 50 bp, homo sapien
accccaacaggtgtctcagagtagcracacctaagcaagaccctgagcac

SEQ ID NO: 108863 - DNA, 50 bp, homo sapien
aaataatcagcgatttcaccacttaygttctattttaatcacagaggatg

SEQ ID NO: 108864 - DNA, 50 bp, homo sapien
tgagcaaatcttgaaaatttgtatayggctgtttaacctaaggatatttt

SEQ ID NO: 108865 - DNA, 50 bp, homo sapien
caggtctcctgtacgttacatgaacygagcaggagatgtcattcacaatc

SEQ ID NO: 108866 - DNA, 50 bp, homo sapien
tcgctgagtttggccaaaggcaacartctgacatggaataacattacagg

SEQ ID NO: 108867 - DNA, 50 bp, homo sapien
gctgatgttatagatattccgtccakatttacatttgtatggttccatga

SEQ ID NO: 108868 - DNA, 50 bp, homo sapien
gaagttgtcagagctgatatcctagragcagatttcaatcaatgtcagtt

SEQ ID NO: 108869 - DNA, 50 bp, homo sapien
ctgtgacatgaacgtacctcagagartagacatttagaattagtgtgtac

SEQ ID NO: 108870 - DNA, 50 bp, homo sapien
agcagatttcaatcaatgtcagttasgacttatggataaacaccacaact

SEQ ID NO: 108871 - DNA, 50 bp, homo sapien
attggagtaaactgttaaaatagtcragcagtccttaagcggcagcatcc

SEQ ID NO: 108872 - DNA, 50 bp, homo sapien
aggaaatggttatcctgttaatacawtctatacaggtgagcctcagagaa

SEQ ID NO: 108873 - DNA, 50 bp, homo sapien
aagctgctaaacatcacgcaacgcaygggaccgtcctccatgacaaagga

SEQ ID NO: 108874 - DNA, 50 bp, homo sapien
atctcctcattcaattcaagaattcragatccaaaacaacattcagtttg

SEQ ID NO: 108875 - DNA, 50 bp, homo sapien
attgtttcgagtccagtatctttacyctgcaaatcatttattccttccct

SEQ ID NO: 108876 - DNA, 50 bp, homo sapien
gaaaagttcattttatattgtaaaargggttgctgattacttttgcagct

SEQ ID NO: 108877 - DNA, 50 bp, homo sapien
gaaatttaaacaaattaatggactayacattacttagcacagtgcctacc

SEQ ID NO: 108878 - DNA, 50 bp, homo sapien
tcccatttaccattctctgggtacamagttcagcataattttatttttag

SEQ ID NO: 108879 - DNA, 50 bp, homo sapien
aatggcattacagagctctgtgtaawctaaggcacatttagggaccctgt

SEQ ID NO: 108880 - DNA, 50 bp, homo sapien
cccacaagtggggaaagataatgtgstaaaggcagatcctctctgagtcc

SEQ ID NO: 108881 - DNA, 50 bp, homo sapien
gctcttagggtgacagcctattcagrattaggatgacaccgtcttaggat

SEQ ID NO: 108882 - DNA, 50 bp, homo sapien
ggctaggaagctactttctagtaaarattctaaacagtgtaagatagcac

SEQ ID NO: 108883 - DNA, 50 bp, homo sapien
cttttgctccagaactattgtaggamtataccaggaaagctgagagaatc

SEQ ID NO: 108884 - DNA, 50 bp, homo sapien
gtggcatggaaacaattgtgttagayggttcaaaatgccactgtcatgat

SEQ ID NO: 108885 - DNA, 50 bp, homo sapien
attccccaaatattaggctaaaggayatttctgaattattatattacctt

SEQ ID NO: 108886 - DNA, 50 bp, homo sapien
aagcatttttacaagacaaaaggaartgtagaagactacgtaagactgca

SEQ ID NO: 108887 - DNA, 50 bp, homo sapien
cagagatgacagtctaactagcaaamaaggaatgtgtctttcaggttcct

SEQ ID NO: 108888 - DNA, 50 bp, homo sapien
aactcaattacttataggagtcagaygtatattctaataagacagacact

SEQ ID NO: 108889 - DNA, 50 bp, homo sapien
gtttatagaattaatctgatatttcrgttgcaggctattagtgattgtgt

SEQ ID NO: 108890 - DNA, 50 bp, homo sapien
agatagcaggacaatattacagttaygattgatctgtttgacaacaacat

SEQ ID NO: 108891 - DNA, 50 bp, homo sapien
ctgagttttatttaatgggtcattcrcttaggctttcaccacctcttggt

SEQ ID NO: 108892 - DNA, 50 bp, homo sapien
tgaatgtgaacattgttttgcataargaagtccagattaatattagtagc

SEQ ID NO: 108893 - DNA, 50 bp, homo sapien
aagaataagaccagattaactcatamgaggaaaaataggaaaagaagctg

SEQ ID NO: 108894 - DNA, 50 bp, homo sapien
ataaggatgttactagaattatgctsatattacaggtgaggaagttgagg

SEQ ID NO: 108895 - DNA, 50 bp, homo sapien
gtatagttgttacatagaaataataycagttggtttccccataataattt

SEQ ID NO: 108896 - DNA, 50 bp, homo sapien
acttgtttgaaacttgaggctattaygaaaattctttaaaagtacaatgt

SEQ ID NO: 108897 - DNA, 50 bp, homo sapien
acactataagcattagaatcttgaamtagaatcttgacattatctgactt

SEQ ID NO: 108898 - DNA, 50 bp, homo sapien
cagtgaaccttggaatctaaactaaygaagaaaaggagtgaggacaagag

SEQ ID NO: 108899 - DNA, 50 bp, homo sapien
actgagaaaccaaagcaagatgaaasaagcatgaaccttagttcacactt

SEQ ID NO: 108900 - DNA, 50 bp, homo sapien
caaaccaactcctttggcagaattckaaaagcaacttgtacgcaactcta

SEQ ID NO: 108901 - DNA, 50 bp, homo sapien
atctagatagtgtgatactgagatarggataaacatataaatcaataaaa

SEQ ID NO: 108902 - DNA, 50 bp, homo sapien
actacggatcctctgctggttgaaasctagacatttaagatattattttg

SEQ ID NO: 108903 - DNA, 50 bp, homo sapien
tgtcaaaacttgacaaacaatttaartgaagaactgaagtatagctgcaa

SEQ ID NO: 108904 - DNA, 50 bp, homo sapien
cattttttagattaatgtaatgaaaygtatgagactgttagtccagtttg

SEQ ID NO: 108905 - DNA, 50 bp, homo sapien
aattagtttccagttatattctaaayagtttagcgcatggatggcaacat

SEQ ID NO: 108906 - DNA, 50 bp, homo sapien
acaatattctgaagacaatcatttargtgtagaaagaacttccttgaaca

SEQ ID NO: 108907 - DNA, 50 bp, homo sapien
tggaaactaattttcagaaccgtcaragattcaatgcagaattcattaca

SEQ ID NO: 108908 - DNA, 50 bp, homo sapien
ataattttttctccttgtgctgtaaratatgaacaaagagattttagaag

SEQ ID NO: 108909 - DNA, 50 bp, homo sapien
aagaaaccccttttatgcactgaaamaaattttgcatatccattctacta

SEQ ID NO: 108910 - DNA, 50 bp, homo sapien
tcacagcaacagtgggtgaaaaggaygctatgtgctgggcaaatgatgaa

SEQ ID NO: 108911 - DNA, 50 bp, homo sapien
aaatgtaggtatttataattatctgyagttttgatattgcttttgattct

SEQ ID NO: 108912 - DNA, 50 bp, homo sapien
taggccaaagactttcctagtaacayataattcagcctacttcaaaagtt

SEQ ID NO: 108913 - DNA, 50 bp, homo sapien
tgtctaagtgtctaataaggaagaasttaaaatgtgggcacctatgtaaa

SEQ ID NO: 108914 - DNA, 50 bp, homo sapien
ctgccaggtctacctcagtgaaaackcattgaccttgtgcatagcaagag

SEQ ID NO: 108915 - DNA, 50 bp, homo sapien
gaacatgctggtatgcatgaaggtarcatttacttaacacatgttcactg

SEQ ID NO: 108916 - DNA, 50 bp, homo sapien
caaccagtctgtttgtcattgttcayggttttgtacttcattatctgaat

SEQ ID NO: 108917 - DNA, 50 bp, homo sapien
gttagtatttttgagatggcaaagaratattgttcaaaaaaaatttatgg

SEQ ID NO: 108918 - DNA, 50 bp, homo sapien
attccccattttttgcagttacttcrgaaaggccatatatatacatggat

SEQ ID NO: 108919 - DNA, 50 bp, homo sapien
ggagtagttactgcaccatcatggasactcttacaggagatgaaaggcgc

SEQ ID NO: 108920 - DNA, 50 bp, homo sapien
gcccaactttgtagaactcaaaatcygagaactcctaattcttggaggtc

SEQ ID NO: 108921 - DNA, 50 bp, homo sapien
gttaggacatccaattctatataacmaaatgtagatgagtaaaaagtatt

SEQ ID NO: 108922 - DNA, 50 bp, homo sapien
aggactgttgggctttgtttcagcaygtagtgaacttacttgcaaatcat

SEQ ID NO: 108923 - DNA, 50 bp, homo sapien
atcatgatggccttgtgtccaatgarccatttaaggggacactgtttaga

SEQ ID NO: 108924 - DNA, 50 bp, homo sapien
taaacccttcatcacttatgtgcaayagataccttctcctgccatgtggg

SEQ ID NO: 108925 - DNA, 50 bp, homo sapien
gatggagggaaggagccacttctgaygcttattaacatggccctgaacca

SEQ ID NO: 108926 - DNA, 50 bp, homo sapien
tcatctcttattcaaatttttagaawcgttcatagtagattcggactatc

SEQ ID NO: 108927 - DNA, 50 bp, homo sapien
gaatttggtgattgactatgctacargacaacactaaaaaatatcccgat

SEQ ID NO: 108928 - DNA, 50 bp, homo sapien
taaagaaacaatttgcttatttggcyctatatacatgtatacaacaggta

SEQ ID NO: 108929 - DNA, 50 bp, homo sapien
ccctctaaaggttagctgaaaatgartaaatgacaagagggggattaata

SEQ ID NO: 108930 - DNA, 50 bp, homo sapien
caggttactgcatgatctaatggtcmagcacaattttgaaatttagattt

SEQ ID NO: 108931 - DNA, 50 bp, homo sapien
ttgggtgagagccctttaaggacccragagcctgcagagatcaaagtccc

SEQ ID NO: 108932 - DNA, 50 bp, homo sapien
tgtgggagagcaacagtaactgagcrgcatccagaaactcatgaactgtt

SEQ ID NO: 108933 - DNA, 50 bp, homo sapien
gaaactagatactattatacagacaytgacgattacagaggttaaggagg

SEQ ID NO: 108934 - DNA, 50 bp, homo sapien
tcaaatgactacaagagaatgacgaygaggaaatgagtagagccaaccca

SEQ ID NO: 108935 - DNA, 50 bp, homo sapien
tgtgaatcaatcaatcaatcgtacartcttcctttacctaaattaatcac

SEQ ID NO: 108936 - DNA, 50 bp, homo sapien
tgaactgtaactaatcctccactcamaactcccatgtgcttggctggtgc

SEQ ID NO: 108937 - DNA, 50 bp, homo sapien
atcagtcatcggccagccacgttaastcacttgagagtctcacagaagct

SEQ ID NO: 108938 - DNA, 50 bp, homo sapien
atgaaacttccatacaaacccctaartgacagattttggacagcttccaa

SEQ ID NO: 108939 - DNA, 50 bp, homo sapien
aagtatcatcaactgctggattataygttctcctttatttctcattgcac

SEQ ID NO: 108940 - DNA, 50 bp, homo sapien
tagttgtcactagtgaatgtgatcartgacaagagaacatcatactctga

SEQ ID NO: 108941 - DNA, 50 bp, homo sapien
accaaaatagaagcaaacctggcaaytgagcgagtaagaactctggaaga

SEQ ID NO: 108942 - DNA, 50 bp, homo sapien
cagctgacaatctgtcccttgtacastcctagtgaatttcctaaacaaat

SEQ ID NO: 108943 - DNA, 50 bp, homo sapien
aagaatgtttatttaacacttagaasatatacagtcaatacctcttgtaa

SEQ ID NO: 108944 - DNA, 50 bp, homo sapien
tgtaattctttggtcttcttggcctyaattctatgaaaatgaacaagaca

SEQ ID NO: 108945 - DNA, 50 bp, homo sapien
agtaaattggctcctgttaccctcartagaagaaattgttagttttgagg

SEQ ID NO: 108946 - DNA, 50 bp, homo sapien
tatagaaggtctataaaattctgatmatatcctcacaccccaaaaggtta

SEQ ID NO: 108947 - DNA, 50 bp, homo sapien
caaagaagaggggatttctctttctraaatttgtagtaatgtgtttctgg

SEQ ID NO: 108948 - DNA, 50 bp, homo sapien
ccatttgactacctatctctaataastactataaacctgtatggccatat

SEQ ID NO: 108949 - DNA, 50 bp, homo sapien
gtaagtgtctaaggaatgatttgtgycactaagaaacaatctccacaggt

SEQ ID NO: 108950 - DNA, 50 bp, homo sapien
ggtggtcactgcagcatgtctgcacrgtcgatacagggtgtgggcgtcag

SEQ ID NO: 108951 - DNA, 50 bp, homo sapien
ctaatatgtcagcaggagagccaaasactagcgtatgaaacagcaaaaca

SEQ ID NO: 108952 - DNA, 50 bp, homo sapien
ctttgtaattagtccctttgcaaatraacactctacaaattttccaagat

SEQ ID NO: 108953 - DNA, 50 bp, homo sapien
ttgtcataaaccattatgtccttgaraaccacctgcatggctagagtttt

SEQ ID NO: 108954 - DNA, 50 bp, homo sapien
atgctaagctttcgtacttgccttaycaatgagtcactggctctggctga

SEQ ID NO: 108955 - DNA, 50 bp, homo sapien
gtatgacctgagccggttgctaacasagtcattattagattaagtcctcc

SEQ ID NO: 108956 - DNA, 50 bp, homo sapien
aagtcatttatataaggtcaacaaargtttatactgaacataagacagat

SEQ ID NO: 108957 - DNA, 50 bp, homo sapien
acttagcaattttaaacttgaattcrcaaaatactctcaaaatatataaa

SEQ ID NO: 108958 - DNA, 50 bp, homo sapien
gcagtgctgacccttgaaagtttccractggaatcaaggttattaatcac

SEQ ID NO: 108959 - DNA, 50 bp, homo sapien
ctcgtgtccaggagagtaagtcacamgtgggataggtttgttgatccatt

SEQ ID NO: 108960 - DNA, 50 bp, homo sapien
cgacccagtctagatgcaggagcacrgaaaacaaatatatcaagaagaga

SEQ ID NO: 108961 - DNA, 50 bp, homo sapien
gtctttgtgagatgaagtgggacaamtaatttaatagagttaataataat

SEQ ID NO: 108962 - DNA, 50 bp, homo sapien
gaaagacagttgtgtcagggaagacsagaaccacagccaaaggggacaga

SEQ ID NO: 108963 - DNA, 50 bp, homo sapien
ggcttgatttgtggataggagttgayggtttgctcaagaaggtgcatttt

SEQ ID NO: 108964 - DNA, 50 bp, homo sapien
cttttgaaaggctcaggttgccttakagtcttccataaaaatactgaggg

SEQ ID NO: 108965 - DNA, 50 bp, homo sapien
cctggtgacattggtggaaggctcaytgagatgattttactgtgaacgat

SEQ ID NO: 108966 - DNA, 50 bp, homo sapien
atacccaaaaggtcttttagccatgwaagagaatatactcacaggctcca

SEQ ID NO: 108967 - DNA, 50 bp, homo sapien
tcactctaggagacagttggaaataktattaaaaagatgtacccttcaaa

SEQ ID NO: 108968 - DNA, 50 bp, homo sapien
tgcctggcaaatagtacgctcttcayaggttggctataaatattgcagtc

SEQ ID NO: 108969 - DNA, 50 bp, homo sapien
agggatgaatttcactttatggtaaragttcaagatgattttggagctag

SEQ ID NO: 108970 - DNA, 50 bp, homo sapien
ttctttcttgacaatttgttagaacycatggttgccacgagttgggtgcc

SEQ ID NO: 108971 - DNA, 50 bp, homo sapien
tcactcatgttaatgggtgggcatayctgctcttactcacgtacacccta

SEQ ID NO: 108972 - DNA, 50 bp, homo sapien
attcaaacataataggtatccaatamagatttgttgatagaaaaatgaga

SEQ ID NO: 108973 - DNA, 50 bp, homo sapien
tgtgtttgtgaaggacaataaataasatccatacaatatcctcctgtggc

SEQ ID NO: 108974 - DNA, 50 bp, homo sapien
atagtctaagtgaaagacatgttcayagtaggcttacaagaaatatttca

SEQ ID NO: 108975 - DNA, 50 bp, homo sapien
tgtacatcctgagatctgactgttayggagaaaagatttagtaacttatt

SEQ ID NO: 108976 - DNA, 50 bp, homo sapien
ccaagacaaaacaggttccaattctkcacaaatatgagataattgaaaag

SEQ ID NO: 108977 - DNA, 50 bp, homo sapien
tctatcaactattactaaagcagaartattatgaaacagttaaaaaatat

SEQ ID NO: 108978 - DNA, 50 bp, homo sapien
aagtggcatgataggtggctagataygcagacaagaaaagattaagtcat

SEQ ID NO: 108979 - DNA, 50 bp, homo sapien
ttgcaccaaggaagtgagttaatacrcctgcccactgcagtccctagagc

SEQ ID NO: 108980 - DNA, 50 bp, homo sapien
gtttcatctagaataactaatttgcratgctcaagatgacagtagtggcc

SEQ ID NO: 108981 - DNA, 50 bp, homo sapien
aagttccaaacagcaatcgtttctgragcctgatttggataaaaccagat

SEQ ID NO: 108982 - DNA, 50 bp, homo sapien
gaagcagagagaggatgaagaattarcagggaaaagaaacaataacatcc

SEQ ID NO: 108983 - DNA, 50 bp, homo sapien
accccatgtggctttaagtagaagaraagtacattgataacagaagagtc

SEQ ID NO: 108984 - DNA, 50 bp, homo sapien
tggcagtatctgaggcgagagagacsaaagcaacaatgacaatgaatctt

SEQ ID NO: 108985 - DNA, 50 bp, homo sapien
ttcacaatgaatagcatatttaaaaygtcaacccagtgttgattcttatg

SEQ ID NO: 108986 - DNA, 50 bp, homo sapien
gtgtgtgtttcactttgcaaaatgaraacagcataaccaggagagagaga

SEQ ID NO: 108987 - DNA, 50 bp, homo sapien
cagaatctcccctggccgcgaagacygtccgcttccctgagtttagaaga

SEQ ID NO: 108988 - DNA, 50 bp, homo sapien
tttataaattgcctctttacaattaygattgaagactgagaccaagggaa

SEQ ID NO: 108989 - DNA, 50 bp, homo sapien
aataaaaataaggcatcttgctagayagtatgatgtgatgtagaacatag

SEQ ID NO: 108990 - DNA, 50 bp, homo sapien
atctttggtctaagtggaactagagraatattatggaatgctccaaatct

SEQ ID NO: 108991 - DNA, 50 bp, homo sapien
aacttgcacacattattaatgaaaakggaagtaggagtttccaatactaa

SEQ ID NO: 108992 - DNA, 50 bp, homo sapien
aacataatttctcctatactcctagycatatatcttcatctttgttgttg

SEQ ID NO: 108993 - DNA, 50 bp, homo sapien
actctcaagcaagagaataccttaayatacctgaacagatcctgtcctta

SEQ ID NO: 108994 - DNA, 50 bp, homo sapien
agtggtgaacgtactcattattaaamggactcagaaatactgtggttcaa

SEQ ID NO: 108995 - DNA, 50 bp, homo sapien
cctggggtagagaaaggggaaagaayacgccaggagaaagtgaaagccct

SEQ ID NO: 108996 - DNA, 50 bp, homo sapien
cttacagcaaacacttttagtgacamacaagtcaaattaataataataat

SEQ ID NO: 108997 - DNA, 50 bp, homo sapien
gcttcagtccttccagcacaattacrgctggtcacatgttggtgctatta

SEQ ID NO: 108998 - DNA, 50 bp, homo sapien
atttctatcagctgacctttattcaytacggttttagtatgagccttgtt

SEQ ID NO: 108999 - DNA, 50 bp, homo sapien
tgaggcagccttcccctcttccgcasagtgccacacagaacaggggtctg

SEQ ID NO: 109000 - DNA, 50 bp, homo sapien
aattaaccagcattttaacacggaartaagcaataaactaatgctttaac

SEQ ID NO: 109001 - DNA, 50 bp, homo sapien
attggatttttcttcttcttctatgsattattaaaggtcatgctgttctc

SEQ ID NO: 109002 - DNA, 50 bp, homo sapien
tctccctattgtagcagaaaatatcragagacacagagaaatagtgtatc

SEQ ID NO: 109003 - DNA, 50 bp, homo sapien
gaaacaaagtacgcaacatgtcaccragagaaaatgactgctcataccga

SEQ ID NO: 109004 - DNA, 50 bp, homo sapien
aacatctgtttactgtcaattgggawcaaacctatgtacaattacatgtt

SEQ ID NO: 109005 - DNA, 50 bp, homo sapien
taaaaacagaatatttggggatgaarcattattcttttcagttgtcattt

SEQ ID NO: 109006 - DNA, 50 bp, homo sapien
ccttccctctgcccttccttagaatrgaaggctgttctacaaatacatgg

SEQ ID NO: 109007 - DNA, 50 bp, homo sapien
ttctagcttccagaataatttctcaytgaatacgtagttctcaaaacaaa

SEQ ID NO: 109008 - DNA, 50 bp, homo sapien
acaagtcacatgagtcagaagacacraggtaacaagtagttttggccatc

SEQ ID NO: 109009 - DNA, 50 bp, homo sapien
ttcacatccacttaaaggagagaacrcatcttgcaaaatttcatggaatg

SEQ ID NO: 109010 - DNA, 50 bp, homo sapien
gcaacttcttatttcagctgtgtcayatgccttagtttatatagtccatt

SEQ ID NO: 109011 - DNA, 50 bp, homo sapien
aaaataccatttatactgagagtgasgaaagatgattcagtgtcaatgtc

SEQ ID NO: 109012 - DNA, 50 bp, homo sapien
aaactggtccttccaggacagaaagkctcatatcagataatatagggcaa

SEQ ID NO: 109013 - DNA, 50 bp, homo sapien
attatatgacccaaatccaaagacastctgaatcttctgcagagccactc

SEQ ID NO: 109014 - DNA, 50 bp, homo sapien
ggcattttcaggcattttagatgacrgcattgcgggatctcgttctttgt

SEQ ID NO: 109015 - DNA, 50 bp, homo sapien
ggcactaaggagattaaataaagagycgctatgttctaaatgttgataag

SEQ ID NO: 109016 - DNA, 50 bp, homo sapien
ttattggcttggcttttcttggactstcaagtagtgtatactcaaactgt

SEQ ID NO: 109017 - DNA, 50 bp, homo sapien
ctttttcacagtggcttatttcctcwtctgttttggtatttttgttatct

SEQ ID NO: 109018 - DNA, 50 bp, homo sapien
tctttcctaggcttcacactcccacktccattcagcagaatctttcagca

SEQ ID NO: 109019 - DNA, 50 bp, homo sapien
tggtgatgaatactaaaactgaaaamggtatcagggaatatctggtacaa

SEQ ID NO: 109020 - DNA, 50 bp, homo sapien
atgtgatattgggcaagttacttatragcatcagttttctcctttgtaaa

SEQ ID NO: 109021 - DNA, 50 bp, homo sapien
tcaggaaagaattgaccagttcccartaatcaatgaaaagaatagaaaaa

SEQ ID NO: 109022 - DNA, 32 bp, homo sapien
agagtgggaagttgggwaagtcaaagacagag

SEQ ID NO: 109023 - DNA, 50 bp, homo sapien
ttctttcactgctccaacacaatacraagagctgtatttttctctctctc

SEQ ID NO: 109024 - DNA, 50 bp, homo sapien
cacatcagtcaactaatattacaacratgctgcttaacaataagaatgca

SEQ ID NO: 109025 - DNA, 50 bp, homo sapien
ttctggtttgcttgttagtcattacmatcaaacaataccaagtcactaaa

SEQ ID NO: 109026 - DNA, 50 bp, homo sapien
ggaaaccttagtgggacactgaaaartgagttaatgttaaataaggagtt

SEQ ID NO: 109027 - DNA, 50 bp, homo sapien
atatattttactatagcagaaacaargtcgagaacaatacctaccaggga

SEQ ID NO: 109028 - DNA, 50 bp, homo sapien
cagcacttgatattccagaccaccaytaattatgctctcagcaatgtcaa

SEQ ID NO: 109029 - DNA, 50 bp, homo sapien
ttcgtttgatagaatttccagttaaygtattataagttataatatgcctt

SEQ ID NO: 109030 - DNA, 50 bp, homo sapien
tttatcctgcttacaggtcatatggracttcttaaatctgtgactgaaat

SEQ ID NO: 109031 - DNA, 50 bp, homo sapien
cttaaaaggaaataaggaataggaamtagacagaggaaagcttgaccatt

SEQ ID NO: 109032 - DNA, 50 bp, homo sapien
tcccattaaatcttttaacaaacatmattccctctcacctagagaccatc

SEQ ID NO: 109033 - DNA, 50 bp, homo sapien
gtctcagcagacaagatggttatatwgcagggctcacttgcatgggcaat

SEQ ID NO: 109034 - DNA, 50 bp, homo sapien
cagggctttcactctcttactatggycagcttcacagtctctgtgaccct

SEQ ID NO: 109035 - DNA, 50 bp, homo sapien
acatatttaaagtcaattatcataasaagcctcagacaaaggtactatta

SEQ ID NO: 109036 - DNA, 50 bp, homo sapien
ggcttgagtcttgaaatcaattttargctctatacctcagagggaaaagg

SEQ ID NO: 109037 - DNA, 50 bp, homo sapien
aattgtggcagtactggtctccttgygtaattgagagtgatgggatcaac

SEQ ID NO: 109038 - DNA, 50 bp, homo sapien
aataaaaataggcaaacactatataygctgtaaacctttggagtactcct

SEQ ID NO: 109039 - DNA, 50 bp, homo sapien
acaggtgtgagccactgtgcccagawgcattaattatcctttaaagagat

SEQ ID NO: 109040 - DNA, 50 bp, homo sapien
atataataacctgtaggaaaatgctwaatctttctggaaacatacatttt

SEQ ID NO: 109041 - DNA, 50 bp, homo sapien
gggagtaggccttaattagccctacmgtaatggctactacaaaacacgtt

SEQ ID NO: 109042 - DNA, 50 bp, homo sapien
gacattgcgtttcttaattatagaamatcagagcagttttaccatcttgg

SEQ ID NO: 109043 - DNA, 50 bp, homo sapien
caaacaagtacttactgactgtaatractttgggaaatgctcacaataaa

SEQ ID NO: 109044 - DNA, 50 bp, homo sapien
gagaatgtagcatctctgaattttarcagggcatcatcaagttctgtcat

SEQ ID NO: 109045 - DNA, 50 bp, homo sapien
ttgagtgatgagattatgttctaaartcactcccacagagagctgcaaaa

SEQ ID NO: 109046 - DNA, 50 bp, homo sapien
agaatcccaaggtcctctgagtaaargttgaaagagcacataaaattatg

SEQ ID NO: 109047 - DNA, 50 bp, homo sapien
cattgttcatggttcatttaaaatayattatgaggataatcaaatacagt

SEQ ID NO: 109048 - DNA, 50 bp, homo sapien
actcccatgttgaccgaatatacacrgaaaggaggagtgattacagtacc

SEQ ID NO: 109049 - DNA, 50 bp, homo sapien
tctctgctgtccctgtccgaccttcyaggtgtaggagtcgccggctgtgg

SEQ ID NO: 109050 - DNA, 50 bp, homo sapien
ttggagcattgaggtacccagagaaygtaatgtaggcctagaacattaaa

SEQ ID NO: 109051 - DNA, 50 bp, homo sapien
atgcagaaaacaggcataaggtacawgtaagacaggatgaaaagtgtaat

SEQ ID NO: 109052 - DNA, 50 bp, homo sapien
ccccctgaagcacattttgtattacwccattaagtgatgttcaagtacag

SEQ ID NO: 109053 - DNA, 50 bp, homo sapien
atctgaatgttgacactgttttatamaatagtaaatctagtctttgctgt

SEQ ID NO: 109054 - DNA, 50 bp, homo sapien
cccattcagaatggcgagctatcatrctgcattgttttaacttggttcga

SEQ ID NO: 109055 - DNA, 50 bp, homo sapien
cctagtctctgccagacaccacataracaatagataagtaaataaacaac

SEQ ID NO: 109056 - DNA, 50 bp, homo sapien
aatgctttttgtttcattttgataawgtttgaaaattcaaacatgtctaa

SEQ ID NO: 109057 - DNA, 50 bp, homo sapien
taaaatacttccatttctttcaggaycagccacctgccatgttgataccc

SEQ ID NO: 109058 - DNA, 50 bp, homo sapien
aaaacagctactgctagagactgtasaaatattctgtaaaaacagcaaaa

SEQ ID NO: 109059 - DNA, 50 bp, homo sapien
agattcccatccttctgatgccgaasactctccagggttcctgtggaatt

SEQ ID NO: 109060 - DNA, 50 bp, homo sapien
aatcagcatccttcatttgaatatcmcggtttaataccaccaaagcagca

SEQ ID NO: 109061 - DNA, 50 bp, homo sapien
gataattttgatttacagcatcctaygagacatttctacatgcataacag

SEQ ID NO: 109062 - DNA, 50 bp, homo sapien
atataaacctcctgcaaatcaaagasgagaaatttattaaaatagagcta

SEQ ID NO: 109063 - DNA, 50 bp, homo sapien
gtacttttgtcctgtttgatggaaaytgtcacttggaacaggaaggtgaa

SEQ ID NO: 109064 - DNA, 50 bp, homo sapien
agatatataaagcaaacattattgawgggagagatagactccaatataat

SEQ ID NO: 109065 - DNA, 50 bp, homo sapien
tttttacacaatacggttgtagatamaatcaccaaagtttctgccttttt

SEQ ID NO: 109066 - DNA, 50 bp, homo sapien
ctgctactaaaaatttcaatgagaayatgttttgtataaccactttcctg

SEQ ID NO: 109067 - DNA, 50 bp, homo sapien
ggtaccatgcagatatgattttagcmcaacaattataaatatacgagata

SEQ ID NO: 109068 - DNA, 50 bp, homo sapien
cttatttctcctccctcaatatccartaatttcccacctaaaacaatgaa

SEQ ID NO: 109069 - DNA, 50 bp, homo sapien
aaggatggatttgggaaggtcagttragagaagactaaagtaacaggaaa

SEQ ID NO: 109070 - DNA, 50 bp, homo sapien
gatacttaggttgcttccctggcackgctgtttctgtgaacgatcccatt

SEQ ID NO: 109071 - DNA, 50 bp, homo sapien
attttggtctatcaagttagatttamgtcataatttcttagctttcacag

SEQ ID NO: 109072 - DNA, 50 bp, homo sapien
gaacagttctagatttcaatccaatraagtgatttgttctctactctgca

SEQ ID NO: 109073 - DNA, 50 bp, homo sapien
atgcagtagcctctcaggagcagacygatttgtagctgtcgtggtttact

SEQ ID NO: 109074 - DNA, 50 bp, homo sapien
cagccagcagaaagagtcaaaaatayagtactctggaaatctacattttc

SEQ ID NO: 109075 - DNA, 50 bp, homo sapien
aaatgttcaaggttttggtgaattcragagggcaagttctacccaaagtt

SEQ ID NO: 109076 - DNA, 50 bp, homo sapien
aaattccttatgttaacatagctgcratggttacctcttattataaacca

SEQ ID NO: 109077 - DNA, 50 bp, homo sapien
tcagccctgttaaataaaaaagtagrcctcaactacataaatagagtacc

SEQ ID NO: 109078 - DNA, 50 bp, homo sapien
ccactgatcacaaaaatcagacctasagaggaaaataattttatggttgt

SEQ ID NO: 109079 - DNA, 50 bp, homo sapien
ccatctgcacaccccctactcagccratgtggtaagcatttagccacagc

SEQ ID NO: 109080 - DNA, 50 bp, homo sapien
tgtccagggaaatcgtgtaaccagcmactaatatcagtccctgcttaatt

SEQ ID NO: 109081 - DNA, 50 bp, homo sapien
gaggaacagggatgagcaccaacggyatctgctatgtggatattccacac

SEQ ID NO: 109082 - DNA, 50 bp, homo sapien
agaataagcacataaagataagaaasctacatattttgatccgattctag

SEQ ID NO: 109083 - DNA, 50 bp, homo sapien
gtttacaaagcccttcaacgcataaygtctcataaggtaattatggccag

SEQ ID NO: 109084 - DNA, 50 bp, homo sapien
tagtttttacaatagttccttgaaamagattattgttatttactcagata

SEQ ID NO: 109085 - DNA, 50 bp, homo sapien
tagtggagataagatctatatgagtsaataatcagaattaattacaaatg

SEQ ID NO: 109086 - DNA, 50 bp, homo sapien
tagacttatttcaaggaatagagaaygtttattttcagtttttatgttgt

SEQ ID NO: 109087 - DNA, 50 bp, homo sapien
gtgtgacgttatctttgtaatagcamactgagatgagcaaaggtggtgtt

SEQ ID NO: 109088 - DNA, 50 bp, homo sapien
tggctgagacagtactatgtattccrcacatttttttttctctatcacct

SEQ ID NO: 109089 - DNA, 50 bp, homo sapien
catgccagataattttggattgtatsttagacattgtggtggttaaattg

SEQ ID NO: 109090 - DNA, 50 bp, homo sapien
aaataattttggagaatggtggtgamgtgattatattctatttcttttgt

SEQ ID NO: 109091 - DNA, 50 bp, homo sapien
ttgcaatgccaccactcagttctaayacaccattcctaagcctccaacaa

SEQ ID NO: 109092 - DNA, 50 bp, homo sapien
atcaaaggcacgtttgcatttccccragtggtggcgtctcactgagctcc

SEQ ID NO: 109093 - DNA, 50 bp, homo sapien
ataattgaacccagctgggaagtacsaggaccagagaatctctgctgcat

SEQ ID NO: 109094 - DNA, 50 bp, homo sapien
ctcatttcccctggcctgatctttayctacttccagaccgtctttatcct

SEQ ID NO: 109095 - DNA, 50 bp, homo sapien
atagaaaaaaagaggaccctaagaawctggagtcaaaatttcctctctca

SEQ ID NO: 109096 - DNA, 50 bp, homo sapien
agtccaaaagctggaccttttctgawtgataaaaaagtgacacggactta

SEQ ID NO: 109097 - DNA, 50 bp, homo sapien
gaaaccttagcattgtaagtccacastaaattactagcacggagtcacct

SEQ ID NO: 109098 - DNA, 50 bp, homo sapien
acaaaatggtaaaagtcagagctacmctttaaataattattttaaatata

SEQ ID NO: 109099 - DNA, 50 bp, homo sapien
ttttctgtgtgtttgtcaggttccargagaagaccaaaaccacgcagtga

SEQ ID NO: 109100 - DNA, 50 bp, homo sapien
cagtttacttcattcatatacgaaamcttcaatccttacaagtctgctcc

SEQ ID NO: 109101 - DNA, 50 bp, homo sapien
ctcccagtaagtcgaacatgaagcaratgccttactacatggtctataga

SEQ ID NO: 109102 - DNA, 50 bp, homo sapien
gatatttaatatcatagaggagttayggacataggtacacacagaggagt

SEQ ID NO: 109103 - DNA, 50 bp, homo sapien
actggggtcactttcttttacaccayttcttggattgcatgctgcttata

SEQ ID NO: 109104 - DNA, 50 bp, homo sapien
tatatacgcatatgcatgtttctgckaagaactcaagaactcaatgagga

SEQ ID NO: 109105 - DNA, 50 bp, homo sapien
atgaaaaattcgctgatattaaatgyagactctgttgaaactatagtaaa

SEQ ID NO: 109106 - DNA, 50 bp, homo sapien
agacgggagcttctgccctccacagwacttgctcgtgatacttaatatgg

SEQ ID NO: 109107 - DNA, 50 bp, homo sapien
tgctttctaacctgtgaaatgtctayggagaaacctgttgatagtcttat

SEQ ID NO: 109108 - DNA, 50 bp, homo sapien
ttttttttttgagttagggttgatayagtttagatatgtgtcctcaccca

SEQ ID NO: 109109 - DNA, 50 bp, homo sapien
cctttcattgaaagttcttgttcacratttttatcgataaatatttgttt

SEQ ID NO: 109110 - DNA, 50 bp, homo sapien
aaaagggaatcaatggaaagtgtacrgatagagagaaggatgaaactctg

SEQ ID NO: 109111 - DNA, 50 bp, homo sapien
tcttgcaaacgacccctctacatagmactaacacggaattgaggcttgcc

SEQ ID NO: 109112 - DNA, 50 bp, homo sapien
taataaaaacaattgaaattgtgacygataatatggaactggataaagca

SEQ ID NO: 109113 - DNA, 50 bp, homo sapien
ggtgggggctggaaggtgagtagacrcagagaaaatctctgggcccacag

SEQ ID NO: 109114 - DNA, 50 bp, homo sapien
ccatcagagaaatgaggtcatggggyaaactgctatcctgaaaactggag

SEQ ID NO: 109115 - DNA, 50 bp, homo sapien
agcatgctacctccctgtgtagaaamtgctcgcggtccggtgggggtaaa

SEQ ID NO: 109116 - DNA, 50 bp, homo sapien
agcagtgtgcaattattttcaaacaygaggattctccccatatcataaag

SEQ ID NO: 109117 - DNA, 50 bp, homo sapien
tttatctctataatgatctttcttgraatttaggcttgtgattctcactt

SEQ ID NO: 109118 - DNA, 50 bp, homo sapien
ccccactctgtgctacgaggaggccrtgagaagagctgaaacccaatgac

SEQ ID NO: 109119 - DNA, 50 bp, homo sapien
cacacaagctttcacgtttacttgasatttgatctagtgacagcttatca

SEQ ID NO: 109120 - DNA, 50 bp, homo sapien
ctgcactgtgcacttacaaacggtawattatatgttaggtatcttttact

SEQ ID NO: 109121 - DNA, 50 bp, homo sapien
aagggttaaatgttatctttagagasaatatgctcattttataaatttta

SEQ ID NO: 109122 - DNA, 50 bp, homo sapien
agagaaccttcagagtaacaggaccrgaataactttgttgaataactctc

SEQ ID NO: 109123 - DNA, 50 bp, homo sapien
catatgttcacaatggtgatgctaasacgctactaaatacctattcaata

SEQ ID NO: 109124 - DNA, 50 bp, homo sapien
gtatttatcaaagaacagacatcagrattattgggttcagcattctgaga

SEQ ID NO: 109125 - DNA, 50 bp, homo sapien
gcactctggcttctcttgtagaaagratgatgatttgcttgtgtgctttc

SEQ ID NO: 109126 - DNA, 50 bp, homo sapien
tcccatagcgggatggctgtcaaaaraagaggaggagaccacagccctct

SEQ ID NO: 109127 - DNA, 50 bp, homo sapien
acgtttttcatgcaacttcccacaarcttctaggaaaatataaaaaatac

SEQ ID NO: 109128 - DNA, 50 bp, homo sapien
gaaaacatattactgaaaagtataargagagaaacacagcttttgaagac

SEQ ID NO: 109129 - DNA, 50 bp, homo sapien
agaaaaaaaatcaaattattgtaccraattccctaatatcagatgtgtat

SEQ ID NO: 109130 - DNA, 50 bp, homo sapien
cttcaacagatctgtgcattctgagrcccatgaaaccagaatattagacc

SEQ ID NO: 109131 - DNA, 50 bp, homo sapien
aatactgttttcaacaatagtcttaygatttttttgcaatttcaatgaaa

SEQ ID NO: 109132 - DNA, 50 bp, homo sapien
tgtcttctacatattcacacgtaaarctgtctcatcccagacatgataaa

SEQ ID NO: 109133 - DNA, 50 bp, homo sapien
tttctctttgtgtgaaaccgtcatakcccagaaaattagaccagttacaa

SEQ ID NO: 109134 - DNA, 50 bp, homo sapien
tgggcttcatgctttttaatctcggyatagacaagagggaagattcagct

SEQ ID NO: 109135 - DNA, 50 bp, homo sapien
ctgagaaacaaaatggatagaatgcragttaaaacaagatctggaatagt

SEQ ID NO: 109136 - DNA, 50 bp, homo sapien
ccaagaatgattagacggcgcctctraaataacaaggccgttgcatgcaa

SEQ ID NO: 109137 - DNA, 50 bp, homo sapien
catgcagtgcactattattactttaygccatttcagtcacaagagcaggt

SEQ ID NO: 109138 - DNA, 50 bp, homo sapien
taccatatgttctgccttctacttascacaccgtatattggctctgctga

SEQ ID NO: 109139 - DNA, 50 bp, homo sapien
tgttatgacagaaaagagacctgaasagttgatgaatagagacatttaca

SEQ ID NO: 109140 - DNA, 50 bp, homo sapien
tacttggaactcaggatgtggacaamcgtatctagtcatctttcctttct

SEQ ID NO: 109141 - DNA, 50 bp, homo sapien
tggagattaaaagtatcaagccatgraccttgctaaaccaagaaatgtta

SEQ ID NO: 109142 - DNA, 50 bp, homo sapien
aacattctccatgatttcttctctayatctgttatcctctctctaccatg

SEQ ID NO: 109143 - DNA, 50 bp, homo sapien
cctcctaagaaattacactctgataracactactctctaataaaagttac

SEQ ID NO: 109144 - DNA, 50 bp, homo sapien
gagagcaatattttcattttcagagyatggctttttaaatgtgtatatta

SEQ ID NO: 109145 - DNA, 50 bp, homo sapien
atataccatgtctattaaatcaccawaaccaaatgaaattcctctcaggg

SEQ ID NO: 109146 - DNA, 50 bp, homo sapien
tcactacaagcctattagatacaaaygttattcgactttcttacagataa

SEQ ID NO: 109147 - DNA, 50 bp, homo sapien
gattccacaaagcaaatctatgtcasaatctatcctacgtgtgctttcct

SEQ ID NO: 109148 - DNA, 50 bp, homo sapien
gtttaacctgtgcaggagacatataygagtttatgaaccaacattcccat

SEQ ID NO: 109149 - DNA, 50 bp, homo sapien
agcctagttgtaagcattgagcacastcagtcaccgtagagagatacatc

SEQ ID NO: 109150 - DNA, 50 bp, homo sapien
tttttaattggtttgtcatttaaagwataaactacataagatatgagtac

SEQ ID NO: 109151 - DNA, 50 bp, homo sapien
accatcaactggggataaaacacaartacacagactagaaattccttgga

SEQ ID NO: 109152 - DNA, 50 bp, homo sapien
acaaacaccagtgcctttaatcttastaacgttgtggaagtgttatgatc

SEQ ID NO: 109153 - DNA, 50 bp, homo sapien
tttctgcttatcttcatctttaaaakgagatcataacacttccacaacgt

SEQ ID NO: 109154 - DNA, 50 bp, homo sapien
caaattaaatctctgtgcacactcayagggaagcagggaaagcagtggta

SEQ ID NO: 109155 - DNA, 50 bp, homo sapien
agagcactagaagcagcagtttatakgtagagaagctttttaaaaatcct

SEQ ID NO: 109156 - DNA, 50 bp, homo sapien
cagaattaattctcaattgtcagtamaaaatgaacaaaattataacatat

SEQ ID NO: 109157 - DNA, 50 bp, homo sapien
gtaatgccaaactcgattttctaaaytcgttgtccacagtgaccagctga

SEQ ID NO: 109158 - DNA, 50 bp, homo sapien
taacacaaaataatttatggaaaaamagagcttctaatcgatattctcag

SEQ ID NO: 109159 - DNA, 50 bp, homo sapien
ttcagaccaacatccacacttaaaakaaatggacatgtatacattaagtt

SEQ ID NO: 109160 - DNA, 50 bp, homo sapien
ataatctgaatgaaaggatgggcaaygtgactcttcactctgtcataagt

SEQ ID NO: 109161 - DNA, 50 bp, homo sapien
tgcagacttgtgcaatggtaataacracggctcatgtttccccagccctt

SEQ ID NO: 109162 - DNA, 50 bp, homo sapien
tacgacggcaatgttgcatcaaagasagaatgccagtaaagagacagaaa

SEQ ID NO: 109163 - DNA, 50 bp, homo sapien
taaatttcaacactgctgccaatcartaacagagataatatgccaattat

SEQ ID NO: 109164 - DNA, 50 bp, homo sapien
ccactcctgccaataacataggtaaygagtgaatttatttccccaacaag

SEQ ID NO: 109165 - DNA, 50 bp, homo sapien
cattggctcaaagagtcatcaagaartaatgtcctttcaacagtacacta

SEQ ID NO: 109166 - DNA, 50 bp, homo sapien
atatgccacctagcgcatggaattcygaaatgtttaattccttctatgat

SEQ ID NO: 109167 - DNA, 50 bp, homo sapien
tatgaggaaaaaagaggtaattggargaaaacaaatataacaactctttc

SEQ ID NO: 109168 - DNA, 50 bp, homo sapien
ctaggacctttaagaattatactaartctactctacctgtgctctataaa

SEQ ID NO: 109169 - DNA, 50 bp, homo sapien
tcaaatctcacactaaagccatctamatttgggagaggatctgggtgtga

SEQ ID NO: 109170 - DNA, 50 bp, homo sapien
caaatatttattgtgagcaaaactaycaaattcaaaataaaaatatgata

SEQ ID NO: 109171 - DNA, 50 bp, homo sapien
aactgtccactagaactcaatacggyggcaggttctgcatgtagctttaa

SEQ ID NO: 109172 - DNA, 50 bp, homo sapien
taattgtacttatttcaataactaasactataattgaattgtctgtaaca

SEQ ID NO: 109173 - DNA, 50 bp, homo sapien
gggacacaggaactgagaggactcayggtaaacatcgggccccaggggta

SEQ ID NO: 109174 - DNA, 50 bp, homo sapien
gccaggagccctgcaagatattggcygataaaacagagccacctcaccca

SEQ ID NO: 109175 - DNA, 50 bp, homo sapien
tgtttgctgagcgcttgcattgtgcyaacttctgtagggtgcaagtatat

SEQ ID NO: 109176 - DNA, 50 bp, homo sapien
atgcagctgcttctgtggctcacacscagacacggaggggtcaagcagca

SEQ ID NO: 109177 - DNA, 50 bp, homo sapien
cctgacacagggttttgccagcagastcatttttcagcccagccctaaaa

SEQ ID NO: 109178 - DNA, 50 bp, homo sapien
tgtcttctcttgctagaatctggaayatctttctattctgtcagaacctt

SEQ ID NO: 109179 - DNA, 50 bp, homo sapien
tcagtgaagtaaattgtgagccaccraataaagcccatggcctcaggaga

SEQ ID NO: 109180 - DNA, 50 bp, homo sapien
gaggaattactatctatggcagttayggatgtatgaaatatatttcttaa

SEQ ID NO: 109181 - DNA, 50 bp, homo sapien
ggatgaagcagctccactcatttcaygctcctgtagaaaaccaaccagag

SEQ ID NO: 109182 - DNA, 50 bp, homo sapien
atcacattattttgtacctaacttakgcgaatatatatgtaaaacttcaa

SEQ ID NO: 109183 - DNA, 50 bp, homo sapien
attcaaatcccatatgctaaaaaagwaggttaatatctacatcattgtac

SEQ ID NO: 109184 - DNA, 50 bp, homo sapien
tactgattatgtaatgtgtgattaasaagtataatgtgtcactttcaaca

SEQ ID NO: 109185 - DNA, 50 bp, homo sapien
ccatgttgaccagatgcaggaaagamcacagagtcagcaaactacagcct

SEQ ID NO: 109186 - DNA, 50 bp, homo sapien
caagcagcatatttgtgtatacccamcagctgaagtatagtcttgtcata

SEQ ID NO: 109187 - DNA, 50 bp, homo sapien
tataagcccgggaggaaatatttgcsgaacagtctctgtgtatttaggat

SEQ ID NO: 109188 - DNA, 50 bp, homo sapien
aaaaaaaaaaattgtgagtttaacastgtcaacatctactaagcacttat

SEQ ID NO: 109189 - DNA, 50 bp, homo sapien
ttattaaaaatttaattatattaacygacaaattatattaaaacacagat

SEQ ID NO: 109190 - DNA, 50 bp, homo sapien
ctttctagacttaattctgtttcatyaatctactgtttatccatgtgcta

SEQ ID NO: 109191 - DNA, 50 bp, homo sapien
aaggtgctagacatttctctcacaaygcaagatcttaatccacacccaca

SEQ ID NO: 109192 - DNA, 50 bp, homo sapien
tgatttatttattgtaactttatcaygtcttaatttccatagggtttgcc

SEQ ID NO: 109193 - DNA, 50 bp, homo sapien
cccacgtggcccaggaaagccaagaygaaatatcaaggttgaaactgatc

SEQ ID NO: 109194 - DNA, 50 bp, homo sapien
tttggtgttattgtagatttactacrccaaaattttacattctattactc

SEQ ID NO: 109195 - DNA, 50 bp, homo sapien
gaaggctgatgtgctgatacctgacraaagagattctaaagcaaaggcat

SEQ ID NO: 109196 - DNA, 50 bp, homo sapien
attcttttctgaaatagtgcagaatyaacatcatagaattttatgttgtc

SEQ ID NO: 109197 - DNA, 50 bp, homo sapien
ctgagtgctccagcaccaatcagatyatgtatgtgttactcagaagagat

SEQ ID NO: 109198 - DNA, 50 bp, homo sapien
ggttgttggtgggtggtacgtagacsaaaatagtcctgtgaccagagaaa

SEQ ID NO: 109199 - DNA, 50 bp, homo sapien
cagcacattatctcaactttaatgcratttttcgaattaagagttaacaa

SEQ ID NO: 109200 - DNA, 50 bp, homo sapien
ttgcccaaggtcatttcagttcatartatctacaaaagtcccatttgtcc

SEQ ID NO: 109201 - DNA, 50 bp, homo sapien
cacacttgaaagtttcccagtaatasaataaagtagtggtttttaaatgt

SEQ ID NO: 109202 - DNA, 50 bp, homo sapien
tcaagaaaaccagactgtcaataccmgaaccagatgaacaaacttctttt

SEQ ID NO: 109203 - DNA, 50 bp, homo sapien
attctgaaatgcagttcgttattaaytatctgatcttgttggcgggagac

SEQ ID NO: 109204 - DNA, 50 bp, homo sapien
gagagaggttaaatatctgtaaaaaygtgaaactgtacccagtggccttg

SEQ ID NO: 109205 - DNA, 50 bp, homo sapien
tagtgagtttggggtttttgcaacaytgaggtcgataatgggacctggag

SEQ ID NO: 109206 - DNA, 50 bp, homo sapien
gctttgagagaagaactcggttccartcattcacggccggagaaggtgcc

SEQ ID NO: 109207 - DNA, 50 bp, homo sapien
aaagaagccctcactaacaggtgtaygtgaactaccttcgcaggaccaga

SEQ ID NO: 109208 - DNA, 50 bp, homo sapien
cctccctttggaatctgcccaaagaygcaagcaggattcccaggaggcac

SEQ ID NO: 109209 - DNA, 50 bp, homo sapien
ttgttcttttgttgaagtcttagagwattttaaatatgtttcattttaaa

SEQ ID NO: 109210 - DNA, 50 bp, homo sapien
cctgggagctacaggagaaatatgcrccctgagttcctgggagttacagg

SEQ ID NO: 109211 - DNA, 50 bp, homo sapien
atatatgataaacactgttgtccatraaattccctcagagtagaatgcta

SEQ ID NO: 109212 - DNA, 50 bp, homo sapien
tcattatgtttgaaaggaacaaataycgattgagcatatatagcccgtcc

SEQ ID NO: 109213 - DNA, 50 bp, homo sapien
atcgattgagcatatatagcccgtcyaacatttcgctaataatgtgacgt

SEQ ID NO: 109214 - DNA, 50 bp, homo sapien
aaggtctttctgaggttgaaaatatmataggagaccctcatgtatagctg

SEQ ID NO: 109215 - DNA, 50 bp, homo sapien
acccattctcaaaatacacttcacartgctaaaactgaaaaggcaagagg

SEQ ID NO: 109216 - DNA, 50 bp, homo sapien
taactgatgtagtgaaatgttgagaraatcagatattaatggttggctga

SEQ ID NO: 109217 - DNA, 50 bp, homo sapien
ctatgttaacataaggaatttcaaastctaagtcagagctgcccaagtac

SEQ ID NO: 109218 - DNA, 50 bp, homo sapien
aaaggtcatgacatgagttgtatatyacaggcattatgattattctatgg

SEQ ID NO: 109219 - DNA, 50 bp, homo sapien
aatgcaaatataccagcctttggcaygtgaagataattcttctaatcctt

SEQ ID NO: 109220 - DNA, 50 bp, homo sapien
actatttttagagtactatttgcttraaaaggaatgcaaatataccagcc

SEQ ID NO: 109221 - DNA, 50 bp, homo sapien
cgccagggccttctaaatactttccmagacgctgtgtgctgtgagcatca

SEQ ID NO: 109222 - DNA, 50 bp, homo sapien
ggaaggatattagagaattcttagcrgaggaaattcaccagaccagagaa

SEQ ID NO: 109223 - DNA, 50 bp, homo sapien
tcaggtaatgtgacacaagctactawactttgattacaaagttagttttg

SEQ ID NO: 109224 - DNA, 50 bp, homo sapien
taatcctagtgcaagagtggaaacayggagacattactaaacaattttag

SEQ ID NO: 109225 - DNA, 50 bp, homo sapien
aaaggtttatacacatcaggacatgsagagtaaatctgtttatgacatga

SEQ ID NO: 109226 - DNA, 50 bp, homo sapien
tatacctacttccaagtaaaactcasgtaactacttcaagcaagtttttt

SEQ ID NO: 109227 - DNA, 50 bp, homo sapien
aaatgtattccaagagtaaagtagastcacaatgtaatttgatgtaatat

SEQ ID NO: 109228 - DNA, 50 bp, homo sapien
ctctagattgtgtgctttcttaaaamgtatcattaaagtaacttctccag

SEQ ID NO: 109229 - DNA, 50 bp, homo sapien
ttgtactatagaactattacaagcartgatacttttatagggaaaatacc

SEQ ID NO: 109230 - DNA, 50 bp, homo sapien
aagaaacttacctgctgtactaggayataagtcaaataagagaaagcatg

SEQ ID NO: 109231 - DNA, 50 bp, homo sapien
acaccagtctttacatatttaaaagsataatttgagtataagaagttaca

SEQ ID NO: 109232 - DNA, 50 bp, homo sapien
agttatgaatggtttgtatcagaagygttttgtgtaaatagtgtcagtaa

SEQ ID NO: 109233 - DNA, 50 bp, homo sapien
gtgctggaagatatgttgactttcamatcgtcaataagtgttcgtggggc

SEQ ID NO: 109234 - DNA, 50 bp, homo sapien
cgcctttttccttgccattttcaaayatctcttagcaactaatgaatttg

SEQ ID NO: 109235 - DNA, 50 bp, homo sapien
tcacagttggaaatagatgtcaacgycaattgtttctgatttgggacaag

SEQ ID NO: 109236 - DNA, 50 bp, homo sapien
gattgcttagagagctagtgtggaaygaatatcagtcattcattgatcat

SEQ ID NO: 109237 - DNA, 50 bp, homo sapien
aggtatttgtttgtaagttgcgtaarcacaaactggaagattttcaaaat

SEQ ID NO: 109238 - DNA, 50 bp, homo sapien
aaaaatactcaaacttaaccagtaaygattgagcttacctaggggtcact

SEQ ID NO: 109239 - DNA, 50 bp, homo sapien
caaacccagtaacattctgagaaatkattgtgcattctagttacctagtg

SEQ ID NO: 109240 - DNA, 50 bp, homo sapien
tagggaaggagagaattaggtataamcatgatgagagcccaatctcaccc

SEQ ID NO: 109241 - DNA, 50 bp, homo sapien
agacaatggtctaagtacaagcaaasgatttacaattcttaaaagttgtt

SEQ ID NO: 109242 - DNA, 50 bp, homo sapien
gttattaatggcagtattttggagayattgacaagaggtaagaagggtta

SEQ ID NO: 109243 - DNA, 50 bp, homo sapien
cttttttgtctgactggcttattccraaaatcctgtctccaggttcagaa

SEQ ID NO: 109244 - DNA, 50 bp, homo sapien
taaggaaactcaccttgttgtgagaycagacaaagatttagagcagtgtc

SEQ ID NO: 109245 - DNA, 50 bp, homo sapien
tttccacagcagtactgagagatctsggttgtgaaggttgagtacggata

SEQ ID NO: 109246 - DNA, 50 bp, homo sapien
tgcttgttctttatccattcacatayccgcatttgaataatttaaatgag

SEQ ID NO: 109247 - DNA, 50 bp, homo sapien
gatctcggttgtgaaggttgagtacsgatactgggggtgaccaacacgcc

SEQ ID NO: 109248 - DNA, 50 bp, homo sapien
tttgacatgatttctgtttggtttayacaaagtaattcagaaatttacaa

SEQ ID NO: 109249 - DNA, 50 bp, homo sapien
atgaaatgtgaggagttgggaacacrtgatgagctctgaggagagatgtc

SEQ ID NO: 109250 - DNA, 50 bp, homo sapien
aggtgttgggagccttgccacgttcrgaaacggcagttgtatgacagggt

SEQ ID NO: 109251 - DNA, 50 bp, homo sapien
attgtctcactccaggattaacttcrccctggaggatcagaaaaaataga

SEQ ID NO: 109252 - DNA, 50 bp, homo sapien
tttttcaaaaatggttcatataaagmctagcgctgaaaaatgttttagaa

SEQ ID NO: 109253 - DNA, 50 bp, homo sapien
ccttgtttccaaggatcttctgaacrcctttaatggcctcatttagattt

SEQ ID NO: 109254 - DNA, 50 bp, homo sapien
attacttactattgaatggtccaacyactaacatcaacctctagttaaga

SEQ ID NO: 109255 - DNA, 50 bp, homo sapien
caggtatatttcgtgctactgtactwaaaaactgatctctaagaagttca

SEQ ID NO: 109256 - DNA, 50 bp, homo sapien
acacaccaaactgggatgtacctagkaaaggtgtacgcagtgtaggagta

SEQ ID NO: 109257 - DNA, 50 bp, homo sapien
cagagtcggtccactgaggttacacratgtgcacaactgaggcctgaggc

SEQ ID NO: 109258 - DNA, 50 bp, homo sapien
tggcgacgatatccccagcctcgtcygaaactaaacacgcagagatattg

SEQ ID NO: 109259 - DNA, 50 bp, homo sapien
atgcaggacatggtccctgaacagamtcaagctctaccagggacctatgg

SEQ ID NO: 109260 - DNA, 50 bp, homo sapien
gttatgtgttggatctggccaaaagyatatctcacaccaaatatatgatg

SEQ ID NO: 109261 - DNA, 50 bp, homo sapien
gtttactaaatgacaccaatatatckgaactatttgtggaaacttgcact

SEQ ID NO: 109262 - DNA, 50 bp, homo sapien
tcaagacagaagtatagatgtaaagrtgtatgtgtatatacacacctttg

SEQ ID NO: 109263 - DNA, 50 bp, homo sapien
acatcactttttctgtaaatatcaamttcactctccaaattgcttggtga

SEQ ID NO: 109264 - DNA, 50 bp, homo sapien
agtgtgctgggcaaagccatttaacygtaagatgctctataaaattctga

SEQ ID NO: 109265 - DNA, 50 bp, homo sapien
cgtcgtctctgatacctatagtcctracaagaatatgaatcataccttgt

SEQ ID NO: 109266 - DNA, 50 bp, homo sapien
aataaagcaaactgggtgttattgawattagaatgagaatctttgttcaa

SEQ ID NO: 109267 - DNA, 50 bp, homo sapien
gtcctaataaatacaaattttgaacraagattctcattctaatatcaata

SEQ ID NO: 109268 - DNA, 50 bp, homo sapien
cctattaacatttatcagcttcacaraacatgctaaaaagatttgtcatt

SEQ ID NO: 109269 - DNA, 50 bp, homo sapien
gggaggtggccttgtagattgtgagrcaggttcaggaacaaggagaggct

SEQ ID NO: 109270 - DNA, 50 bp, homo sapien
cattttgtgtacagcaaggattggtyaaattccttcagtattcccaagag

SEQ ID NO: 109271 - DNA, 50 bp, homo sapien
gcataataaggaacattatgcatgtkttacaaagaatgagccagaatttt

SEQ ID NO: 109272 - DNA, 50 bp, homo sapien
acccacctggcatcttccacaggggyaaacagtagcccacagagatgaag

SEQ ID NO: 109273 - DNA, 50 bp, homo sapien
cataaatgtgctataaatttgcctayaaagtggaaaaaagaaataaaaag

SEQ ID NO: 109274 - DNA, 50 bp, homo sapien
tacacagacgactccctaataaatastagaggatcagcaaattcattatg

SEQ ID NO: 109275 - DNA, 50 bp, homo sapien
tctacgaagctaactcctacaatagmcatgagaggcaacagagggaaaat

SEQ ID NO: 109276 - DNA, 50 bp, homo sapien
aatgcaatgactattcctcagtgagyatctaaattacaccagacacagtc

SEQ ID NO: 109277 - DNA, 50 bp, homo sapien
aaaactttaaaacttgctataggtcrcaagttagggtctgaatttacaaa

SEQ ID NO: 109278 - DNA, 50 bp, homo sapien
actactgcaatcaggacaggaagtcygactgatccaacaacaccctttct

SEQ ID NO: 109279 - DNA, 50 bp, homo sapien
tttgtaaagctgtatgaaattccaastagcactgtctttctatctctgca

SEQ ID NO: 109280 - DNA, 50 bp, homo sapien
caacttcaacccaagattagggcgcyctggagctttcggcacttctggtt

SEQ ID NO: 109281 - DNA, 50 bp, homo sapien
aaaaccttcagatatattcaaagtayctaatgggtaacaaaatgatttgt

SEQ ID NO: 109282 - DNA, 50 bp, homo sapien
cacaattaccgagttaaaagaatgcrgcagatgtcgatattgtgggaaat

SEQ ID NO: 109283 - DNA, 50 bp, homo sapien
ttgtgggaaatcattcacacctgaamaatgaacccctctaatgtttttct

SEQ ID NO: 109284 - DNA, 50 bp, homo sapien
tttacttaaatcgctttataaaacamactccatctagtcatttaccccct

SEQ ID NO: 109285 - DNA, 50 bp, homo sapien
cacttacaacaacgctaaaataatcrattcctttttcattcacctgcaga

SEQ ID NO: 109286 - DNA, 50 bp, homo sapien
aatacaggggatcactacacaggcartcaactacaatcttctagatagtt

SEQ ID NO: 109287 - DNA, 50 bp, homo sapien
cccatgtgcctagtccatgtgacagyattgctttaaaaatcaataaaaat

SEQ ID NO: 109288 - DNA, 50 bp, homo sapien
aagacctactaggcattttaaagaayccactcatgtgatcgaacgataaa

SEQ ID NO: 109289 - DNA, 50 bp, homo sapien
aatagatcacttaaattggtttgctsacttttagctttatggagggtgga

SEQ ID NO: 109290 - DNA, 50 bp, homo sapien
ctagtgggtattgtgacttctcttakggagcacacttgccttcacctgcc

SEQ ID NO: 109291 - DNA, 50 bp, homo sapien
gtcaatacaaaacaactaagtacacrgagaatggctgttcattaggagca

SEQ ID NO: 109292 - DNA, 50 bp, homo sapien
tctgacaataaagcgctgaaattaaytctccaaagccacagaaaggtaat

SEQ ID NO: 109293 - DNA, 50 bp, homo sapien
taaacatgtttaagaactcactatcygaaagtttgcgtttcaattcattg

SEQ ID NO: 109294 - DNA, 50 bp, homo sapien
accaggcacacaaagattagagaaayggcttttatgcagtcttttactcc

SEQ ID NO: 109295 - DNA, 50 bp, homo sapien
cttgctgctgctctgatgtggccacygtgattaacgcaatcagcccagca

SEQ ID NO: 109296 - DNA, 50 bp, homo sapien
cttactttcttctgttccacaagctmagaggaagcagaatttgtagtgaa

SEQ ID NO: 109297 - DNA, 50 bp, homo sapien
gtctgtacatatcagcctggtcccamagaacctttgacatttagcctgtg

SEQ ID NO: 109298 - DNA, 50 bp, homo sapien
acgacgccctggcatctcactggaargctaactaaagagagaaaaataag

SEQ ID NO: 109299 - DNA, 50 bp, homo sapien
tttcttttataaatttggactttaartaagagtactttataaaaatgtct

SEQ ID NO: 109300 - DNA, 50 bp, homo sapien
atcctcatcctgatgtttatgactgmaaaatgtgtatctcctgccaagac

SEQ ID NO: 109301 - DNA, 50 bp, homo sapien
tatgccaaatatactactacgactaygaccgttactactgctaataataa

SEQ ID NO: 109302 - DNA, 50 bp, homo sapien
aagggagtcaaattctcttttattaycagtgaatagtgtaagggagggac

SEQ ID NO: 109303 - DNA, 50 bp, homo sapien
ctcattttgattggattcatgcaaasataatgcttacgtgttccataaac

SEQ ID NO: 109304 - DNA, 50 bp, homo sapien
cccattgctccccatcctgtatattwaaaagccagatctttaacgattgc

SEQ ID NO: 109305 - DNA, 50 bp, homo sapien
agggctgaagaacaagtagggtgtcsagataagtaatttttctgtgcaca

SEQ ID NO: 109306 - DNA, 50 bp, homo sapien
aagagaaagaaagacgattggataaktgaaaacaatgactttggaggttc

SEQ ID NO: 109307 - DNA, 50 bp, homo sapien
agtgttatggctgtataagcttgaarctgacaatgatggtttatggaaca

SEQ ID NO: 109308 - DNA, 50 bp, homo sapien
ataagccagcagcctagggaactatktaaattgattgtgaaggagaactt

SEQ ID NO: 109309 - DNA, 50 bp, homo sapien
atgcagatttcaccagttcaatgaamctatcactcactcatcgaagaatt

SEQ ID NO: 109310 - DNA, 50 bp, homo sapien
cgacaatgttaagtgaaaattataayctcagagaccaggagatgttagaa

SEQ ID NO: 109311 - DNA, 50 bp, homo sapien
tttattctacggatatactaacatgygtcaaagaatacaatctcgagtct

SEQ ID NO: 109312 - DNA, 50 bp, homo sapien
aaaaacaagataaaatgtagcataasaaaatgtagagttttgtactttat

SEQ ID NO: 109313 - DNA, 50 bp, homo sapien
aaggaatatagtagcatttaaaacakgattacctgatcttgggtccagga

SEQ ID NO: 109314 - DNA, 50 bp, homo sapien
ctaggactttgatttggctcacggayagtaagtcaggtccatttgttgca

SEQ ID NO: 109315 - DNA, 50 bp, homo sapien
aggcttctttcctttcttgcggagaygtatttgctaggttgggcacaaag

SEQ ID NO: 109316 - DNA, 50 bp, homo sapien
agtcacactgtgacatgtgatgaaaracatgggcgccatagtaagtcagc

SEQ ID NO: 109317 - DNA, 50 bp, homo sapien
gcttctgacaagtgtctaaaaaatgyatgtcctttagtcaaagaaagcag

SEQ ID NO: 109318 - DNA, 50 bp, homo sapien
tgtgggaatatttctggctgaactayggagtgcttgattctgtaagcctc

SEQ ID NO: 109319 - DNA, 50 bp, homo sapien
aaaataggtgggtaaagatcaaccaygttcacctttaacttgattttgac

SEQ ID NO: 109320 - DNA, 50 bp, homo sapien
taaatttaacatatttctcttatggwattgaagggtttctgtcatggaaa

SEQ ID NO: 109321 - DNA, 50 bp, homo sapien
caccagctttatcaatccacacttcsatattgcaggggctggcagagtga

SEQ ID NO: 109322 - DNA, 50 bp, homo sapien
caacagcagcagagacagacagagakttaatccagggtaaggagaacccg

SEQ ID NO: 109323 - DNA, 50 bp, homo sapien
aagtcattgatggaaatataatgctkaagattccagaataagggaaataa

SEQ ID NO: 109324 - DNA, 50 bp, homo sapien
taaatgaaatgagaggaaaagcagastactgcaagaaggggagaaactta

SEQ ID NO: 109325 - DNA, 50 bp, homo sapien
cctcctttaagtataggctcccgatrataggtctaagttgagacagttaa

SEQ ID NO: 109326 - DNA, 50 bp, homo sapien
ccattttcatgtcttaacttcttcaraaattggacagacgtctatgcttt

SEQ ID NO: 109327 - DNA, 50 bp, homo sapien
cattccatgtgaactttgagtaacawctgcgcataaaggaccagatgaaa

SEQ ID NO: 109328 - DNA, 50 bp, homo sapien
gagaaaaggaatgaattgataagaarttaaggatgtatggctgcttatga

SEQ ID NO: 109329 - DNA, 50 bp, homo sapien
caaccaggatttctccagcatttcamatatagcctgtgtagcatgactca

SEQ ID NO: 109330 - DNA, 50 bp, homo sapien
ctcgctaggatgcactatgggttctmacatttagatgctcacaatacata

SEQ ID NO: 109331 - DNA, 50 bp, homo sapien
ttcatcagtcccagattaaccctgayactatacaaattgcaataacacaa

SEQ ID NO: 109332 - DNA, 50 bp, homo sapien
atgaggtggagttttgtctgaggtcmatattaggtttcctatgagatgaa

SEQ ID NO: 109333 - DNA, 50 bp, homo sapien
aaggaattttaggaaaagctgagaasagtagagttgaataactataatat

SEQ ID NO: 109334 - DNA, 50 bp, homo sapien
ggcatagatgaatcttgttaagggcycaggaatatagaagtgaaagaatt

SEQ ID NO: 109335 - DNA, 50 bp, homo sapien
ctctgggcctcgattttcttatctcsaaactgaatagagagacaaacaaa

SEQ ID NO: 109336 - DNA, 50 bp, homo sapien
tataaaattcgctagggttaagatayggagagacagattgaccagttctt

SEQ ID NO: 109337 - DNA, 50 bp, homo sapien
gaatggatgttgccagatagaaggakgcagtagaattcaggctgatgtgc

SEQ ID NO: 109338 - DNA, 50 bp, homo sapien
tggtcagaccacctgtgggacaagcygatgtatttattattgtccagaga

SEQ ID NO: 109339 - DNA, 50 bp, homo sapien
tgcagcagtatgtgaaactcacaccrccaatgaggcagttcccaacacga

SEQ ID NO: 109340 - DNA, 50 bp, homo sapien
catgacattctcttggacagcagaaygttaatcgacacgcgtgcagcagt

SEQ ID NO: 109341 - DNA, 50 bp, homo sapien
ttctggggcatatgttgtgtgtcagmagttcgtcccactagtattcaatt

SEQ ID NO: 109342 - DNA, 50 bp, homo sapien
cacccaaaaaatgcatgagaaatggyctctccgtgagctagttatcttct

SEQ ID NO: 109343 - DNA, 50 bp, homo sapien
gaagtctctaaaaacaatttagatayaagagttagcaggtagaggaaaag

SEQ ID NO: 109344 - DNA, 50 bp, homo sapien
gcatttgctaagtcacgtggtcaaayccagagaagaggggattatctagg

SEQ ID NO: 109345 - DNA, 50 bp, homo sapien
gccctacaaactctgggggtgaagaygctccttagtagagagtaattaga

SEQ ID NO: 109346 - DNA, 50 bp, homo sapien
cttgacacagacacatatcaaatttyaaagaggtgtaaacaaagacatct

SEQ ID NO: 109347 - DNA, 50 bp, homo sapien
aagactgaggtctacacaattcagaytatgaatgatacttccaagaaaat

SEQ ID NO: 109348 - DNA, 50 bp, homo sapien
gttgtaactggttgttctatagcagsaggcgtcaggttcaattaatagag

SEQ ID NO: 109349 - DNA, 50 bp, homo sapien
agaaagaaagaaactagtaaaataasagcaaaataggaaaatttcaaaag

SEQ ID NO: 109350 - DNA, 50 bp, homo sapien
cattttaattcttctcttagatccaraaaatggaaaggtgtttcagataa

SEQ ID NO: 109351 - DNA, 50 bp, homo sapien
cttgtggttgttattttaccaaagasagctaaaccatgctgagaagcaga

SEQ ID NO: 109352 - DNA, 50 bp, homo sapien
acaatgtgctcgaaatcctgtgataygaatattaagcaagttttaatggt

SEQ ID NO: 109353 - DNA, 50 bp, homo sapien
agggctgccaaggaggtgttcataaktaggatttggggcagatgggactc

SEQ ID NO: 109354 - DNA, 50 bp, homo sapien
aaaggcactggtgtttgtaaaattaygagctaacaattatttgtcaatat

SEQ ID NO: 109355 - DNA, 50 bp, homo sapien
ttggatcctattaaaagctgagagtkaatgaataaacagataaaacagag

SEQ ID NO: 109356 - DNA, 50 bp, homo sapien
tcccctgtaggaggagagagaaaaaygtgttagggagatgtgcactaaaa

SEQ ID NO: 109357 - DNA, 50 bp, homo sapien
tgctgtttccttgggcaggaatggcrcaataaagttgctgcagtgctgat

SEQ ID NO: 109358 - DNA, 50 bp, homo sapien
aagtgacattgatctctgtagatttwgaattaaatgatatgatgaagtat

SEQ ID NO: 109359 - DNA, 50 bp, homo sapien
tacgacatgatagttcatttataaastgctttcttgtctgttttcttttg

SEQ ID NO: 109360 - DNA, 50 bp, homo sapien
tttccactcaaacagaggatttaagmctgaccacttccttccagtctgag

SEQ ID NO: 109361 - DNA, 50 bp, homo sapien
tagcatgtctactggacgtgagccasaggaaggaagtgataaaacaccat

SEQ ID NO: 109362 - DNA, 50 bp, homo sapien
ttcctgaaactatccattgcatctgrcaactcatgaaagattaccaaaat

SEQ ID NO: 109363 - DNA, 50 bp, homo sapien
tgctctattcctgaagccctgcgaaygaaaactggatgacttgacacaag

SEQ ID NO: 109364 - DNA, 50 bp, homo sapien
aacaaagaaaacaagagtcttaggayattgtgagggtctccattctcctt

SEQ ID NO: 109365 - DNA, 50 bp, homo sapien
gtgttccctttaggtagggaagacamgaattctgagagccataggaaaga

SEQ ID NO: 109366 - DNA, 50 bp, homo sapien
catacagaatggtacacataggtgamgtccaggaaatttacatgttgatt

SEQ ID NO: 109367 - DNA, 50 bp, homo sapien
tgccttactcatattctgaccttgartagttctcactttactgttgaacc

SEQ ID NO: 109368 - DNA, 50 bp, homo sapien
ttactttttattttacttaagaaaasttagtgacttgtccagtggtattt

SEQ ID NO: 109369 - DNA, 50 bp, homo sapien
gttgtcttacagatacagttgtatgmaatttgaaaatggcttggggtagc

SEQ ID NO: 109370 - DNA, 50 bp, homo sapien
tccaatgccattctcaaatttcatamaactgtgtctgtaggacaacatgt

SEQ ID NO: 109371 - DNA, 50 bp, homo sapien
aggtcacacccacttagtgacctacraacattaatcaaggaattgaaggc

SEQ ID NO: 109372 - DNA, 50 bp, homo sapien
tacagacatgtcttggctttcttgaygagcttttctggatcccattcaac

SEQ ID NO: 109373 - DNA, 50 bp, homo sapien
cttgggccaccagtaggacaagagtyaaatgggttcaatcaagtcttaag

SEQ ID NO: 109374 - DNA, 50 bp, homo sapien
aggaaaatcaattagaactatttctsaatggttgctattcctattaccca

SEQ ID NO: 109375 - DNA, 50 bp, homo sapien
ttcccactagactgcaagctccttasaggcaacctcagtgtgggagtcat

SEQ ID NO: 109376 - DNA, 50 bp, homo sapien
taccctgcggtccccaaaacgcacastcgcgtccgcacacggggcctccg

SEQ ID NO: 109377 - DNA, 50 bp, homo sapien
tgaaacaactaaattcaaaaagaagyagtagatgattaagtattgttgct

SEQ ID NO: 109378 - DNA, 50 bp, homo sapien
attgaaactggaccccttcctttcaycgcatacgaaaatcaatgcaagat

SEQ ID NO: 109379 - DNA, 50 bp, homo sapien
agtgacatttctccttgcagcctggyagtaagaaccagttagcagacaga

SEQ ID NO: 109380 - DNA, 50 bp, homo sapien
taaagacgtgctgtgctataaaggamattttgctgattctagactattaa

SEQ ID NO: 109381 - DNA, 50 bp, homo sapien
gtggcatctgggcagctcattaattyaacccaagcttagggaaaccttta

SEQ ID NO: 109382 - DNA, 50 bp, homo sapien
ttaattcaacccaagcttagggaaayctttaggagaggatgtccaagctc

SEQ ID NO: 109383 - DNA, 50 bp, homo sapien
ttgcaaatatatactcttgtataaastccaccacaatcaaaatggacaac

SEQ ID NO: 109384 - DNA, 50 bp, homo sapien
attgctgttgcaaggcttagtttacrgacccagagaggcttatatgtcac

SEQ ID NO: 109385 - DNA, 50 bp, homo sapien
acacaccaaagactatacaaaactcmatacccttcaatggcttgcaatgc

SEQ ID NO: 109386 - DNA, 50 bp, homo sapien
aagaaattgagcttttccaaagtgcraggcatggattatagacagtgttg

SEQ ID NO: 109387 - DNA, 50 bp, homo sapien
tgtgacttcaggatgtagtcactggyaggtagcacgtgggcatttgagtt

SEQ ID NO: 109388 - DNA, 50 bp, homo sapien
cccccaccatcatctgaatattcaayctcatctcattagcctagtcccat

SEQ ID NO: 109389 - DNA, 50 bp, homo sapien
ccctcttaggctgacttataaaccaytgactgcttcccgactgttctgtg

SEQ ID NO: 109390 - DNA, 50 bp, homo sapien
attcccttccatgtatattaaatgasgtagtgcactccatttaatatctt

SEQ ID NO: 109391 - DNA, 50 bp, homo sapien
tcgtatacctttcctttgtgtaagargagaaaaagaacaaaagaaaaagg

SEQ ID NO: 109392 - DNA, 50 bp, homo sapien
tttggaagatttatgaacctggtaaygtccatgcaattggatttcattga

SEQ ID NO: 109393 - DNA, 50 bp, homo sapien
ggccctgttttaattttcatagtcaygggaatcccctgtgtatcaacagg

SEQ ID NO: 109394 - DNA, 50 bp, homo sapien
tagatgaggttgtgaaggtggtgtaygaagccattcttcactgttctaaa

SEQ ID NO: 109395 - DNA, 50 bp, homo sapien
tggatctctggcttggaagcatttcrcgggatcgtcacacggggcaggtg

SEQ ID NO: 109396 - DNA, 50 bp, homo sapien
tgggtgtttgtttcctttgtagctcyagttagtagaaggacactggtctt

SEQ ID NO: 109397 - DNA, 50 bp, homo sapien
gaaataaaacacccgcctgaaacaarcattggcaggttctatttcaggga

SEQ ID NO: 109398 - DNA, 50 bp, homo sapien
actccccatctgtgcctctgtttacrgctctcttccatttttacttctaa

SEQ ID NO: 109399 - DNA, 50 bp, homo sapien
ccataattgtgttgtttattggagakattatttttgttttattttcgttg

SEQ ID NO: 109400 - DNA, 50 bp, homo sapien
aaaaatgtatttgtccagtcattatragaattatttgagtctcttactgt

SEQ ID NO: 109401 - DNA, 50 bp, homo sapien
gcttccaaaattgcccaacctctcayggaataccaaatacataataattt

SEQ ID NO: 109402 - DNA, 50 bp, homo sapien
actacactgatatattagcaatctcraactcttgacttttttttttttga

SEQ ID NO: 109403 - DNA, 50 bp, homo sapien
tagaaaatgctcacacctggagtccmaattgtagattcttgtccctactg

SEQ ID NO: 109404 - DNA, 50 bp, homo sapien
cagtgacatgcttagatagaaacaarttgacataacccttattccagaac

SEQ ID NO: 109405 - DNA, 50 bp, homo sapien
tctaagatgtgttaaggttttagtasgcatctgatggacttgtaagggag

SEQ ID NO: 109406 - DNA, 50 bp, homo sapien
aatctagggcttattattaaaacaarttatgcaagctaactttaatattt

SEQ ID NO: 109407 - DNA, 50 bp, homo sapien
gggcatgagtaagctatataagcaastagtgcagactcccttgtcattca

SEQ ID NO: 109408 - DNA, 50 bp, homo sapien
aggatattgtctgaaatatgataaayggccagcaggtgttagtacataaa

SEQ ID NO: 109409 - DNA, 50 bp, homo sapien
ctccttggctgatactaactgactcmattcacgagcagcttttccccact

SEQ ID NO: 109410 - DNA, 50 bp, homo sapien
tgccaaaatgataggaatagattggkcaggaataaatattgaacattttc

SEQ ID NO: 109411 - DNA, 50 bp, homo sapien
tttgcaaaaactatcttagttgaagsatagttcatgttacatgagtaaaa

SEQ ID NO: 109412 - DNA, 50 bp, homo sapien
cacaatacaaagcttacggcaggtayattggaagaattgcaatggaggcc

SEQ ID NO: 109413 - DNA, 50 bp, homo sapien
ggctcatgaagatttctgtaaaatasattccaagcagtgaaattactgtg

SEQ ID NO: 109414 - DNA, 50 bp, homo sapien
gctcatactagtccatgttgctgggyaaagtacagatagataataagttt

SEQ ID NO: 109415 - DNA, 50 bp, homo sapien
tccactaaaaatctcttagaactaayaagtgagtcttgcaagtttcagaa

SEQ ID NO: 109416 - DNA, 50 bp, homo sapien
ctataatatgagagcctaaaaccaasatggacattccaaggtgatcagat

SEQ ID NO: 109417 - DNA, 50 bp, homo sapien
ccccattctgccctcttggaagactmaatgattgtctctgcagttggacc

SEQ ID NO: 109418 - DNA, 50 bp, homo sapien
gctcaaaataatattttgtataataygaaaattacgaaattttagtttct

SEQ ID NO: 109419 - DNA, 50 bp, homo sapien
tgtgtactgagaaatatatggtgaastagagcaagggccggactcagggc

SEQ ID NO: 109420 - DNA, 50 bp, homo sapien
ctgccaagttgcagagaatccgtgaraacagagaagcaaacagggcagcc

SEQ ID NO: 109421 - DNA, 50 bp, homo sapien
agtaggcactaaagtatactgatacrcttgggtaatagagaaagtcttcc

SEQ ID NO: 109422 - DNA, 50 bp, homo sapien
aagatttgaggataacagattgttayatgagtctgaagttgtcaagaggg

SEQ ID NO: 109423 - DNA, 50 bp, homo sapien
gtggagtccaactaatctttccacaratgttttcagaagtactttgcact

SEQ ID NO: 109424 - DNA, 50 bp, homo sapien
gttggcggcagcagaatctgtatcarctgtgtattaggagagtagctgca

SEQ ID NO: 109425 - DNA, 50 bp, homo sapien
gaagctgaagtttgggcatggctaartctaacacaatccaaagtcaggaa

SEQ ID NO: 109426 - DNA, 50 bp, homo sapien
tatttaaagaaactacatctcaaagkacccggtgcacaagtaatgggcag

SEQ ID NO: 109427 - DNA, 50 bp, homo sapien
acaagccttttccaatgttcaagaaraaaagatgtctccaggttgctgtg

SEQ ID NO: 109428 - DNA, 50 bp, homo sapien
aaggcttgtccccaggtatgtctgamaccagagaaaaagctatctgcaag

SEQ ID NO: 109429 - DNA, 50 bp, homo sapien
aagcttttccctaatcatctatcatsacactgagagctctgcaccttcat

SEQ ID NO: 109430 - DNA, 50 bp, homo sapien
gtattttcaaattttgtagatttcartcaagagtagggataaggaaggtg

SEQ ID NO: 109431 - DNA, 50 bp, homo sapien
atacaacccccaagtaatgaccacartgcagtctgttacgacagctatgg

SEQ ID NO: 109432 - DNA, 50 bp, homo sapien
ccacctgccatctctttgtcggacawgtcaacttttctctctgaccccac

SEQ ID NO: 109433 - DNA, 50 bp, homo sapien
aacagataaaatacataaatcagaartggtatgctgatgaaaacaaagaa

SEQ ID NO: 109434 - DNA, 50 bp, homo sapien
gcaaatgtgctcagctgagacaaggwaagtgtctttcaaaataactttaa

SEQ ID NO: 109435 - DNA, 50 bp, homo sapien
gtaattgagaattaaatgtagatacscatgtccatagtcaattaaagaga

SEQ ID NO: 109436 - DNA, 50 bp, homo sapien
tatggagcaggctcctgggatactakagtcattatgtaacacattttttt

SEQ ID NO: 109437 - DNA, 50 bp, homo sapien
ccaaaagctaaaagaataagtgttasaatccaagctcaggattcacaatg

SEQ ID NO: 109438 - DNA, 50 bp, homo sapien
tcacttttcccttctgcctgggagaygggtcagtaaattccaaagggcct

SEQ ID NO: 109439 - DNA, 50 bp, homo sapien
caccctgttaatgtcttttccagackgcccttctctcttgacctctagat

SEQ ID NO: 109440 - DNA, 50 bp, homo sapien
cagaacaggatattcttaactaccamagaattttacacatctattgtttt

SEQ ID NO: 109441 - DNA, 50 bp, homo sapien
gtatgttgagtgtgatgtcaaggacraggtcaagattggaaataaggaag

SEQ ID NO: 109442 - DNA, 50 bp, homo sapien
tgtttctagcagttttaatcagaatmattaagaacgagaaacaaccaata

SEQ ID NO: 109443 - DNA, 50 bp, homo sapien
ctggtccaagcatttttgcctacaaycagaaccagaatttttgttttgtc

SEQ ID NO: 109444 - DNA, 50 bp, homo sapien
ggaccagattagcacattgtcataawtcttttctctacttggagctttta

SEQ ID NO: 109445 - DNA, 50 bp, homo sapien
gtagattaagccatcgattgtatcawagagaaagtgtgaaaaactacttt

SEQ ID NO: 109446 - DNA, 50 bp, homo sapien
tttcatttcccctggaaaatgcctakgagtgaacaggttgggtcatatga

SEQ ID NO: 109447 - DNA, 50 bp, homo sapien
aaaaaaaagaacataactatggcaastaatgagaattgattgtgtatgta

SEQ ID NO: 109448 - DNA, 50 bp, homo sapien
atcagaattctgaaggcagtgtcacrgcacaaagaaactagctactgaag

SEQ ID NO: 109449 - DNA, 50 bp, homo sapien
ggaggtaaaagagttaagagatagaygcaaatgctgatgtacttcatcga

SEQ ID NO: 109450 - DNA, 50 bp, homo sapien
aaaaccctactgaacacatgatctayctgaattagaggagaaatcagaat

SEQ ID NO: 109451 - DNA, 50 bp, homo sapien
ccagcgtgtcccagagttggttctcraatatcctaggctgcctccttctt

SEQ ID NO: 109452 - DNA, 50 bp, homo sapien
tctgacagcatccactttagaaatargcatatgtttttcccactttcgca

SEQ ID NO: 109453 - DNA, 50 bp, homo sapien
gcgcccagcctatgtctgtatcaggycctactacttggtacattgtctgt

SEQ ID NO: 109454 - DNA, 50 bp, homo sapien
agatgcagggacagcagcctcgaccraagaaactggatgaggaaaggtat

SEQ ID NO: 109455 - DNA, 50 bp, homo sapien
ctttgtattatctcagatatattagrgaaaaaaatgtcttttccccattc

SEQ ID NO: 109456 - DNA, 50 bp, homo sapien
ctcctaaataacaaactcaactataycgctgggtccaagctgaatgacag

SEQ ID NO: 109457 - DNA, 50 bp, homo sapien
tcgcagtgtgccaatttaatagacamgaacaaggatgtagaagatgaact

SEQ ID NO: 109458 - DNA, 50 bp, homo sapien
aaaagacatgtgaaaataacttaggrccaaagctggaacaattttggcac

SEQ ID NO: 109459 - DNA, 50 bp, homo sapien
gtcgtaatcaacctaagggcataaaycttgaatcccaactcagggaaaag

SEQ ID NO: 109460 - DNA, 50 bp, homo sapien
tttccttaattcatggtgcctgtatyagaagagtaagccttcaaagaggg

SEQ ID NO: 109461 - DNA, 50 bp, homo sapien
atctccaagaaacctgttcattttasagtaccagccttgcgtcctgaggt

SEQ ID NO: 109462 - DNA, 50 bp, homo sapien
caataaagtgcagcctgtacccaaasaataactaattgtgtaatattttc

SEQ ID NO: 109463 - DNA, 50 bp, homo sapien
tcatttgggtaaataccaaggagcayaactgttgaatcacatggtaagaa

SEQ ID NO: 109464 - DNA, 50 bp, homo sapien
taacaaaatatttaacctctatctgyactcatctatcaatccctaacttc

SEQ ID NO: 109465 - DNA, 50 bp, homo sapien
gcgctctagattctcagatgtgagasctgggcataaacaaagaattaatc

SEQ ID NO: 109466 - DNA, 50 bp, homo sapien
aagttgttagccagtatccaaacgtsaatgtgccaaaacttataaatgta

SEQ ID NO: 109467 - DNA, 50 bp, homo sapien
aacagatattgttttagtcttcatgraattctacaggaggataaaacaaa

SEQ ID NO: 109468 - DNA, 50 bp, homo sapien
ttcctcgttttggcttttctctactyaatcggctttttgtctcagcggcc

SEQ ID NO: 109469 - DNA, 50 bp, homo sapien
gctctccatttctttatcctccttcwagttagagatttattggaaaacat

SEQ ID NO: 109470 - DNA, 50 bp, homo sapien
ttcaagtaaacagattcaactaacargtatatgatgagcacctactatgt

SEQ ID NO: 109471 - DNA, 50 bp, homo sapien
gcattttctacctgtagattgtttaygggtttatttgcatttttatatat

SEQ ID NO: 109472 - DNA, 50 bp, homo sapien
tataacatgaactgtgtatcatatamaaatacgcatctgggatactctct

SEQ ID NO: 109473 - DNA, 50 bp, homo sapien
gaagctctcaggctaacctaacatamgagataaataggcagtttcaaaag

SEQ ID NO: 109474 - DNA, 50 bp, homo sapien
gccatagcaagtcacttagggtttayctgaattcaagtaggtagaaaaat

SEQ ID NO: 109475 - DNA, 50 bp, homo sapien
tttatctcttatgttaggttagcctsagagcttctttggagccagtgctt

SEQ ID NO: 109476 - DNA, 50 bp, homo sapien
ctatctttatcactgatgtgcttacraactatattcctgatttaaacaag

SEQ ID NO: 109477 - DNA, 50 bp, homo sapien
tgtatacttgtgtatatatcaatcartaaccattacttactacatgaaag

SEQ ID NO: 109478 - DNA, 50 bp, homo sapien
tgaaagaaatacatgaaggaatcaayaagttaataagtcctactatatgt

SEQ ID NO: 109479 - DNA, 50 bp, homo sapien
acaggtgataagaaacaaatatgtcsaaactataattggatcacagtaga

SEQ ID NO: 109480 - DNA, 50 bp, homo sapien
atttacaggcctctgtgagcccaaakgtagctagcactgtcccagagact

SEQ ID NO: 109481 - DNA, 50 bp, homo sapien
ttcttagcatcagaaatagaaaaaaytgaattgccattattaagagatgg

SEQ ID NO: 109482 - DNA, 50 bp, homo sapien
atgcccacattgtgagttctgaattkgaagagcatcacagtagcttctct

SEQ ID NO: 109483 - DNA, 50 bp, homo sapien
tttgaagagcatcacagtagcttctstaaccattttgcatcatctttcta

SEQ ID NO: 109484 - DNA, 50 bp, homo sapien
attgcattccattaaaatgcagaccwcctattagaaagcattaagggatt

SEQ ID NO: 109485 - DNA, 50 bp, homo sapien
tgatggggaataggtgatgggagaamaaaagtatcatatattaaatagca

SEQ ID NO: 109486 - DNA, 50 bp, homo sapien
acgtctagataaacaactgataatgrattaggaatataaaaccaattttt

SEQ ID NO: 109487 - DNA, 50 bp, homo sapien
acacctgaaaccaaaatgccctaaaytgagcttttatccacaacccacaa

SEQ ID NO: 109488 - DNA, 50 bp, homo sapien
gtgctgcttttagaaaatcaaactayggttcattaggttatttaaaaatc

SEQ ID NO: 109489 - DNA, 50 bp, homo sapien
agatacagtcagcaaaatgttctaayatagagtgagctcattaagtaatt

SEQ ID NO: 109490 - DNA, 50 bp, homo sapien
aatactatatgaaagtatattctaastcaatatttgtatcttaattaaaa

SEQ ID NO: 109491 - DNA, 50 bp, homo sapien
gagaggtggaaaagcagttgagctgsagaaaataggaagagaacatgttt

SEQ ID NO: 109492 - DNA, 50 bp, homo sapien
taactttaatattggatattccaackgctaaacaacctctggactcctga

SEQ ID NO: 109493 - DNA, 50 bp, homo sapien
gccttacataattcccacaaaagatyataagtgcccaaaccgagagagtg

SEQ ID NO: 109494 - DNA, 50 bp, homo sapien
attctaaaagggctgccgctgcgtgycaaggattctccctcctcattctc

SEQ ID NO: 109495 - DNA, 50 bp, homo sapien
gggccgggccagaactccatttagamctcctgcagaagtctcagtagact

SEQ ID NO: 109496 - DNA, 50 bp, homo sapien
gctaagaaaaaaacaagcaaacttasgttcctgataattacgaagaaact

SEQ ID NO: 109497 - DNA, 50 bp, homo sapien
ctttggtaaaatgagtttttgacccwcctcttacagactcacaatatgta

SEQ ID NO: 109498 - DNA, 50 bp, homo sapien
gctcgctcatgaataaaaagtcacawattatcctaggctatctaatattc

SEQ ID NO: 109499 - DNA, 50 bp, homo sapien
taatactctcctgacattttaagtgsatgagtaattctactatggaagtg

SEQ ID NO: 109500 - DNA, 50 bp, homo sapien
ctttaattgccagacatcaaattttsaaaacctgaagtttctagagatta

SEQ ID NO: 109501 - DNA, 50 bp, homo sapien
gtctttgtaggggagctataggatgkagtagtagttcagaaaaggatttt

SEQ ID NO: 109502 - DNA, 50 bp, homo sapien
aaatggaagtgttgaaaccacttctmaatgctggctctactccttccata

SEQ ID NO: 109503 - DNA, 50 bp, homo sapien
tggtccattcaacactggagaatgtraaaactatagcaaatgtactgccg

SEQ ID NO: 109504 - DNA, 50 bp, homo sapien
gataatatagctacctatcttgaaawtatactgcagaaagtataggcttg

SEQ ID NO: 109505 - DNA, 50 bp, homo sapien
cctagctcagctccctgagaacttawgctctattcttcaatatctgcttt

SEQ ID NO: 109506 - DNA, 50 bp, homo sapien
atacatatctctaaaaactggatcarcaatctatagagtactatcttttc

SEQ ID NO: 109507 - DNA, 50 bp, homo sapien
caccctcatttatataccctcaagamtagaattactttaacaactaaagt

SEQ ID NO: 109508 - DNA, 50 bp, homo sapien
ggcagccaacactgcaccagaattcrccactctacactttcttccagcag

SEQ ID NO: 109509 - DNA, 50 bp, homo sapien
ataaaatatcatcaggctgctacaasaactttcattgtcatcacccctca

SEQ ID NO: 109510 - DNA, 50 bp, homo sapien
tgacacagttattcagctatttcgayggctggcaatgagataagttagct

SEQ ID NO: 109511 - DNA, 50 bp, homo sapien
tttcattctgttgaatattgtctaayggtgcagaaggtttttcctttttt

SEQ ID NO: 109512 - DNA, 50 bp, homo sapien
ccaaagtatgtaagaaactcttacaratcaatggcaaaaaaaaaacaaac

SEQ ID NO: 109513 - DNA, 50 bp, homo sapien
aacaagctaaggaaaagaagtctaaygaagagataattcactattcatat

SEQ ID NO: 109514 - DNA, 50 bp, homo sapien
ctctcctcacagaatctaagacctakgcaaccatgccatttacataaaat

SEQ ID NO: 109515 - DNA, 50 bp, homo sapien
aatgggactcatgtctatattaagasgacatattttcaaatacatagtaa

SEQ ID NO: 109516 - DNA, 50 bp, homo sapien
attgcattaaacaatacgtaatacartggttcattccaaagtgaagctta

SEQ ID NO: 109517 - DNA, 50 bp, homo sapien
caggtcttgccttcattagaacttcrcaaagggtatccttgaaattagta

SEQ ID NO: 109518 - DNA, 50 bp, homo sapien
ccagatgtaccaaggcaaaaagataygtggtctcatgtctttaaccaaga

SEQ ID NO: 109519 - DNA, 50 bp, homo sapien
gttagactttttctttgcaacgtgaracattaccacaagctccatgctac

SEQ ID NO: 109520 - DNA, 50 bp, homo sapien
tcctacatttaaatgacaaatgataygtactaatacaaagggctcccaga

SEQ ID NO: 109521 - DNA, 50 bp, homo sapien
aaaactgtctctctcaagaattgaamatttttaccatgtagattactagt

SEQ ID NO: 109522 - DNA, 50 bp, homo sapien
tcaatgttttcaacaagtatagtttytaagcctttaagaagaccttgaat

SEQ ID NO: 109523 - DNA, 50 bp, homo sapien
tatagtgttctgtatcaaatatttcraagaacttttttgttgttgctgtt

SEQ ID NO: 109524 - DNA, 50 bp, homo sapien
cctgtttttgtcctgaatgagccaarggtacaaaattaataagcaacaca

SEQ ID NO: 109525 - DNA, 50 bp, homo sapien
ttcaaaacaatcataaaagcgactargagtcagtgtattatttattatta

SEQ ID NO: 109526 - DNA, 50 bp, homo sapien
gagcctgttcccttgagatctcacasatgattccattttggaacctttcc

SEQ ID NO: 109527 - DNA, 50 bp, homo sapien
tgttcttattctctaaacatcatcaraggctgaggcaatcagatcatttg

SEQ ID NO: 109528 - DNA, 50 bp, homo sapien
agacttggaactgcactggttaacaraacttcatctttttctgacctcct

SEQ ID NO: 109529 - DNA, 50 bp, homo sapien
aaagtgtgcatgaaattggctcacastacatattacagatgatcagtgca

SEQ ID NO: 109530 - DNA, 50 bp, homo sapien
ttttagttcctttgaatcagatctasgcttaacacttttaaataactcct

SEQ ID NO: 109531 - DNA, 50 bp, homo sapien
tcgcttggatttagggatatagtgaygaacgggagtgttttagtttgttc

SEQ ID NO: 109532 - DNA, 50 bp, homo sapien
cattctcaaacctggcattacatcartccattttcagatcacccctagag

SEQ ID NO: 109533 - DNA, 50 bp, homo sapien
tacaagaaatgattattctaaaaaamttatcatccccaggcaagagatcc

SEQ ID NO: 109534 - DNA, 50 bp, homo sapien
ccacacagggaaaaacaggtgtaaargagatcaggtaatagactatatct

SEQ ID NO: 109535 - DNA, 50 bp, homo sapien
ctgatgcaaaagcaatatgttttcartagagtattcaataaattacacgg

SEQ ID NO: 109536 - DNA, 50 bp, homo sapien
gggttttctggaagctggtagttcayagggctcagaaggagacataatgc

SEQ ID NO: 109537 - DNA, 50 bp, homo sapien
ttttttaaagacaaaccctcatagaygtttagcagttctcacacatagag

SEQ ID NO: 109538 - DNA, 50 bp, homo sapien
ttcttctgttcgcctctctgttgatktatacactgaaaacaactgaggac

SEQ ID NO: 109539 - DNA, 50 bp, homo sapien
tcattgattctgtcacttaacttcaygggtaatcctaggcaaagtactta

SEQ ID NO: 109540 - DNA, 50 bp, homo sapien
attaacagtgccttgtcttcttaagsagtgatttgtgtatgtgctgatat

SEQ ID NO: 109541 - DNA, 50 bp, homo sapien
tagataattttattcccctttgtgayctgaaatatggcataagcactcca

SEQ ID NO: 109542 - DNA, 50 bp, homo sapien
tacacttggcaaagtatgtatgaaasaagaaattcaagcagttttaccca

SEQ ID NO: 109543 - DNA, 50 bp, homo sapien
cccatcaaaccagcaaagatgtggcracagtattcaagattaataatctt

SEQ ID NO: 109544 - DNA, 50 bp, homo sapien
aatataaaacttccaaatcaagaaartgcaaaaagggacaatttaggaaa

SEQ ID NO: 109545 - DNA, 50 bp, homo sapien
atcttcttcctatggagattaatcartaacagtcctcatcattctttggt

SEQ ID NO: 109546 - DNA, 50 bp, homo sapien
atactccagccaaactaatgtgtacraaaagtggagacataaaatataaa

SEQ ID NO: 109547 - DNA, 50 bp, homo sapien
ctctaattattttttaaagcctttakaatattgaatgatgtcttctcatt

SEQ ID NO: 109548 - DNA, 50 bp, homo sapien
aggtttttcttttggggaaatacacrccaatggtagagttcttactatat

SEQ ID NO: 109549 - DNA, 50 bp, homo sapien
agtttaatattaatctgatagcagaygatgataaatataaaccacaaact

SEQ ID NO: 109550 - DNA, 50 bp, homo sapien
aaagtttttgaaaatatacaacataraagttgagttacaaaccactttac

SEQ ID NO: 109551 - DNA, 50 bp, homo sapien
tacattttgcaatgaacaaaatgagwaagaatgctgtagcatctcacacc

SEQ ID NO: 109552 - DNA, 50 bp, homo sapien
ctaagagaatgactgttttgtatcaycagtatggtagtctgtagacttta

SEQ ID NO: 109553 - DNA, 50 bp, homo sapien
aaaatcctttcatatatcttagaaascagcttaagtagcctcaaagttgt

SEQ ID NO: 109554 - DNA, 50 bp, homo sapien
tataagtctagtgatttcagtaaatkaataataagctcatcatttgaaaa

SEQ ID NO: 109555 - DNA, 50 bp, homo sapien
aagaacgaaggtttaggttgacctawatgtggcagtatctcatagcctga

SEQ ID NO: 109556 - DNA, 50 bp, homo sapien
ccattaggatgctatacggaaaagcyatatacacttgaaaaaatctagcc

SEQ ID NO: 109557 - DNA, 50 bp, homo sapien
aaaaattatgatctgttaatgatacrgaatagcaacaaattataccgtaa

SEQ ID NO: 109558 - DNA, 50 bp, homo sapien
cagtcactgatattcgtaagagagaytatcagcagaaataatcatgggaa

SEQ ID NO: 109559 - DNA, 50 bp, homo sapien
ccaagggacctactaggaaagtgaaygaagattctagtatcaaattttta

SEQ ID NO: 109560 - DNA, 50 bp, homo sapien
aattctttttaacccaagtatatatsaaaagttacagctatgatttatat

SEQ ID NO: 109561 - DNA, 50 bp, homo sapien
atggtctctacgtttctttgtaggcyaaatgggtattttgctccattttt

SEQ ID NO: 109562 - DNA, 50 bp, homo sapien
agaatttgaatttccacttttaacayggtgctttggtgattctaattttt

SEQ ID NO: 109563 - DNA, 50 bp, homo sapien
ttgttggctgtgattccaatgttaaygagtccaaaaatatgtattaaata

SEQ ID NO: 109564 - DNA, 50 bp, homo sapien
atgaattttgggggtactcacttcaktccgcaatagcatgatacaagttt

SEQ ID NO: 109565 - DNA, 50 bp, homo sapien
tcacacaggtagtgaggtagaaagckctcacatataaatcctggcgttcg

SEQ ID NO: 109566 - DNA, 50 bp, homo sapien
tttcttaagggagatcaatttgtcasatggtaatatgaattttaaatact

SEQ ID NO: 109567 - DNA, 50 bp, homo sapien
ttacaatctttccagatgggataagractgtttaacaatgattctaaata

SEQ ID NO: 109568 - DNA, 50 bp, homo sapien
agaaagggctatacttcaaaacttakgagacaagaaaacaaagaatctct

SEQ ID NO: 109569 - DNA, 50 bp, homo sapien
gcaggccaaatctggttacttctcaygctctgatttaagaaactttatat

SEQ ID NO: 109570 - DNA, 50 bp, homo sapien
agaattctaagcaggggtgttgttasgcagtgcatatatgggtttgtagt

SEQ ID NO: 109571 - DNA, 50 bp, homo sapien
catatatgggtttgtagttgagagaygagctatgggcaagagataaagac

SEQ ID NO: 109572 - DNA, 50 bp, homo sapien
tccacatatgaatgtacggtagacaytgatgtgttatatgattgtacttc

SEQ ID NO: 109573 - DNA, 50 bp, homo sapien
aatgatagtcctatttcaagcaaaasaggcttaacaaatgatgcatgtct

SEQ ID NO: 109574 - DNA, 50 bp, homo sapien
ttctttcagaaaaggattgtaaacaygatgccttcatttaatttttaaaa

SEQ ID NO: 109575 - DNA, 50 bp, homo sapien
agattaggagtggttcagctgatccrcagtatcttccataccctgaaatt

SEQ ID NO: 109576 - DNA, 50 bp, homo sapien
attgaaaaggagctgaagtaacgcckgagataaacttcttttaaaagaca

SEQ ID NO: 109577 - DNA, 50 bp, homo sapien
ctaactggtggacaattctacttcastcatgtttgggggatgccctactt

SEQ ID NO: 109578 - DNA, 50 bp, homo sapien
aatggaatcttagttataaaactacraaatatgaagtgaagttgcttttt

SEQ ID NO: 109579 - DNA, 50 bp, homo sapien
gcaagataataaataatgatcccaarttcacacaggtagtgaggtagaaa

SEQ ID NO: 109580 - DNA, 50 bp, homo sapien
ttacttacatatgtctcctagaatgyatttttaaaactgatttaaaaaat

SEQ ID NO: 109581 - DNA, 50 bp, homo sapien
agtagattttgttttagagtgacaamtgaaacacgaatatgttaatatat

SEQ ID NO: 109582 - DNA, 50 bp, homo sapien
ccatgcaaaattgaatatacagtatraacctgatttgcagaaaaaatgta

SEQ ID NO: 109583 - DNA, 50 bp, homo sapien
caatgtatacgaaaccagccaactgraaacgtcataactgagccacaagt

SEQ ID NO: 109584 - DNA, 50 bp, homo sapien
tgtaaacatcatcactgatcaaaccwatctgtgttccctacgtagtaaat

SEQ ID NO: 109585 - DNA, 50 bp, homo sapien
acttggttaaccctcattgaaaatartatgtagcatttctatgaactaat

SEQ ID NO: 109586 - DNA, 50 bp, homo sapien
ttattagtaagaatgaattaagctayagaaagttttgtagtaccagacag

SEQ ID NO: 109587 - DNA, 50 bp, homo sapien
tagataacataaatactgtttttaasgatttgaaaaatatgcttcaagtg

SEQ ID NO: 109588 - DNA, 50 bp, homo sapien
tagctccaaagcagaagattctcaasagcctggtgaatttctacacctgg

SEQ ID NO: 109589 - DNA, 50 bp, homo sapien
gcaggaattggaagtaaaatgatgamgtatacattgattttttaaataga

SEQ ID NO: 109590 - DNA, 50 bp, homo sapien
tgaactatagtccatgatactacaaygaacaaagtacttggaaacaaaat

SEQ ID NO: 109591 - DNA, 50 bp, homo sapien
cctgctgttaagtattttacaattayagatttacaccctatcttttattc

SEQ ID NO: 109592 - DNA, 50 bp, homo sapien
atgtccatatttactttgtctttgamgatttccaggatatccactattca

SEQ ID NO: 109593 - DNA, 50 bp, homo sapien
tccttctgggtatactatgccgtagratataaacgtcattctttttatta

SEQ ID NO: 109594 - DNA, 50 bp, homo sapien
accctactccataacaacttccttamagtcacagtctgttgctctgactt

SEQ ID NO: 109595 - DNA, 50 bp, homo sapien
agtatttcccagttaagtaggtatayattttttgtaatatctagagctgt

SEQ ID NO: 109596 - DNA, 50 bp, homo sapien
actcagttttttcataacaaatgcastaatttatgaaaaaatgttaaatc

SEQ ID NO: 109597 - DNA, 50 bp, homo sapien
gggaaataagttttcaatagcactakacttaggcttaactcacgttatta

SEQ ID NO: 109598 - DNA, 50 bp, homo sapien
ttaattatatgcattgcctttaaatwatctgtcatccattgaagtcagca

SEQ ID NO: 109599 - DNA, 50 bp, homo sapien
agtacattgagtataggcatttaaasctttgtagtaaatgaaagttgatt

SEQ ID NO: 109600 - DNA, 50 bp, homo sapien
tcatttggtacttcaaagtgtgtacrgcaaaacaacatcttaaggcttaa

SEQ ID NO: 109601 - DNA, 50 bp, homo sapien
atgttccagttgataattttaataasagccatcacccattttattagcag

SEQ ID NO: 109602 - DNA, 50 bp, homo sapien
ccactttgctttcaaggctttctgcracgtgtccttacaacattctaact

SEQ ID NO: 109603 - DNA, 50 bp, homo sapien
tgtatctccatctcatctttccttaraaccagagatttatgtatccagct

SEQ ID NO: 109604 - DNA, 50 bp, homo sapien
tgagtgtcacttggagctttgggaayggacatgtgctatgccttcagctt

SEQ ID NO: 109605 - DNA, 50 bp, homo sapien
tgaacctcttctttgttactaacacwcatttatttggtgattgcatctag

SEQ ID NO: 109606 - DNA, 50 bp, homo sapien
atatgaacatgtctgaaatgatagargatacaacggaattttaaatcatg

SEQ ID NO: 109607 - DNA, 50 bp, homo sapien
agggcatcccactggtcaaatccaaytggaacccaggtggcatgagagta

SEQ ID NO: 109608 - DNA, 50 bp, homo sapien
aagggtaaagggttaaggggaagaartagcattattggaaccctctgagt

SEQ ID NO: 109609 - DNA, 50 bp, homo sapien
aacccttcagattcctggtggaacaygatccaactccaatgagtccaaag

SEQ ID NO: 109610 - DNA, 50 bp, homo sapien
tgatcgtttctgagcaaaaacagtgraacagtgaagagggcagtggaatg

SEQ ID NO: 109611 - DNA, 50 bp, homo sapien
tacttccctgagctcttttgtgtcaytatggtttctatgtgcacatttgt

SEQ ID NO: 109612 - DNA, 50 bp, homo sapien
aatcactgtggttcattatgattcayagcactggatagtctgtgggaaat

SEQ ID NO: 109613 - DNA, 50 bp, homo sapien
ataaatgaaggtcttaacgcaaagartaatactgaagtacaatactaaaa

SEQ ID NO: 109614 - DNA, 50 bp, homo sapien
cttgaatatagggacaaagaaacagraatagtgtaagcagtagtttatta

SEQ ID NO: 109615 - DNA, 50 bp, homo sapien
ctgtggaagtgtgtgaaacatattaycatcatattgattccaatgtattt

SEQ ID NO: 109616 - DNA, 50 bp, homo sapien
atgcctgttatatttgtattgcttcrtccctgccccatagtaatggatca

SEQ ID NO: 109617 - DNA, 50 bp, homo sapien
gcatcaaaagaaatctaggacattaratagctattgaatcaagagcagct

SEQ ID NO: 109618 - DNA, 50 bp, homo sapien
attttggttcaatttatatgaatcgrtaatcttccagactttgagagttt

SEQ ID NO: 109619 - DNA, 50 bp, homo sapien
agttaatcaagagaccaagccaaaasttgtgatatttttaatttcttagt

SEQ ID NO: 109620 - DNA, 50 bp, homo sapien
atgttgcacaatgagttcttaatgastagcatagggtaaaataaaagaac

SEQ ID NO: 109621 - DNA, 50 bp, homo sapien
aataggaaagatgctgtgtttggcaytgagtacttttttttaagcgtaag

SEQ ID NO: 109622 - DNA, 50 bp, homo sapien
aaaatcaatgcattattagcattaamatagatactagatcaacagaacag

SEQ ID NO: 109623 - DNA, 50 bp, homo sapien
ctagaaaggtattcaaacactgggtraaataatgcaatcagacaaagtaa

SEQ ID NO: 109624 - DNA, 50 bp, homo sapien
aaaatttaaaaagacataaaaagcaytgaatatagcaaaccacagaccca

SEQ ID NO: 109625 - DNA, 50 bp, homo sapien
agaaaacagaatagaaagatggagayaattgtgaggtaaaaacattttac

SEQ ID NO: 109626 - DNA, 50 bp, homo sapien
cacacactgattatttaaagagatgracaataaggttattaatgggcctc

SEQ ID NO: 109627 - DNA, 50 bp, homo sapien
aaagaaaatgataagccacaaatacygattttaagcaaaagctacctata

SEQ ID NO: 109628 - DNA, 50 bp, homo sapien
cattatttgattcgtttaacaaatasattcagatgcaaggtatttctagt

SEQ ID NO: 109629 - DNA, 50 bp, homo sapien
acgagtcttaatctgttgggactgcmataaaacatgacttagactgaata

SEQ ID NO: 109630 - DNA, 50 bp, homo sapien
ggaatattggatacagaaaatttaasactgctgcacatttgatactaaat

SEQ ID NO: 109631 - DNA, 50 bp, homo sapien
atttgcacatatatctaatactccartctttttatggaacctattatttt

SEQ ID NO: 109632 - DNA, 50 bp, homo sapien
tctagatgcggcaacatgtttttcaratgaagatttaacaggaatatctg

SEQ ID NO: 109633 - DNA, 50 bp, homo sapien
aggtagaaagtgttgcacaggtttaygcagtcttgagaggcagagatgaa

SEQ ID NO: 109634 - DNA, 50 bp, homo sapien
ttcacggtaagttctctgatcatctraatctggttaaattgttaataaat

SEQ ID NO: 109635 - DNA, 50 bp, homo sapien
gtcctcctgcaatagcatttctgtcyctttaactcagggatttctccaag

SEQ ID NO: 109636 - DNA, 50 bp, homo sapien
acatggctgtcagcagttttggagaygcaggtaattagtcctgctccagc

SEQ ID NO: 109637 - DNA, 50 bp, homo sapien
ttctccagtctagttagccacaatamtaaaacagtaagatcattttgaaa

SEQ ID NO: 109638 - DNA, 50 bp, homo sapien
tctcaaagtgtatcttctggaataayagtccaagtagacatgccataaaa

SEQ ID NO: 109639 - DNA, 50 bp, homo sapien
tccagggagatgaccacaacattccragaagatgaatacacctataaccc

SEQ ID NO: 109640 - DNA, 50 bp, homo sapien
ttaaagcaagtcctctcacaatgaaygaggacatccaatgacaattttta

SEQ ID NO: 109641 - DNA, 50 bp, homo sapien
aaaacaaaaaattctttgaatcaaaygacagcaaagatacaacataccaa

SEQ ID NO: 109642 - DNA, 50 bp, homo sapien
catccaaaccataccagtgagtttayacttacattgaaactggtgaagag

SEQ ID NO: 109643 - DNA, 50 bp, homo sapien
caaataatatacataggttgttctaygcagatgatggcactctgatatca

SEQ ID NO: 109644 - DNA, 50 bp, homo sapien
taggcttggggctgacatatagtaawtattcaaatcgcaggaattataga

SEQ ID NO: 109645 - DNA, 50 bp, homo sapien
acacacttatcaaaaatttatttaawccatattccgatattctcattggg

SEQ ID NO: 109646 - DNA, 50 bp, homo sapien
ccttaataaataccgggcacaagcaygggtgtaaagtttacagaaaaagg

SEQ ID NO: 109647 - DNA, 50 bp, homo sapien
tagagtgtatttatcacaaattatawgtattacacacattttctgaaatg

SEQ ID NO: 109648 - DNA, 50 bp, homo sapien
aacatcttctttgctcttatgaacaytgtatcctgtatctgcaatcagac

SEQ ID NO: 109649 - DNA, 50 bp, homo sapien
aatgaaaggatccaatgatttctgartagaacacagagacgagacacccc

SEQ ID NO: 109650 - DNA, 50 bp, homo sapien
tggttttgactaacacctacctgagragtgctccttggacccagggcccc

SEQ ID NO: 109651 - DNA, 50 bp, homo sapien
actagtgtgggttggctttttcagastacgaataaaaaaaaaagtgaaat

SEQ ID NO: 109652 - DNA, 50 bp, homo sapien
cagacagtgaccccgcttatagttcraaggtaagctgacaggcgtctctc

SEQ ID NO: 109653 - DNA, 50 bp, homo sapien
aaatgaaaacataaacaagtaaacawatacagtcccaactctaataataa

SEQ ID NO: 109654 - DNA, 50 bp, homo sapien
acatgtattatcttcccacgatcagyttcaagaaccttcatgattctgtc

SEQ ID NO: 109655 - DNA, 50 bp, homo sapien
aaaagtcggctaacagtgttggcaamggcacggggaaataaggtctccac

SEQ ID NO: 109656 - DNA, 50 bp, homo sapien
aaatctttgtgcgggaccagccctaygtcaactctcattctggaggaggg

SEQ ID NO: 109657 - DNA, 50 bp, homo sapien
aaagcccaggaccaagggccagaaaytagctttttatctttttataccaa

SEQ ID NO: 109658 - DNA, 50 bp, homo sapien
tttgatggaaaagaaacaattgtcgrtggtggaaataacagcagacgtag

SEQ ID NO: 109659 - DNA, 50 bp, homo sapien
accagtttgttgttagaacaatggasacactttctagggattgctgtttc

SEQ ID NO: 109660 - DNA, 50 bp, homo sapien
gcctccagtcccgaagcagcatttayacacctggcaactaaataggtatt

SEQ ID NO: 109661 - DNA, 50 bp, homo sapien
caaggcaactgacaaaccctggacargaaactatggagtgtacctgtcaa

SEQ ID NO: 109662 - DNA, 50 bp, homo sapien
tccagtgctatacagaatgtttttaragggagagcttgggaaatcacagg

SEQ ID NO: 109663 - DNA, 50 bp, homo sapien
atccaggaagtcagagaattgcctasgccagtgtgagcaagatttgacag

SEQ ID NO: 109664 - DNA, 50 bp, homo sapien
agggagaggagaaggtagaacataamgtttccatccaggttaagaaacag

SEQ ID NO: 109665 - DNA, 50 bp, homo sapien
ctgcactgtttacagattaatgacaytggtaagtataaacatagcaaagt

SEQ ID NO: 109666 - DNA, 50 bp, homo sapien
cttaacaatatactatttagtgatawgtgaataggtggaaaaactaaaga

SEQ ID NO: 109667 - DNA, 50 bp, homo sapien
agaatgtgctggagaaaaaggattawcatcttacccatctgagtacgtag

SEQ ID NO: 109668 - DNA, 50 bp, homo sapien
tttgccaataagagtataagttaggycagcaactttaacagttggcatta

SEQ ID NO: 109669 - DNA, 50 bp, homo sapien
tggtgaagaggtgagaatgtggagcratgaagattctcattctttgccaa

SEQ ID NO: 109670 - DNA, 50 bp, homo sapien
tgttttcctgttttctgtagtagaaytgcattttctcaaataacatagaa

SEQ ID NO: 109671 - DNA, 50 bp, homo sapien
ttgaggaagaatttggtatatgataygagacacataaaatcactggggaa

SEQ ID NO: 109672 - DNA, 50 bp, homo sapien
ctcttcttatcactttaacaaagaasgcgaggagacagcctctctccaag

SEQ ID NO: 109673 - DNA, 50 bp, homo sapien
gaacaagtcagactcctttgtgtaaytgcttgatgaaacattcctgtcca

SEQ ID NO: 109674 - DNA, 50 bp, homo sapien
cagggccgttttgtaaagccttgaasaagaaagcaagttcgggtttgcac

SEQ ID NO: 109675 - DNA, 50 bp, homo sapien
cagaggagactttggagattagacayggtgatgggattcccacacctgtg

SEQ ID NO: 109676 - DNA, 50 bp, homo sapien
tccatatgaaagaccaagttgcatasaaagaaaaagaaccaaaccgacac

SEQ ID NO: 109677 - DNA, 50 bp, homo sapien
cacgtgctattaagttccaaattacrggcctagaaaatcagggggaagaa

SEQ ID NO: 109678 - DNA, 50 bp, homo sapien
cttacccactggactaaaaccttgayggcagaagcttctctatcttgctt

SEQ ID NO: 109679 - DNA, 50 bp, homo sapien
ggactaaaaatcgattgatcaagcaragattttaataggtttctgccagg

SEQ ID NO: 109680 - DNA, 50 bp, homo sapien
taagcacaaatggaatataaatacartctatcttacatatagtgttacat

SEQ ID NO: 109681 - DNA, 50 bp, homo sapien
gctttttaaatctgtgtaatgcgtargtatagtttttgggcaaattttgt

SEQ ID NO: 109682 - DNA, 50 bp, homo sapien
atttcctctacggtattattttcaaytcacgcaaactggcttttcatttt

SEQ ID NO: 109683 - DNA, 50 bp, homo sapien
cactttcttgtcctcatggcaaacartaagtataatgaaggaccaggtgc

SEQ ID NO: 109684 - DNA, 50 bp, homo sapien
attcccacttctcaccattaggctgrcagagttagaggaacatgaatact

SEQ ID NO: 109685 - DNA, 50 bp, homo sapien
tgttcctccgtggtctggaatgtcayggaattttagacctaccacgagaa

SEQ ID NO: 109686 - DNA, 50 bp, homo sapien
tacatacggctttcttcatctgtccyatggataaaaggccagccagagag

SEQ ID NO: 109687 - DNA, 50 bp, homo sapien
aagtgggaatggtatttgaaatccaragaggaggacaaattgtattaaag

SEQ ID NO: 109688 - DNA, 50 bp, homo sapien
tcgtgtcccttttgcatgaaaagtayattcactgtctcccaagtttctcc

SEQ ID NO: 109689 - DNA, 50 bp, homo sapien
atctagattgcgttgggtttcgtgaygacttcttaaatgaaacaccagag

SEQ ID NO: 109690 - DNA, 50 bp, homo sapien
cttgtgagatgaaccaaaataaggakaacttgcgaatgcccagacaggga

SEQ ID NO: 109691 - DNA, 50 bp, homo sapien
ggaaaaactattgtgagtctcgaagyccaaccttttagaggatgcctggt

SEQ ID NO: 109692 - DNA, 50 bp, homo sapien
aacatgacatagttttgaattaataygaaagaggcaaaatttgacatttt

SEQ ID NO: 109693 - DNA, 50 bp, homo sapien
tggggcagagaatgcagattgattcmaaaaaaaaatcccccttgttctaa

SEQ ID NO: 109694 - DNA, 50 bp, homo sapien
atatgtggttttcttccaattcaaarcaaggagagaggacagcaagagga

SEQ ID NO: 109695 - DNA, 50 bp, homo sapien
ttgtgttactttgcaactttattgamataagatcacacatagcatatctg

SEQ ID NO: 109696 - DNA, 50 bp, homo sapien
ttaggggtttatagtcacggatacartggtcaagtagagacatggacaat

SEQ ID NO: 109697 - DNA, 50 bp, homo sapien
ctcaaccagctctgttattattagaygcagatcgttttaggtaagtggaa

SEQ ID NO: 109698 - DNA, 50 bp, homo sapien
cattggaccagattacattagtttayaacgtattagtttcagttttatca

SEQ ID NO: 109699 - DNA, 50 bp, homo sapien
atggaggaaagttaaaggactgttasacttggttcagtagcacattctgc

SEQ ID NO: 109700 - DNA, 50 bp, homo sapien
ctacataaagaaattattttgccaaygataaagccagacactagtgaaaa

SEQ ID NO: 109701 - DNA, 50 bp, homo sapien
atgaaacttctattctcagaagggaygcagaatgtgctactgaaccaagt

SEQ ID NO: 109702 - DNA, 50 bp, homo sapien
taatcaattttcccagctattttcaygtttacgatcagtgcttgtttgtt

SEQ ID NO: 109703 - DNA, 50 bp, homo sapien
agtgcaggtctttctggtccaggacragtactgggaaattcccccaaccc

SEQ ID NO: 109704 - DNA, 50 bp, homo sapien
gaaaccgacccgaggcacttcattakgctcttgtcttcctcttgcaactc

SEQ ID NO: 109705 - DNA, 50 bp, homo sapien
agtttttcttggaaatgatcatcatracttctggaactattttaacaggc

SEQ ID NO: 109706 - DNA, 50 bp, homo sapien
cagaaccattgctgacttacggttcmcaggaagaatgtgctttaacaatt

SEQ ID NO: 109707 - DNA, 50 bp, homo sapien
atgtaaggaaactggggtaaaagaayatgacgatgagagaaaagaagcgc

SEQ ID NO: 109708 - DNA, 50 bp, homo sapien
tttgtgtgctagttcatcagaaaagyaattcataatatttagtgaagagc

SEQ ID NO: 109709 - DNA, 50 bp, homo sapien
cccctttcaatagctctcttttgcartcgtatttctcaccctcttctaat

SEQ ID NO: 109710 - DNA, 50 bp, homo sapien
tactctataataaatccctgtcctawcaaataacataagcttttacttaa

SEQ ID NO: 109711 - DNA, 50 bp, homo sapien
tgcaacacacattgttaagcacgcawgtatagtatgtactgtgttagacc

SEQ ID NO: 109712 - DNA, 50 bp, homo sapien
tgaggaactattgcagaatttcttargtgaacctctgacactcatgtgga

SEQ ID NO: 109713 - DNA, 50 bp, homo sapien
atattttatagttctttccaagtcakaggtatagattactacaagttgaa

SEQ ID NO: 109714 - DNA, 50 bp, homo sapien
tcaatgacactcccaataatattgaktactgaactagacataagcataat

SEQ ID NO: 109715 - DNA, 50 bp, homo sapien
tatgctaagtgaaagaagtcagtcaytacagaccacatattatatgatgc

SEQ ID NO: 109716 - DNA, 50 bp, homo sapien
taccctttagacctcccaaagataasgaaactaactctggatgggaattg

SEQ ID NO: 109717 - DNA, 50 bp, homo sapien
aaatttattttaaaagtatgcaaagractgcaatgatttgtgcttttgtg

SEQ ID NO: 109718 - DNA, 50 bp, homo sapien
aatgagacaactataatctttcaaartacaaaggcagggcagcctagtaa

SEQ ID NO: 109719 - DNA, 50 bp, homo sapien
ccagctctgtccctttgtgtgtttayggtgtttggccagggaagtgtgtg

SEQ ID NO: 109720 - DNA, 50 bp, homo sapien
aggagtatgttttaggacaggaataktaaggttcttttgtgggtggaaaa

SEQ ID NO: 109721 - DNA, 50 bp, homo sapien
ctccttcctccacaatcaatttgcasaaagtaagaaagagcgaaactgac

SEQ ID NO: 109722 - DNA, 50 bp, homo sapien
caaaggtattgcttggcttatataawctaaaatgatcaagacggggtgag

SEQ ID NO: 109723 - DNA, 50 bp, homo sapien
atttctccacattctcatcaacactycttattaactgctgtcttttcaca

SEQ ID NO: 109724 - DNA, 50 bp, homo sapien
taaaaagctttacactcacagaaaawtaaatcagggcaatcatgtatgtg

SEQ ID NO: 109725 - DNA, 50 bp, homo sapien
agaaaggtagtgatagatgctaacakggaaataatttaaatgcactgtga

SEQ ID NO: 109726 - DNA, 50 bp, homo sapien
tctgtaggctggacactgtgctggaratttttacaaataaaaaactttac

SEQ ID NO: 109727 - DNA, 50 bp, homo sapien
acttctgaggttggctacagtgggaygtgaccagttagaatgatgcatag

SEQ ID NO: 109728 - DNA, 50 bp, homo sapien
ggtcacatggatattgatgctaccaytgatgatctctgaggaacagggca

SEQ ID NO: 109729 - DNA, 50 bp, homo sapien
agaactgacacagaatttagaatgastagatatgggcattaaaatggtat

SEQ ID NO: 109730 - DNA, 50 bp, homo sapien
gtttcctgaatccttttcaagcctgracttagaagcaacgggtaggactt

SEQ ID NO: 109731 - DNA, 50 bp, homo sapien
gtggtatataaaaagtaacatccaargtctgacacctcttctaaacatgt

SEQ ID NO: 109732 - DNA, 50 bp, homo sapien
tattatctttaatgttaatacaacastcccaaaagatggttgctaatttc

SEQ ID NO: 109733 - DNA, 50 bp, homo sapien
cctggtgactcccactcctggtgtayaagaggctccatcaatccaattat

SEQ ID NO: 109734 - DNA, 50 bp, homo sapien
aaaattgttataggctctggagatayaattgtaaagaaagcaaataaagt

SEQ ID NO: 109735 - DNA, 50 bp, homo sapien
tcatttcatgcaaccataccttgagrcagctgttatcactattcctatct

SEQ ID NO: 109736 - DNA, 50 bp, homo sapien
ggaaacgtgttccacgggttaagcgmcctactcaggaaagatcaggaaag

SEQ ID NO: 109737 - DNA, 50 bp, homo sapien
atgctatttgtttcttgaaagctaawtattccacgaacacatatctcttc

SEQ ID NO: 109738 - DNA, 50 bp, homo sapien
cactagcctcttgaatatgttgggcyacgtgacaaacatggacagaaaat

SEQ ID NO: 109739 - DNA, 50 bp, homo sapien
caaccgccattctgttctgaaaatargctgaggctgagttcctcttgaca

SEQ ID NO: 109740 - DNA, 50 bp, homo sapien
agttacacctgaaaatatctggagamgtaaactggaatcagttgtgactt

SEQ ID NO: 109741 - DNA, 50 bp, homo sapien
gatatttctcacgtagattagtaccwcaattcaaactggatgtctacgtt

SEQ ID NO: 109742 - DNA, 50 bp, homo sapien
catctcaggctaccagctaagcacaraccatggtacattaacgatccctc

SEQ ID NO: 109743 - DNA, 50 bp, homo sapien
atcctctagagagcagatccactcgsaagaattgggtgtggaaccaaagg

SEQ ID NO: 109744 - DNA, 50 bp, homo sapien
tgccctctaaatcatctcagccaatsaagcacttaatgttctctgttcct

SEQ ID NO: 109745 - DNA, 50 bp, homo sapien
cgtgatttatcactagttttaaatamggctaagttactgacttcaaaatt

SEQ ID NO: 109746 - DNA, 50 bp, homo sapien
atttttctgtatttggcctgtaaaartaaaatgagtagtggctcttaaaa

SEQ ID NO: 109747 - DNA, 50 bp, homo sapien
ttctagaaaatatgtagaaacactaycatttaaaattaacattaatgaga

SEQ ID NO: 109748 - DNA, 50 bp, homo sapien
gaagatctggaaaatgagatgttcaytggaggatttgaaaagttcttaaa

SEQ ID NO: 109749 - DNA, 50 bp, homo sapien
attaaacgtttatgggtctggtaaaygcctcacaagcagagaccatgact

SEQ ID NO: 109750 - DNA, 50 bp, homo sapien
aggttccaacacattaagagatcacyagagtctagctggagccaatcttc

SEQ ID NO: 109751 - DNA, 50 bp, homo sapien
atcaccaaacacatgatcctgaataygacagagattcactgttattgata

SEQ ID NO: 109752 - DNA, 50 bp, homo sapien
ttcccaagttgacttctgatagcaasgaaatgttttagtgaatcatggac

SEQ ID NO: 109753 - DNA, 50 bp, homo sapien
aaaagtttcagtttattagaggttcragacaacagaaaaacctctaataa

SEQ ID NO: 109754 - DNA, 50 bp, homo sapien
gatgccagaataatcttcatggggartacactaatcaaccattattcttt

SEQ ID NO: 109755 - DNA, 50 bp, homo sapien
taagtcagcaaatggaagtactaagmaatcaggtagtgtgtctaaagtct

SEQ ID NO: 109756 - DNA, 50 bp, homo sapien
tctccaatgtcaccatctcccttcaygtcaagctgggaaaactttctagt

SEQ ID NO: 109757 - DNA, 50 bp, homo sapien
tgctaaacagacatttgcactaaaayagagtagaagatgtatcaggttga

SEQ ID NO: 109758 - DNA, 50 bp, homo sapien
caggtgtgggcatccttaaagattcsctgaaaattatgaaagcaaataga

SEQ ID NO: 109759 - DNA, 50 bp, homo sapien
cagcctattcctccctgatgatcaaratttattgcctctgtcaagatgac

SEQ ID NO: 109760 - DNA, 50 bp, homo sapien
ggacaatgtacatgtggtcagcaaakgagatcttgatgtcccgactctga

SEQ ID NO: 109761 - DNA, 50 bp, homo sapien
taatgagacttctgctatgtccactrgaagaagtattcccctttgggtac

SEQ ID NO: 109762 - DNA, 50 bp, homo sapien
tgcagcttttaggacagatttcccawcctgctgcttaatttcatttctgc

SEQ ID NO: 109763 - DNA, 50 bp, homo sapien
ctggctccagatgaaaccagaaccayaaatctccaacatatatgtgccat

SEQ ID NO: 109764 - DNA, 50 bp, homo sapien
aacgtttgctttgagcttattttcaytacatatgacatcaagattaagtg

SEQ ID NO: 109765 - DNA, 50 bp, homo sapien
ctgcagtattgctattatgacacaayggtaaggaaaaaaagaataatggt

SEQ ID NO: 109766 - DNA, 50 bp, homo sapien
tagatattatcagtcccattttatasatggttttagaggaagtagttaac

SEQ ID NO: 109767 - DNA, 50 bp, homo sapien
tagcctaattagagaagtttaacatratccaacatgaaattaaaacacct

SEQ ID NO: 109768 - DNA, 50 bp, homo sapien
gtctgtaacaagaaggagtatgaaasaagtcaaatggataaattaacaat

SEQ ID NO: 109769 - DNA, 50 bp, homo sapien
tctagagtgtagtccttggaaaagarctgtgaggttacaaggtagataaa

SEQ ID NO: 109770 - DNA, 50 bp, homo sapien
tcaatttttctcccctatttccttcrcttgcgtcctctttccttgtgtca

SEQ ID NO: 109771 - DNA, 50 bp, homo sapien
gaaaaccccttcctcctgttcggaayactcccaaacagggacaggattgg

SEQ ID NO: 109772 - DNA, 50 bp, homo sapien
gcccccctgcagtaattaccattacygtaactgctgtcagctgcctccaa

SEQ ID NO: 109773 - DNA, 50 bp, homo sapien
tattacagccataactcacaaaaaayattcatggtagattaggtgcaaag

SEQ ID NO: 109774 - DNA, 50 bp, homo sapien
atacctgtatctatacacacacgcasagtctacagaaccttgtaaagtaa

SEQ ID NO: 109775 - DNA, 50 bp, homo sapien
ctatggagcctgtgatgtttcatcaytgagagaataaattcagccatttt

SEQ ID NO: 109776 - DNA, 50 bp, homo sapien
gttctatgaccaggctttagtaaaartaatcagagcgttctgtgacctgg

SEQ ID NO: 109777 - DNA, 50 bp, homo sapien
aagtaatttactgtaaaatatctgamatgctaaaatatcaaatggtgcat

SEQ ID NO: 109778 - DNA, 50 bp, homo sapien
atctgtgtagatatggttcaaaatayagcttacatataaataactgaaaa

SEQ ID NO: 109779 - DNA, 50 bp, homo sapien
agcattgtattctttcgcaaaatcawatcttcagcgcacagactacggag

SEQ ID NO: 109780 - DNA, 50 bp, homo sapien
atattggacatctgggcccttggaartacaaatctaaggaaaaaccaacc

SEQ ID NO: 109781 - DNA, 50 bp, homo sapien
cagctcctaccatctgggagaagcartctaaggagatcacaaaaagtaac

SEQ ID NO: 109782 - DNA, 50 bp, homo sapien
tttttgttttatctgattacaaaatmatacatgttcattaaaacacttta

SEQ ID NO: 109783 - DNA, 50 bp, homo sapien
tatcaccactagacataaacaccaamacattatgatatatcactcaagtc

SEQ ID NO: 109784 - DNA, 50 bp, homo sapien
agtgttaaagaaaagtcatctaaccraaaaggagtttgtgctaggtgctg

SEQ ID NO: 109785 - DNA, 50 bp, homo sapien
cgctgagttgtcttcatggctatcargtagaattaaaataattgtgcatg

SEQ ID NO: 109786 - DNA, 50 bp, homo sapien
ataagaggttatcctgattcactaarggtttcaagaatttcgctttgaca

SEQ ID NO: 109787 - DNA, 50 bp, homo sapien
aagtttgttgattaggccttgaaaamtgtaagtgattataactacttaaa

SEQ ID NO: 109788 - DNA, 50 bp, homo sapien
actgtaaaggctcagtaaagaaagcragattatgcatattcatacgatgc

SEQ ID NO: 109789 - DNA, 50 bp, homo sapien
agggcgagtatagtcagtatcaatasgtccaaaaacaagaaatgtctaaa

SEQ ID NO: 109790 - DNA, 50 bp, homo sapien
tctgttagccttttacgaaagaatascgtgaccttgaaaagcatacattt

SEQ ID NO: 109791 - DNA, 50 bp, homo sapien
ataagatgcataaaggtacactcaargatactagaagagctactgtataa

SEQ ID NO: 109792 - DNA, 50 bp, homo sapien
cccgggctggagacctgatggtttaygagattctgggagagaaaaccacg

SEQ ID NO: 109793 - DNA, 50 bp, homo sapien
tctcttctatagattggagaagtgaygacgctgagtggacagaagtagaa

SEQ ID NO: 109794 - DNA, 50 bp, homo sapien
gcgtttgtggtggtcttcttttgaawggaacagtaatttgtgtggatatt

SEQ ID NO: 109795 - DNA, 50 bp, homo sapien
catacacacacacacacagaaatcaytgaagaacaattaagcacttgaat

SEQ ID NO: 109796 - DNA, 50 bp, homo sapien
ctaaaccttgtagacaagtgagtcayctgatatgtatagaagctgtgata

SEQ ID NO: 109797 - DNA, 50 bp, homo sapien
ttgcttccacgattatctttccttaraatgctcgctctgatgttgttgtc

SEQ ID NO: 109798 - DNA, 50 bp, homo sapien
actaggcatctgctgatgttcactasctacaggaaacctttggaaggctg

SEQ ID NO: 109799 - DNA, 50 bp, homo sapien
gatactgccatattgctttactgaasgattatgccagtttataccatcat

SEQ ID NO: 109800 - DNA, 50 bp, homo sapien
tcacagctgtgaaacatactgtcaarctgttaccattttgtcacaaaaaa

SEQ ID NO: 109801 - DNA, 50 bp, homo sapien
aaaaaaaaaaatagtggtttcccaasttgccaagaatattcccattccta

SEQ ID NO: 109802 - DNA, 50 bp, homo sapien
tgctaccatccagtgaatggagtccrcggatgttgctaaatatcctagaa

SEQ ID NO: 109803 - DNA, 50 bp, homo sapien
aaaacacagggattgtggaaacctckcagtcttttcactttgttttccct

SEQ ID NO: 109804 - DNA, 50 bp, homo sapien
aattattttatgttgtccagtaccartatctttggcttgagatatttaaa

SEQ ID NO: 109805 - DNA, 50 bp, homo sapien
atttttttctggacatctccttccaygctgatggtgagaattccttaagg

SEQ ID NO: 109806 - DNA, 50 bp, homo sapien
aacccataatatagaaaaggatgacraactgctccttaatccaacctggc

SEQ ID NO: 109807 - DNA, 50 bp, homo sapien
cgggggaaaagtgactgagctttcaygtaggtaaatgatttagaaacagt

SEQ ID NO: 109808 - DNA, 50 bp, homo sapien
ctcttgaatttgaattttagtcaggratcctactgaatgtttttgtgcaa

SEQ ID NO: 109809 - DNA, 50 bp, homo sapien
tgggagtattagagttggactagatraagtttaagcttctttcattctgc

SEQ ID NO: 109810 - DNA, 50 bp, homo sapien
acatatgctgcgtatcctcccttaaktggtctttggttaatacatattcc

SEQ ID NO: 109811 - DNA, 50 bp, homo sapien
cttaatttcaattaaatgtcttctayggcaactagacaatgatcagataa

SEQ ID NO: 109812 - DNA, 50 bp, homo sapien
actttctaaatatttgtaaatttagraggacacttataactaagccaagg

SEQ ID NO: 109813 - DNA, 50 bp, homo sapien
aagggttgctgaaatatccataagcyatttttccaattcagagactgcca

SEQ ID NO: 109814 - DNA, 50 bp, homo sapien
gtctgttgcttaagccactcagtctkctgtcttgttatagcagcctaagc

SEQ ID NO: 109815 - DNA, 50 bp, homo sapien
aaacaccttatttctgatatagagaragttttaatggtctggatagaaga

SEQ ID NO: 109816 - DNA, 50 bp, homo sapien
tttcccttttcatagctgcattaaartagttctcaatgacatgcaccatt

SEQ ID NO: 109817 - DNA, 50 bp, homo sapien
cacatggaatgttcgagttctgtatyaacatgggattgttgttttctaag

SEQ ID NO: 109818 - DNA, 50 bp, homo sapien
ctagagaccgactcaagtatctggtraagtgacaaaaatgtaatgggatg

SEQ ID NO: 109819 - DNA, 50 bp, homo sapien
agggatacaatttcagcagtttacayggagagccatttccaagcagacag

SEQ ID NO: 109820 - DNA, 50 bp, homo sapien
gagatgctgtaggcaagagtagacaytgaggaagttggacagaaaagcag

SEQ ID NO: 109821 - DNA, 50 bp, homo sapien
gatcaggtttccttggaacaggctcrcacatggcctctgtcttctaaagc

SEQ ID NO: 109822 - DNA, 50 bp, homo sapien
ggaggctgaaaccaagggaatggacragagcttacaaccccaaaaactga

SEQ ID NO: 109823 - DNA, 50 bp, homo sapien
gcagacacacaggtaccagatcgacrgcagagcaggccagttagtgcctg

SEQ ID NO: 109824 - DNA, 50 bp, homo sapien
ttaatgcagtaaattataataataargaaatgctgagtaacacttataac

SEQ ID NO: 109825 - DNA, 50 bp, homo sapien
tgaaagatacaggggagtccctcaamaagaacagagataaagttgatcct

SEQ ID NO: 109826 - DNA, 50 bp, homo sapien
caatcctgatgaaagaattagaatamagggatagatgatataatgaggca

SEQ ID NO: 109827 - DNA, 50 bp, homo sapien
tctctggtctttctccatcatcagtraacagtccaggctccggaggaaac

SEQ ID NO: 109828 - DNA, 50 bp, homo sapien
tggatggattcggcatcagccacaaygacggtttgtaaaagtgctacttt

SEQ ID NO: 109829 - DNA, 50 bp, homo sapien
tgggaaggaagtcaatcttcccaaasttcttgagagcctgggacatgcca

SEQ ID NO: 109830 - DNA, 50 bp, homo sapien
aaatggaggagactaagaagccatartaactgaaggccttgtgggttcta

SEQ ID NO: 109831 - DNA, 50 bp, homo sapien
tttctcataaaacactttaaaatgaygtgtgttggatgcgtttaaaagta

SEQ ID NO: 109832 - DNA, 50 bp, homo sapien
tttattcatgctgcctggattctctsatacttagcaccaattctgtgacc

SEQ ID NO: 109833 - DNA, 50 bp, homo sapien
gacttctctagccctgacacaaggaygcagtgattagaatgctcagtaca

SEQ ID NO: 109834 - DNA, 50 bp, homo sapien
aaactgataaatggagggggtaatayagtagatcctgtgacgacatcctt

SEQ ID NO: 109835 - DNA, 50 bp, homo sapien
gtattattttttaaaaggcaagcagwcatatattattagtgcaactgtac

SEQ ID NO: 109836 - DNA, 50 bp, homo sapien
tgggttttgcaatccttccggcctaygttcaaatgccagcttcatccctt

SEQ ID NO: 109837 - DNA, 50 bp, homo sapien
tcctgtattgactgattgatgaaaaygttatgaacagtggttgtcaggaa

SEQ ID NO: 109838 - DNA, 50 bp, homo sapien
gaagcccagggtcattctaaatctamattcctcagcaaactgttttggat

SEQ ID NO: 109839 - DNA, 50 bp, homo sapien
gttgtattgaaacctattaacacccyagtactgacaagacaatgaattaa

SEQ ID NO: 109840 - DNA, 50 bp, homo sapien
gaggatgattccggctgcgcttatamaggttttcattttttgtataatat

SEQ ID NO: 109841 - DNA, 50 bp, homo sapien
cgtaccaatattaatgtcacagttargagcagcagcttaagaggaaaaca

SEQ ID NO: 109842 - DNA, 50 bp, homo sapien
aataaacagatctttgtggaagaaaragagtaagctatttaagggaaaaa

SEQ ID NO: 109843 - DNA, 50 bp, homo sapien
tgtaaaatttaacaactaacagagaytaataagcaatttttaacgctaga

SEQ ID NO: 109844 - DNA, 50 bp, homo sapien
agacatggtttatgccttctccaaayttatagtctcatagaaacattcaa

SEQ ID NO: 109845 - DNA, 50 bp, homo sapien
agccagagaaataccagacatattaycgaagtttccagcgtttttgcact

SEQ ID NO: 109846 - DNA, 50 bp, homo sapien
atgagtatttcagtgctcaattgtayggtgcagaaattccatggaaaatc

SEQ ID NO: 109847 - DNA, 50 bp, homo sapien
tgaattacatagaaggtgtaactcargaagtttcgtgaaaagttttagta

SEQ ID NO: 109848 - DNA, 50 bp, homo sapien
tgaactggaaaaaccatgaaaaaaartcaagacaacttcctgtctttgcc

SEQ ID NO: 109849 - DNA, 50 bp, homo sapien
aagacatttttagacctctaaggtayattcagcatttcaggaagccccta

SEQ ID NO: 109850 - DNA, 50 bp, homo sapien
tttccatctagaattgattttccaamtaaaccacaaattcagtataagga

SEQ ID NO: 109851 - DNA, 50 bp, homo sapien
cactatgacctgagatatagtgacamcctttaagttctaccttattgctt

SEQ ID NO: 109852 - DNA, 50 bp, homo sapien
aataaagatggcagatggttgttacyagatagaaaaactagaaattggag

SEQ ID NO: 109853 - DNA, 50 bp, homo sapien
gacatttgtacagtgtgatagagaartacattggaaaaccaaagttcaga

SEQ ID NO: 109854 - DNA, 50 bp, homo sapien
accctcaagtacagagtccatggaargccctcaataaaccattttgctga

SEQ ID NO: 109855 - DNA, 50 bp, homo sapien
ttctggtgtgtcaagtaagtatgtaygtctctttgtgaattttatccttc

SEQ ID NO: 109856 - DNA, 50 bp, homo sapien
attattatatgtactagtaaagagaygctttcagtctgcctgagatgagg

SEQ ID NO: 109857 - DNA, 50 bp, homo sapien
cgagcctggagctctctgtagtgccrgaaagcaaggatgtgctcaaagaa

SEQ ID NO: 109858 - DNA, 50 bp, homo sapien
ccttaggaattaggctaaatctactrttgaggtttactactcagaaaaaa

SEQ ID NO: 109859 - DNA, 50 bp, homo sapien
aacagtgctgtatgaagattataccratgtacacagccaacagccatgta

SEQ ID NO: 109860 - DNA, 50 bp, homo sapien
tacatactttttccctcttaaattgygaagttgtcaagtcagttgatctt

SEQ ID NO: 109861 - DNA, 50 bp, homo sapien
caaccttcccagacagactcctttarcccacctgatgtctgagtccagtg

SEQ ID NO: 109862 - DNA, 50 bp, homo sapien
cattagtgttctcaaatgtaacaccrgaagctaacagacaaaagaaacac

SEQ ID NO: 109863 - DNA, 50 bp, homo sapien
gattatgtttctttatctgtaaaacraggactatgagctctttcttctct

SEQ ID NO: 109864 - DNA, 50 bp, homo sapien
cagaagagatgcttaaatgccttgcytttcaatctttcactgttgccaag

SEQ ID NO: 109865 - DNA, 50 bp, homo sapien
ttaaagagcaatgaaaggaagaaacrcaagctggttatttataataggta

SEQ ID NO: 109866 - DNA, 50 bp, homo sapien
ggactctctggcacagaggaacattktccaactctttggaattacaaagc

SEQ ID NO: 109867 - DNA, 50 bp, homo sapien
ttcaatgtatggatgttccaaaatayattacccatttcctgctgtaacat

SEQ ID NO: 109868 - DNA, 50 bp, homo sapien
atatagaaagagccatagttagcagyaagataaacaggatgggggtgcta

SEQ ID NO: 109869 - DNA, 50 bp, homo sapien
aaaccgttaactgtggtcacacttcyggacagcaaatggggatggggttg

SEQ ID NO: 109870 - DNA, 50 bp, homo sapien
tacttgaaagtcctagcgatccacaraagcaagcaatccaatagtagccg

SEQ ID NO: 109871 - DNA, 50 bp, homo sapien
ctagacaagaaaagagactttataastggattatcttgctttccagtgtt

SEQ ID NO: 109872 - DNA, 50 bp, homo sapien
gctaactccatttcactcaacaaacygtatgattaacacaggtgtgttca

SEQ ID NO: 109873 - DNA, 50 bp, homo sapien
aaatccagtctttactcaggacaaamagataaatggcaagtgaagttttg

SEQ ID NO: 109874 - DNA, 50 bp, homo sapien
gaaaatgtatttattagagatttaamaagtatagacagaagtatacaaat

SEQ ID NO: 109875 - DNA, 50 bp, homo sapien
gactgaaatcaacatgttgacaccartggctttccattttcctttaatca

SEQ ID NO: 109876 - DNA, 50 bp, homo sapien
tgcacaagcattgtctataacttcawctgaacacttgctctaccttacac

SEQ ID NO: 109877 - DNA, 50 bp, homo sapien
aatgaaatgttggtgccctcatgcakaattctcccttttcctgaacaaca

SEQ ID NO: 109878 - DNA, 50 bp, homo sapien
agcactggaagggataaggacatgtraaggaagttggaacacagaaggaa

SEQ ID NO: 109879 - DNA, 50 bp, homo sapien
gactctaaagacctactgtattgaaytattatgtcaataataatgttaag

SEQ ID NO: 109880 - DNA, 50 bp, homo sapien
agagatttaactctctaagcgaccaycatttctgccaatgttttccaaaa

SEQ ID NO: 109881 - DNA, 50 bp, homo sapien
aagacatgtctgctagccagcagcamtggaagggataaggacatgtgaag

SEQ ID NO: 109882 - DNA, 50 bp, homo sapien
cattgtagtataaggtagtgtttgcyttcgttacatagaaaatgtataat

SEQ ID NO: 109883 - DNA, 50 bp, homo sapien
tgatgacgtggaaaaatgactctcasgagtttacgctgggatcttagttc

SEQ ID NO: 109884 - DNA, 50 bp, homo sapien
gtacccatgtcccttgttcaatgtcyctgacaagttaccacagttccacg

SEQ ID NO: 109885 - DNA, 50 bp, homo sapien
catggattttgtggtatactcacacrgtcccttacatcactgtgaacaaa

SEQ ID NO: 109886 - DNA, 50 bp, homo sapien
tgtaaattgagcataatgatacccaygaatttaccagagaagcttatagg

SEQ ID NO: 109887 - DNA, 50 bp, homo sapien
cttgtaaaaaatccatcaaggtgtasagagttagatataaggaaagagtg

SEQ ID NO: 109888 - DNA, 50 bp, homo sapien
acccagcccattattgtgttttttcratttccagttagaatccttttgag

SEQ ID NO: 109889 - DNA, 50 bp, homo sapien
atagttccccaaatgctctcttaacwcttctgagcagggatgtatctttc

SEQ ID NO: 109890 - DNA, 50 bp, homo sapien
agagaccccaaatcaaatcaggagckattaaatgactcattcaattacag

SEQ ID NO: 109891 - DNA, 50 bp, homo sapien
taagtccaatttacagaaatgcctcrcagggtgaatgaaagtgaatttct

SEQ ID NO: 109892 - DNA, 50 bp, homo sapien
ctgctggctgacgactaatcgagtarcatggtaatcctttgttttactgc

SEQ ID NO: 109893 - DNA, 50 bp, homo sapien
aaatcagttttaggtcaatcctcaaractttcttaaaaggaggtaagtag

SEQ ID NO: 109894 - DNA, 50 bp, homo sapien
catccctacagtttactcctacacaygttgcaaagtttagaggagcacaa

SEQ ID NO: 109895 - DNA, 50 bp, homo sapien
ctcccagccaagcagaccattagaaytaatctcaattacagtagctaaca

SEQ ID NO: 109896 - DNA, 50 bp, homo sapien
tctgtttctagacatgtatcttagcratggagtgtctcacagcaacagac

SEQ ID NO: 109897 - DNA, 50 bp, homo sapien
atcaggtctgactcgggccttattgraccacttgtctccacctttgttgt

SEQ ID NO: 109898 - DNA, 50 bp, homo sapien
catgtgagtgaaaggatctagattakatgctgcaccctagctgcaaggga

SEQ ID NO: 109899 - DNA, 50 bp, homo sapien
ctgcctctaatgtatgtcccctgtaytaaggcagaaaaaaatccctactg

SEQ ID NO: 109900 - DNA, 50 bp, homo sapien
atctttgattcataaggaaaccaatygtgtgatttcaaggatagtgaaga

SEQ ID NO: 109901 - DNA, 50 bp, homo sapien
tctttcagcagactggaatttcttgsagacaaggaccacgtatattttgt

SEQ ID NO: 109902 - DNA, 50 bp, homo sapien
attgattggctgagtctaatctaagyagtgaagtaactgggctggctgtt

SEQ ID NO: 109903 - DNA, 50 bp, homo sapien
tacatctcaatcatcctgccttttaycatttctcttcccctttcaaaacc

SEQ ID NO: 109904 - DNA, 50 bp, homo sapien
gtgacaataactctgtcttcttctastactgtacatttaagtcaaatttc

SEQ ID NO: 109905 - DNA, 50 bp, homo sapien
gatatccattttccaggccacaataygtatgttctgaggtctaaagtcaa

SEQ ID NO: 109906 - DNA, 50 bp, homo sapien
gatattatttaaatcttctcctttarcatgttttctctcacatccagcta

SEQ ID NO: 109907 - DNA, 50 bp, homo sapien
atggcgatgctctccatatggcatargttgcaataatgatctaccccagt

SEQ ID NO: 109908 - DNA, 50 bp, homo sapien
ctgataagttttttgaaaggctgtaygtagtcattaaaaagtatgtgata

SEQ ID NO: 109909 - DNA, 50 bp, homo sapien
tcagccaaaaacatagaaagcctcakcaaagaaatagaagctatcaagag

SEQ ID NO: 109910 - DNA, 50 bp, homo sapien
acctatgtctggaatgctgtagtaaytcaccactgtagcctcgttcactt

SEQ ID NO: 109911 - DNA, 50 bp, homo sapien
gaaaaagacaataactgaaataaaamtctcaatgaatgggctcaatagca

SEQ ID NO: 109912 - DNA, 50 bp, homo sapien
ccttatcgagaaatgcaggtctgtarcggtgagataaggtctctctagct

SEQ ID NO: 109913 - DNA, 50 bp, homo sapien
gaaaatttctgcaaatgaattaagcratgcctgttaggccacattaatgg

SEQ ID NO: 109914 - DNA, 50 bp, homo sapien
ttctttgcacccaatagccattgtayagtaataagtgtctttaaataaag

SEQ ID NO: 109915 - DNA, 50 bp, homo sapien
agtaacaaccacaaaaggctaaagaktatacaagggtgttttacattttc

SEQ ID NO: 109916 - DNA, 50 bp, homo sapien
catcagccatgtatgtacatacagasaaagaaagggaaaataacacaaat

SEQ ID NO: 109917 - DNA, 50 bp, homo sapien
aggaggtcgatgagcagatgtttaamgtgcagaacaagaacagcagctac

SEQ ID NO: 109918 - DNA, 50 bp, homo sapien
taacatgtgagtaggaaatgaataarcagggaaactaatccattccaaca

SEQ ID NO: 109919 - DNA, 50 bp, homo sapien
gtagcgtgagaagaaaaagatgaacygtctgtgcggagcaaagagaaatg

SEQ ID NO: 109920 - DNA, 50 bp, homo sapien
ttcaaataatttttgattttggtccrcaggttccctggtgaagactctag

SEQ ID NO: 109921 - DNA, 50 bp, homo sapien
cccaaagggtgtctggtttctgtagragctgggctgatgcaattatctag

SEQ ID NO: 109922 - DNA, 50 bp, homo sapien
taaccctggagcactactgttaatgratatactgcttgtcccatatgaat

SEQ ID NO: 109923 - DNA, 50 bp, homo sapien
ttacctgacatagccttaacataacycttaacagagccctgtctgtaaga

SEQ ID NO: 109924 - DNA, 50 bp, homo sapien
ctctgtgagcacaagtacacaggacratacttgtgatggttaatattgag

SEQ ID NO: 109925 - DNA, 50 bp, homo sapien
gtggctgtttgttaccatggctacakaacaatcagtctttccctaaattt

SEQ ID NO: 109926 - DNA, 50 bp, homo sapien
cccacccacagcagtgtctcaaatgyaccctttctggtcatgccagggaa

SEQ ID NO: 109927 - DNA, 50 bp, homo sapien
catgttcactgaggctagttctcacraattaatggaacagatttaaaatt

SEQ ID NO: 109928 - DNA, 50 bp, homo sapien
tgcttgaagcaagggttgcataacargtctaggaaacgtctggccgtgtg

SEQ ID NO: 109929 - DNA, 50 bp, homo sapien
ttcaagagcaccttctgtgagccaayttgagcctccagaatgactaacca

SEQ ID NO: 109930 - DNA, 50 bp, homo sapien
aaggtcagaaaccggacattgagtayatcttcctgcagagatgcccctgg

SEQ ID NO: 109931 - DNA, 50 bp, homo sapien
taatatgattgctttttgttgcttgrataagttaatcacatgtatgactt

SEQ ID NO: 109932 - DNA, 50 bp, homo sapien
aatctaaacatttgtttttagactakacagtatccacaaaatagggaata

SEQ ID NO: 109933 - DNA, 50 bp, homo sapien
gcagctacatggaatttcaaatgacracttagacaaagatatttaccaaa

SEQ ID NO: 109934 - DNA, 50 bp, homo sapien
tctgtctggctcctctggactcaaamctactcaatgcaagattgcgctga

SEQ ID NO: 109935 - DNA, 50 bp, homo sapien
ccttatttaaggttgaaaaagacatsacggaaagatatgtcacaaggtct

SEQ ID NO: 109936 - DNA, 50 bp, homo sapien
attgtctagaggctgaatccaagatyataaacccaagttacagagaaaat

SEQ ID NO: 109937 - DNA, 50 bp, homo sapien
taacttaggtcacaactggtgatacygtttgacctaagtgtttacttttc

SEQ ID NO: 109938 - DNA, 50 bp, homo sapien
tagttaatcctatgctttgtgaatgyctgttaacttaggtcacaactggt

SEQ ID NO: 109939 - DNA, 50 bp, homo sapien
aagatccgtgaaagtgataaacctcyaatccaatgcttctcatttggagg

SEQ ID NO: 109940 - DNA, 50 bp, homo sapien
cagtggctctgagcaaataaatagaratgaacagtgacttgccagaagag

SEQ ID NO: 109941 - DNA, 50 bp, homo sapien
agctacaggctgacctgatgaataargatcacacagagaacctggacttt

SEQ ID NO: 109942 - DNA, 50 bp, homo sapien
accactcacccactgactcacctgaygcaatggccagtcctgcaaactgc

SEQ ID NO: 109943 - DNA, 50 bp, homo sapien
tcagtacagcatcacattccaacatrtattagtctgccatctaaaaataa

SEQ ID NO: 109944 - DNA, 50 bp, homo sapien
ttttaaagatatattgaaatgatcaraggataaaaaatattaggagaaaa

SEQ ID NO: 109945 - DNA, 50 bp, homo sapien
acatccaggggtgtctttgaaacaayagagataccagaagctctacatgt

SEQ ID NO: 109946 - DNA, 50 bp, homo sapien
tcttaaataaactacatatttaaacraagcattattatttaactacttac

SEQ ID NO: 109947 - DNA, 50 bp, homo sapien
tctcatttcaacatcatggcagtaargtaaagtaggaattattgttgaga

SEQ ID NO: 109948 - DNA, 50 bp, homo sapien
gagccctgttctcacgtggctctctsaattgcgcagaagcaagttgcacg

SEQ ID NO: 109949 - DNA, 50 bp, homo sapien
tgtgatgcagttacaacacaaagaasaagaccgacatgaatacttgactc

SEQ ID NO: 109950 - DNA, 50 bp, homo sapien
agggttaccataacccacacctggaygtatcaaagaaaactgtgcatcta

SEQ ID NO: 109951 - DNA, 50 bp, homo sapien
atgtgccgggaactggagctgaaagkattggcaggatccaggattttcac

SEQ ID NO: 109952 - DNA, 50 bp, homo sapien
agtattggtcagattttgttgttccmgattagaatgcttaaatggtttcg

SEQ ID NO: 109953 - DNA, 50 bp, homo sapien
cagcccatagccattggttaataaakgttgtccaaatgagaaaggggatc

SEQ ID NO: 109954 - DNA, 50 bp, homo sapien
tcctttcgttcttatcctatgttcayagcaatgttttgacctggttttcc

SEQ ID NO: 109955 - DNA, 50 bp, homo sapien
aactgctgttttactgaggttagaayaggttttgctgtggtaacacagac

SEQ ID NO: 109956 - DNA, 50 bp, homo sapien
aaaatgtattatttagtcaaaaaaasaattacctaacatgtatgtttttt

SEQ ID NO: 109957 - DNA, 50 bp, homo sapien
tctgtctaaagtaatactgggtaagycatagtcacgtaaggagcttcaag

SEQ ID NO: 109958 - DNA, 50 bp, homo sapien
agaagagcctgcatttcttcttgcasgcagagtagcttgtttttgcattg

SEQ ID NO: 109959 - DNA, 50 bp, homo sapien
ccatacagaaaatgattaggcaagcsacaaattaaaaaaataatttacaa

SEQ ID NO: 109960 - DNA, 50 bp, homo sapien
tataaatataaaagcacaagcacaaktcactgttgtaagcatctggtggg

SEQ ID NO: 109961 - DNA, 50 bp, homo sapien
ttatttcaaacatgaaaagagtctayaagtaatttgatatttgaagatta

SEQ ID NO: 109962 - DNA, 50 bp, homo sapien
cctccctctttgctgttggaccagcrcagggcttctttgtctgtcttctg

SEQ ID NO: 109963 - DNA, 50 bp, homo sapien
taaaagacccttacccatatggaaakctttaagaacatacgaacaccatg

SEQ ID NO: 109964 - DNA, 50 bp, homo sapien
gttttctcaaatatgaaatgagaaasaacacctgccttttctcaccttca

SEQ ID NO: 109965 - DNA, 50 bp, homo sapien
gtgctgttaacctaaacagctctaayaatcaagcacattgcctctgatac

SEQ ID NO: 109966 - DNA, 50 bp, homo sapien
tgctacaactgcagacttagaaaaaygtggtcactcttgaggtggctaaa

SEQ ID NO: 109967 - DNA, 50 bp, homo sapien
tgaatggctcttgcaaaccttaacaygcaaagctaatgacagattgtatc

SEQ ID NO: 109968 - DNA, 50 bp, homo sapien
attctggaaatcataggactgtgaamaagaaaagacctgagagatctcat

SEQ ID NO: 109969 - DNA, 50 bp, homo sapien
gaggagtgtttgtgtgtcagacttaygctggtgttgaggccctagaaagg

SEQ ID NO: 109970 - DNA, 50 bp, homo sapien
atctcattttgttgttgttcctgtcrtgaatggagtcttatttcattata

SEQ ID NO: 109971 - DNA, 50 bp, homo sapien
agaaggtcaggggttcagtcactcasagattccacctgggtgtgaaagta

SEQ ID NO: 109972 - DNA, 50 bp, homo sapien
aagtcagccgtcattgtcccctataygtaatgtgccttttttcctctggc

SEQ ID NO: 109973 - DNA, 50 bp, homo sapien
ttaccaatacagtggaaagagcaggracttggcgttgatatggattcaag

SEQ ID NO: 109974 - DNA, 50 bp, homo sapien
ggtcagctggaatttgaccagataargttcccatgtatcctttttggcag

SEQ ID NO: 109975 - DNA, 50 bp, homo sapien
tcctctccctgaaataagaaataccrgcttctgtttatggaacttgtggg

SEQ ID NO: 109976 - DNA, 50 bp, homo sapien
cattcaaatgctgccctaaattagarcatggcttttcaaattctccatct

SEQ ID NO: 109977 - DNA, 50 bp, homo sapien
tctagatattctgtcatgtttctaaraccgtgtacttcgatttcaggatg

SEQ ID NO: 109978 - DNA, 50 bp, homo sapien
acctcaaagttccccacggtctgcaygggactgagcttggagaggagagc

SEQ ID NO: 109979 - DNA, 50 bp, homo sapien
agacctcaaaaacttcagtgacttamaacaaccaaggcttattactcaag

SEQ ID NO: 109980 - DNA, 50 bp, homo sapien
gaaaataccagcatttgactcccacsagataaacaatgtcagctgtggac

SEQ ID NO: 109981 - DNA, 50 bp, homo sapien
tctgtaatgtgagagataactgttamgcaaccttattggtttttaagcaa

SEQ ID NO: 109982 - DNA, 50 bp, homo sapien
tttattctaccgtataatcctaataytagatcacaaagaaacatcaaact

SEQ ID NO: 109983 - DNA, 50 bp, homo sapien
tgatgcatcctaaaagagtaattggycatccttctttagctatttcaaag

SEQ ID NO: 109984 - DNA, 50 bp, homo sapien
cttctcttctcactttctgtttgacrctgaggaagttggtgagagcttct

SEQ ID NO: 109985 - DNA, 50 bp, homo sapien
aatcattggccaaactgcaggatctraattgcctatatggtctctatttt

SEQ ID NO: 109986 - DNA, 50 bp, homo sapien
gttacccgtatacctacaatcctaayaaagccaattcccacacacacatt

SEQ ID NO: 109987 - DNA, 50 bp, homo sapien
accgatgaagcagtggtgtatcaccraggataggaaacttgttcaaggca

SEQ ID NO: 109988 - DNA, 50 bp, homo sapien
tgttcttttcaaactctcttctctayctggcaggttctctgacgatccag

SEQ ID NO: 109989 - DNA, 50 bp, homo sapien
gcttctcttgggttctctcaatgcamatctctgttatggcaattatctga

SEQ ID NO: 109990 - DNA, 50 bp, homo sapien
gtctatcttacttcacaactggagcrctatttaacacaccttaggattgt

SEQ ID NO: 109991 - DNA, 50 bp, homo sapien
attccaaagagcaaattctaggtaawcacttgccaaaatcctgtactctt

SEQ ID NO: 109992 - DNA, 50 bp, homo sapien
tcagttattgaagagatggtaggcartgagtctggcacgttctatgggaa

SEQ ID NO: 109993 - DNA, 50 bp, homo sapien
tacagagactttgtatatcattatargttaaagcatcattatcttcacat

SEQ ID NO: 109994 - DNA, 50 bp, homo sapien
aatgtaaatggctgcacataacccasagttctggacaatcagtgcacatc

SEQ ID NO: 109995 - DNA, 50 bp, homo sapien
aggcccaaatcttttctgttttcacrcatactccatatccaattcatcta

SEQ ID NO: 109996 - DNA, 50 bp, homo sapien
tttgtgttaactgtcttttaaacaaygctctgagactgcacacttaggtt

SEQ ID NO: 109997 - DNA, 50 bp, homo sapien
gggacctgagtctgaatttggtgctstaagaaccaagaaaaccatgaggg

SEQ ID NO: 109998 - DNA, 50 bp, homo sapien
tgggaaaataatccaagttgaatgcracaaagacaacagagacaaaaaaa

SEQ ID NO: 109999 - DNA, 50 bp, homo sapien
aactaggataaactcaaactcttacrgacagaatattcactaggcagtgt

SEQ ID NO: 110000 - DNA, 50 bp, homo sapien
cttgcctctctagaaaaactggaaaytgctggagggaagcaacttatatt

SEQ ID NO: 110001 - DNA, 50 bp, homo sapien
ataaagttgtctaaaccatggcacarcaattatttgaaaagtgagggatt

SEQ ID NO: 110002 - DNA, 50 bp, homo sapien
cagaagatacttccagggaataaaamagtgagccaagaagtaaaatcaat

SEQ ID NO: 110003 - DNA, 50 bp, homo sapien
aaaataattaaaggataagagaacawatattgtaacaaacaccctacata

SEQ ID NO: 110004 - DNA, 50 bp, homo sapien
tttgatgcaggtccaagtaaagtcartacatcttaattgagctcagcatg

SEQ ID NO: 110005 - DNA, 50 bp, homo sapien
gagggcaagtgattcagttattggakaggcaaatataacaaatggtcaca

SEQ ID NO: 110006 - DNA, 50 bp, homo sapien
gaagggactctcttccatttaagcayggattcagaccgtggcaagctgtc

SEQ ID NO: 110007 - DNA, 50 bp, homo sapien
gttgtaaaaagatacagtggagagcrcagatttaaatggtgagccttgat

SEQ ID NO: 110008 - DNA, 50 bp, homo sapien
actttcaagacacattatttctctaygcaaacaaaacaccaggctttgct

SEQ ID NO: 110009 - DNA, 50 bp, homo sapien
caaagactcagttgggataagagacraggtatccagctcccagaacaaaa

SEQ ID NO: 110010 - DNA, 50 bp, homo sapien
ggcacagattaggagctgccaaaagsccagagttaacctgcaagaggacc

SEQ ID NO: 110011 - DNA, 50 bp, homo sapien
tagccacagagggattgatgtttacygcaaagagcctggagtcagaagat

SEQ ID NO: 110012 - DNA, 50 bp, homo sapien
cacgttttctttcatcttgtgtttgsacattagccacagagggattgatg

SEQ ID NO: 110013 - DNA, 50 bp, homo sapien
tctagagattacattaatgtactggraaagagattaaaatgactaataaa

SEQ ID NO: 110014 - DNA, 50 bp, homo sapien
acattagccataacaaaaacatacaytgccaggtctccttcgtagaaaaa

SEQ ID NO: 110015 - DNA, 50 bp, homo sapien
tcatttcatgcagcagcgaaattccyaaaaagtgttcttccagttttggt

SEQ ID NO: 110016 - DNA, 50 bp, homo sapien
tctgaaggacaacaggaaggaatgargagttggaatacctgaagttttga

SEQ ID NO: 110017 - DNA, 50 bp, homo sapien
gatctacacaaccatgtggtgctacygcttttaaaatctgtgaacaatta

SEQ ID NO: 110018 - DNA, 50 bp, homo sapien
tttccatcctatttatctctcttgaytcaaaaaaagagaaatcagttcta

SEQ ID NO: 110019 - DNA, 50 bp, homo sapien
catgactatcgttatcattagtttasagaaagttttgagatttctcttgt

SEQ ID NO: 110020 - DNA, 50 bp, homo sapien
tatacttaccttctctgaaatctgasaaacagcccactcaaaaacacagc

SEQ ID NO: 110021 - DNA, 50 bp, homo sapien
agaaacattacagctggggagattcracattcccaatatatagattccat

SEQ ID NO: 110022 - DNA, 50 bp, homo sapien
ttgacccaagagttgacaaaaaataragtgcaggaaaagcacagataaat

SEQ ID NO: 110023 - DNA, 50 bp, homo sapien
tttggtaggtcacctaatatagataygtcacctgtaactatcacctacct

SEQ ID NO: 110024 - DNA, 50 bp, homo sapien
tgctatcctcgatagctattatccamtcccacatcgtcatggttaaaagt

SEQ ID NO: 110025 - DNA, 50 bp, homo sapien
aaagctacactggacataacaccacmgaacttttgaatatccccttttcc

SEQ ID NO: 110026 - DNA, 50 bp, homo sapien
aacaaccttctagatgcttattttcyaccttttcctacagaaggtaatat

SEQ ID NO: 110027 - DNA, 50 bp, homo sapien
ctatgcactggctgtcattcctacargccagtataataacacagtcatac

SEQ ID NO: 110028 - DNA, 50 bp, homo sapien
ggaacgaataaagtagaaagactagyagagttcatcatccttgaataaga

SEQ ID NO: 110029 - DNA, 50 bp, homo sapien
cctcccagccaggctgtaggaaatakctgttaccttgcctagttcttcac

SEQ ID NO: 110030 - DNA, 50 bp, homo sapien
tcaatgaggacttcactaattaagcyatgaattaaaaccaaagtaagaaa

SEQ ID NO: 110031 - DNA, 50 bp, homo sapien
tctctacctaagagatgagaaattgmagtaggaacatttacggtccttga

SEQ ID NO: 110032 - DNA, 50 bp, homo sapien
agtgtttgagaaaaactcgtaaaaawtgattttgccctaggcttaacatt

SEQ ID NO: 110033 - DNA, 50 bp, homo sapien
ggactaaggctgcatggctcacccasaagtcagtgaagactgggctataa

SEQ ID NO: 110034 - DNA, 50 bp, homo sapien
cttaagatttcttggttgaagagaartatgagcacaactttcttggactg

SEQ ID NO: 110035 - DNA, 50 bp, homo sapien
aaaaccaagacaagttccctatgatyaaacttatgacttaagatttcttg

SEQ ID NO: 110036 - DNA, 50 bp, homo sapien
cagaaagcccatgtgaccaggataayaaggcttggttttactctgagcct

SEQ ID NO: 110037 - DNA, 50 bp, homo sapien
tctttctccttggagctcaaggataragaggagaattgctgtcattggac

SEQ ID NO: 110038 - DNA, 50 bp, homo sapien
agtgagttaaattcgaccatttaatrtacaactcccataacaaagaatgt

SEQ ID NO: 110039 - DNA, 50 bp, homo sapien
ctcaaaaatgtgttatacttcctgayagagatggcagaatgattacagac

SEQ ID NO: 110040 - DNA, 50 bp, homo sapien
aatgccccaggagtacttagtgagtyaaattcgaccatttaatatacaac

SEQ ID NO: 110041 - DNA, 50 bp, homo sapien
atgtcacagtttccaaccgattgaarttcaactctttttacaatcccccc

SEQ ID NO: 110042 - DNA, 50 bp, homo sapien
atgtttgttttttttcctgtttatcragtatggccaagtagattgttaaa

SEQ ID NO: 110043 - DNA, 50 bp, homo sapien
ctcagacacgcttcctaaaatcatcrgaggtgcttgcacaaattcagcta

SEQ ID NO: 110044 - DNA, 50 bp, homo sapien
gggacttcaaacctagatctacctaycaaaacattataccaatccctcat

SEQ ID NO: 110045 - DNA, 50 bp, homo sapien
gacacatagtgtgtaatattatctcracaatctatactcatcaactggaa

SEQ ID NO: 110046 - DNA, 50 bp, homo sapien
cttgaataagggccattttgggcaakaagatacagatgtaaaaagaatga

SEQ ID NO: 110047 - DNA, 50 bp, homo sapien
ttctacagacggcatgcgatctaggyataaagaggagagattgctcatga

SEQ ID NO: 110048 - DNA, 50 bp, homo sapien
accttgacaatttggggctttaagaraagatttggcaaagtgccttttcc

SEQ ID NO: 110049 - DNA, 50 bp, homo sapien
aaagccaccacctgtaataaattgcragcaaagaaagacacctgggctgt

SEQ ID NO: 110050 - DNA, 50 bp, homo sapien
tttttctttggtatatacgcagtcgyatgcttgagtttcagtttatattt

SEQ ID NO: 110051 - DNA, 50 bp, homo sapien
ggctgtcaagatctaacatcaccaargctagcccaccactcccagtctaa

SEQ ID NO: 110052 - DNA, 50 bp, homo sapien
gctttcaccaaggttgcttgacaacrtgctttcccaggggttaacactgc

SEQ ID NO: 110053 - DNA, 50 bp, homo sapien
atcttggctagtgaatgcatactccrgaatgtgagaggagctgtatttca

SEQ ID NO: 110054 - DNA, 50 bp, homo sapien
agtggaggtattatgggcagtttagrcctcttccagagctgtacactgaa

SEQ ID NO: 110055 - DNA, 50 bp, homo sapien
tcacggctgtcattatctctgtttayagatcaagtctttcccaacctcac

SEQ ID NO: 110056 - DNA, 50 bp, homo sapien
tttaacaacatgcgctcggctgttcracagaaaatggaattatcacatct

SEQ ID NO: 110057 - DNA, 50 bp, homo sapien
gatgcaattgcaattattctggaaarctcatcattaaccttcctcatgag

SEQ ID NO: 110058 - DNA, 50 bp, homo sapien
atcaggtatttacataccccaattasctgtgaatgacattgagtcccaca

SEQ ID NO: 110059 - DNA, 50 bp, homo sapien
ggcactgtggaaaaatttggaggtayaagtgtaattggacaaatggctgg

SEQ ID NO: 110060 - DNA, 50 bp, homo sapien
cactctgctaagatataaagttgcayaatgtttggatcttgtcctcaaag

SEQ ID NO: 110061 - DNA, 50 bp, homo sapien
tcactcaacctatccaaatattatasatgtgtttattttgtacctactgt

SEQ ID NO: 110062 - DNA, 50 bp, homo sapien
tggctcaatgattcactcattcaccrcatatttgtttaattgaattatat

SEQ ID NO: 110063 - DNA, 50 bp, homo sapien
ggtgattcatatggaagtattgagargagaaacatcatagtttaaaaaag

SEQ ID NO: 110064 - DNA, 50 bp, homo sapien
tactgtagtaagacattaacatggasacagagtgtatagtatatttcacc

SEQ ID NO: 110065 - DNA, 50 bp, homo sapien
aaaaatatctgaatatgtgctataaraatacaagtaaacattaaaactgg

SEQ ID NO: 110066 - DNA, 50 bp, homo sapien
cttctcaatacttccatatgaatcaycttcagaaaatgaaagtaatgcac

SEQ ID NO: 110067 - DNA, 50 bp, homo sapien
tgtggcttattttttatgcttagaawtatgctcgatgcactctatgtaag

SEQ ID NO: 110068 - DNA, 50 bp, homo sapien
ccaataccatattgacaggtaaatckctagtgagtgaatatattattatc

SEQ ID NO: 110069 - DNA, 50 bp, homo sapien
caagtttatattggactgacagaaartgtgctgtgcacaaactgagatga

SEQ ID NO: 110070 - DNA, 50 bp, homo sapien
gtatacacgactcaaagcatttcaakttctgaatttgtacagacctaatc

SEQ ID NO: 110071 - DNA, 50 bp, homo sapien
ctggctaattttataaaatttgaacygcactatatgaatgaagaatcatc

SEQ ID NO: 110072 - DNA, 50 bp, homo sapien
tcactgctatacactaaagaaaacakcaatttcagaaaaattcagggaat

SEQ ID NO: 110073 - DNA, 50 bp, homo sapien
ctttttattttctgttcatgtcttgkactttgaataattacaattttgtt

SEQ ID NO: 110074 - DNA, 50 bp, homo sapien
taattcatgataataataatttcacragaaagcctggaagccttaggagt

SEQ ID NO: 110075 - DNA, 50 bp, homo sapien
cacagctgaatttactatattttagrcaaaggaagctcactgtctcttca

SEQ ID NO: 110076 - DNA, 50 bp, homo sapien
caaaaatgccaatgaaaacaatgaaytacctggtttcggctaagagagtg

SEQ ID NO: 110077 - DNA, 50 bp, homo sapien
actttaaaatgttcactctaaaataytaagctagttaacattctttaaat

SEQ ID NO: 110078 - DNA, 50 bp, homo sapien
gttgcatccacagggtagatgttacyagtagtgttctcctaactctagga

SEQ ID NO: 110079 - DNA, 50 bp, homo sapien
tgtagctgcattttactaccaggaartgtcataacaattcttttcaaaat

SEQ ID NO: 110080 - DNA, 50 bp, homo sapien
aggcttctccttacacttaaatagakaccttcaaacctggcttaccaagc

SEQ ID NO: 110081 - DNA, 50 bp, homo sapien
gctgtgtttttccagcattgtccaakctaagaagacactgaatctgtaag

SEQ ID NO: 110082 - DNA, 50 bp, homo sapien
aaaataaaaaatctgaaagagtctckaaaattcttcctttacaaaacttt

SEQ ID NO: 110083 - DNA, 50 bp, homo sapien
cactatgaagttaatttgctttcctktaccagacacctctgagctgatta

SEQ ID NO: 110084 - DNA, 50 bp, homo sapien
atcattttcttctcatacaaggagamctggcattttgttttgggggtagg

SEQ ID NO: 110085 - DNA, 50 bp, homo sapien
cgggagtaagtcattcatgggatgcrttttctaaacaacctttccatgtc

SEQ ID NO: 110086 - DNA, 50 bp, homo sapien
ttattgcaaaacaagtcatttatgawtcacatttgtaagcattattcagt

SEQ ID NO: 110087 - DNA, 50 bp, homo sapien
actcaggggatttcttaggttctgcraatggtcaataccttaatctggca

SEQ ID NO: 110088 - DNA, 50 bp, homo sapien
gtaggagggaaagctagaattaatamgtgccactggattagagttggaga

SEQ ID NO: 110089 - DNA, 50 bp, homo sapien
gagttttatattatttacaagatccygcatgtgaggtacactgggcccta

SEQ ID NO: 110090 - DNA, 50 bp, homo sapien
gtggaaaaatagtgcaacatagagayactgagcatacaatgagaaataga

SEQ ID NO: 110091 - DNA, 50 bp, homo sapien
ttaaaagcaagaaaaataattgaaartaatgacaatagctaaacacacgt

SEQ ID NO: 110092 - DNA, 50 bp, homo sapien
ttatgtctttaactgtctataaaatsatattaatgactatagaatgttgt

SEQ ID NO: 110093 - DNA, 50 bp, homo sapien
atcaagtctcagaatcagaactgttyaacttccaagcaaatgaaattact

SEQ ID NO: 110094 - DNA, 50 bp, homo sapien
tcacaattcaatgttttagcatataycatcaggcaaaactatcaattttg

SEQ ID NO: 110095 - DNA, 50 bp, homo sapien
atcccatgctcatcatgaatgagaastggataatgagcatctatccagaa

SEQ ID NO: 110096 - DNA, 50 bp, homo sapien
acaactaatgagagtttgtgaccgtyaattgttgaaacttcactgtacag

SEQ ID NO: 110097 - DNA, 50 bp, homo sapien
ggcagagggaatagtctgagatgaayagataaagatgttccaaaatacga

SEQ ID NO: 110098 - DNA, 50 bp, homo sapien
cccaaaagacgccagggtgagcacaytggaataaatactgagaagaacag

SEQ ID NO: 110099 - DNA, 50 bp, homo sapien
aacaattggatagggaggttaggcascgaatgctcacttcctccaaaata

SEQ ID NO: 110100 - DNA, 50 bp, homo sapien
aggtgaaaaaattactgtttaatgayaaaaataagttgcaaagagtatgt

SEQ ID NO: 110101 - DNA, 50 bp, homo sapien
accttgtatattacttattactttayactttatgtgagtactttatattc

SEQ ID NO: 110102 - DNA, 50 bp, homo sapien
ctgactcacttgaatatgaactttgyatcaaaatggtaaggcctcatttc

SEQ ID NO: 110103 - DNA, 50 bp, homo sapien
aaataatccatcagtgaaaggagaaratgctgccttgtgtgtggctgtgt

SEQ ID NO: 110104 - DNA, 50 bp, homo sapien
tgctgtttcaacaagctaagttgcayttgaattttgaaatacccactcta

SEQ ID NO: 110105 - DNA, 50 bp, homo sapien
ggctttgatttgtttttcattctaaygctatctaacaaggggatgttctg

SEQ ID NO: 110106 - DNA, 50 bp, homo sapien
aatattttcccaggtcatccagtacrctttcacggcctttggtggcttat

SEQ ID NO: 110107 - DNA, 50 bp, homo sapien
gaaaaaacagagtcaatgcggaaaaygctgccaagacaacattttcttct

SEQ ID NO: 110108 - DNA, 50 bp, homo sapien
agacagaggtgagaaaaagggataayggaaggagtggaaatggatggtgg

SEQ ID NO: 110109 - DNA, 50 bp, homo sapien
taaaatactaaagagagtgattgccrgataatatggtaagagcatattta

SEQ ID NO: 110110 - DNA, 50 bp, homo sapien
tcatctacttctcctttatcacaagmaaatttgttaatcaggcatttacc

SEQ ID NO: 110111 - DNA, 50 bp, homo sapien
atttcttttaactgtaaaatgtggcyaacacgatctaccaggtagcatct

SEQ ID NO: 110112 - DNA, 50 bp, homo sapien
gagtgtgtttcatgacagcacagaayttatctactttgtttattgcaatg

SEQ ID NO: 110113 - DNA, 50 bp, homo sapien
ggccccttaccaggtggtctctctayatttcagagctgatctcttgagta

SEQ ID NO: 110114 - DNA, 50 bp, homo sapien
gggagtctatcaccactgctacttayatcgaatgctttacacaagtttca

SEQ ID NO: 110115 - DNA, 50 bp, homo sapien
tactttgagataaatcatctcattcyataccaaagaaaaatacaatacta

SEQ ID NO: 110116 - DNA, 50 bp, homo sapien
tattttgtaacttctataatgctaakgtttctctgctttccaacacacct

SEQ ID NO: 110117 - DNA, 50 bp, homo sapien
tcttagataaaattactaacagataygcttgtctacttgtattcattgca

SEQ ID NO: 110118 - DNA, 50 bp, homo sapien
tagaaatcagaaaagggattgaatamcctaaagcggctgttcatggccct

SEQ ID NO: 110119 - DNA, 50 bp, homo sapien
gcttgagaatcagtgacttgagagawcataactccttatacatgtgggtg

SEQ ID NO: 110120 - DNA, 50 bp, homo sapien
gaatgggggaggactaagaatgagayggatgcagagagcagcccagaggt

SEQ ID NO: 110121 - DNA, 50 bp, homo sapien
attgatatttaaatgtcaagcaactraaagagtgagtgtctgtgcaaaag

SEQ ID NO: 110122 - DNA, 50 bp, homo sapien
attttcataatgtttactttttaggrcaaaacagtagctaaattaaagta

SEQ ID NO: 110123 - DNA, 50 bp, homo sapien
gactaaaggtaggaagactaggaggwaggaaactgactaattatgcaatt

SEQ ID NO: 110124 - DNA, 50 bp, homo sapien
gggtctcctttagacgttatttccayagagtggtttccttttgccatgat

SEQ ID NO: 110125 - DNA, 50 bp, homo sapien
ggacattactcaaaaagtaataatcyatgtaactcaaaggtaataatcta

SEQ ID NO: 110126 - DNA, 50 bp, homo sapien
ctgttccatctctctcaatggaaaasttgtcattttataatcacagtatt

SEQ ID NO: 110127 - DNA, 50 bp, homo sapien
aatgcaaggttttgttactaaaaatmaccacttaacacacaagaaaagga

SEQ ID NO: 110128 - DNA, 50 bp, homo sapien
gctagtggaacaatttagctatgttmaaacagacagtaagataaacactg

SEQ ID NO: 110129 - DNA, 50 bp, homo sapien
gaagcccctcatctcctcacatttgratgcagcacaaatttcctgcttag

SEQ ID NO: 110130 - DNA, 50 bp, homo sapien
tctctctaattcatgtgagaatgaasaacagcacctcttaaaaaaaaaat

SEQ ID NO: 110131 - DNA, 50 bp, homo sapien
aaaaaaaaaaaaagcaatttaaccarggactattgtaataggggaaaaga

SEQ ID NO: 110132 - DNA, 50 bp, homo sapien
gaagactgttaaaataatctgggcaraggatgttatggttgtgagctaag

SEQ ID NO: 110133 - DNA, 50 bp, homo sapien
ttttttaatgtctaaaaaatgcttayggttattcattatactgacttcaa

SEQ ID NO: 110134 - DNA, 50 bp, homo sapien
gcagtattaattttggcaaagcaagrcaccctagtaaaatgtaaaatata

SEQ ID NO: 110135 - DNA, 50 bp, homo sapien
gatacttttagttatgcaagtgtaakgtaaaaagactgcagggatgaaga

SEQ ID NO: 110136 - DNA, 50 bp, homo sapien
tatttacagaacttgttcctgattaygtaagatttaactaccaagcatat

SEQ ID NO: 110137 - DNA, 50 bp, homo sapien
agcatatatacacaagggtctccaawaagatttttctagaaacaaaggct

SEQ ID NO: 110138 - DNA, 50 bp, homo sapien
gttggtgccattgtcacgcccaatgmatcagaaaaatatttgactagaga

SEQ ID NO: 110139 - DNA, 50 bp, homo sapien
tattacagctttgttgtcatattatytctaggcagtaaatcatagtaaag

SEQ ID NO: 110140 - DNA, 50 bp, homo sapien
attgggactgtaattcttactttgtyttagcccacaggatgatatgtata

SEQ ID NO: 110141 - DNA, 50 bp, homo sapien
catcaatttaaatcagcctcagaatwggaatagcataatttccattgact

SEQ ID NO: 110142 - DNA, 50 bp, homo sapien
gcttgctgcctgtgtcaggtgagtgraatgataggctgccctggatcact

SEQ ID NO: 110143 - DNA, 50 bp, homo sapien
cagggctcaaatgagctatacttctrcaccacatgggataactaactcag

SEQ ID NO: 110144 - DNA, 50 bp, homo sapien
aaagcaagtagtagagattattgtamagcaattttcctaccaatccactt

SEQ ID NO: 110145 - DNA, 50 bp, homo sapien
ctgtgctgagctcagtattctgcgcrctacagtaactgctgtggttcctt

SEQ ID NO: 110146 - DNA, 50 bp, homo sapien
atatcaaatatgttaatttagttgaraatataagtagagatcacttcaga

SEQ ID NO: 110147 - DNA, 50 bp, homo sapien
gctgtcatcattatatttgtcaagartagttgttttttatttctctttag

SEQ ID NO: 110148 - DNA, 50 bp, homo sapien
actatagagaaaattaaacagtgacyggaagagcttgtattttaggcagt

SEQ ID NO: 110149 - DNA, 50 bp, homo sapien
cagagtcaaatgacccgctaacatamtcttataataatgttttcaacttg

SEQ ID NO: 110150 - DNA, 50 bp, homo sapien
gaacactggcacctaatatctaatgrataagcactgagcttatatgtaac

SEQ ID NO: 110151 - DNA, 50 bp, homo sapien
atattatcttcctagggctatggacratggagtgaattttaaaaggagta

SEQ ID NO: 110152 - DNA, 50 bp, homo sapien
gatgtggaaaaaatcaacatgcatastaggataattaatttagtatgcca

SEQ ID NO: 110153 - DNA, 50 bp, homo sapien
atttattagtaaagaagagaagaaaktaccaggacttaaggcaggaggca

SEQ ID NO: 110154 - DNA, 50 bp, homo sapien
aaattaccaggacttaaggcaggagkcatacgctaaccgtgctgttttgt

SEQ ID NO: 110155 - DNA, 50 bp, homo sapien
caaaaatcctcttggatttatttcaytgatgctttatccccgaagtcagg

SEQ ID NO: 110156 - DNA, 50 bp, homo sapien
aactgaaaaaaaaaagcacagcaacscggatttagataacatcagtagtg

SEQ ID NO: 110157 - DNA, 50 bp, homo sapien
acataactactttatgctttacacartgattatcctgatgggaagaacgt

SEQ ID NO: 110158 - DNA, 50 bp, homo sapien
tatatttaagcctactaaacaacaayttctgagttaacaatattaagaca

SEQ ID NO: 110159 - DNA, 50 bp, homo sapien
tggctcctacaacctgaaatttgtarcagagccctttaggcaactgtggt

SEQ ID NO: 110160 - DNA, 50 bp, homo sapien
aagtgatgaaatggacacagccctcrcacaccttttggtcaaatatggag

SEQ ID NO: 110161 - DNA, 50 bp, homo sapien
gcagctgattgattaaaatggagacygcctgaacttgggtgccagttgac

SEQ ID NO: 110162 - DNA, 50 bp, homo sapien
atgattctgtgaatataggcaagcascaattgcaggtagaacattctttt

SEQ ID NO: 110163 - DNA, 32 bp, homo sapien
atatttcattgttgctyttgatggttttaatg

SEQ ID NO: 110164 - DNA, 50 bp, homo sapien
tctaaaaagtgactactctttgacaytatctaatttgaaagagttttgaa

SEQ ID NO: 110165 - DNA, 50 bp, homo sapien
taagaactcagtatccagctggcccraagtgcaatataagaaccaaaacg

SEQ ID NO: 110166 - DNA, 50 bp, homo sapien
ggtttatgctctgtctccatttcaaycagattacccagcagtgtgacttt

SEQ ID NO: 110167 - DNA, 50 bp, homo sapien
tgcttcccgcagtggcactctcatcrcatatattggtaagtatagaggtg

SEQ ID NO: 110168 - DNA, 50 bp, homo sapien
ctatgggtatcatcttctctcataamgaattgtggacattttgtttggat

SEQ ID NO: 110169 - DNA, 50 bp, homo sapien
ggagcactacacactatatattcacragaactctatgccacaaatttcat

SEQ ID NO: 110170 - DNA, 50 bp, homo sapien
ctaaatctcaccatgagtgcctgaayaaaatggaattctgcaacaaggaa

SEQ ID NO: 110171 - DNA, 50 bp, homo sapien
gtgagccaccgcgcccagctggaaaygttcttttgactctgaaattttag

SEQ ID NO: 110172 - DNA, 50 bp, homo sapien
catagaacactagaaattgaacttaygcaaagcttcatctgaaaccaatt

SEQ ID NO: 110173 - DNA, 50 bp, homo sapien
atggattgggcagagagggtggaaayctagttgtcaaaaattcaagaaaa

SEQ ID NO: 110174 - DNA, 50 bp, homo sapien
actgctgaactcctcttctatatctwaagtacaaaagcttcagaaagaat

SEQ ID NO: 110175 - DNA, 50 bp, homo sapien
atctcagtggtttaagcctcaattayataacatttcgagagcttagatac

SEQ ID NO: 110176 - DNA, 50 bp, homo sapien
gtgatgtattcagtgagctatgtatyttctgctaatttgaatgtattgtt

SEQ ID NO: 110177 - DNA, 50 bp, homo sapien
gcagatggccacattctcactttgtyctcactcggtctttcctttctgtc

SEQ ID NO: 110178 - DNA, 50 bp, homo sapien
tactatcatgccatagtagcttgatwagagcttgagctttgtagacctat

SEQ ID NO: 110179 - DNA, 50 bp, homo sapien
gtggcaaaatagtaagaagattgatragtagtggtgatagctggttgtcc

SEQ ID NO: 110180 - DNA, 50 bp, homo sapien
tttagagggacggccttgcactaacrgttaaaatggattaagtagcagat

SEQ ID NO: 110181 - DNA, 50 bp, homo sapien
atgatagtggaattttgttggcaaakgttatatttcagcaacttgggcca

SEQ ID NO: 110182 - DNA, 50 bp, homo sapien
catggtagaccttgccaataaacgayagcaactgggagcagctcacacct

SEQ ID NO: 110183 - DNA, 50 bp, homo sapien
ttacaggctaagtaggataggtaaamagtttgaccaaattattgtaggaa

SEQ ID NO: 110184 - DNA, 50 bp, homo sapien
gggggagatgaaaggagaatacagcragtggaataaacaagagacacttt

SEQ ID NO: 110185 - DNA, 50 bp, homo sapien
tggattggaactggactctcagataratattctttccaaggacttgctaa

SEQ ID NO: 110186 - DNA, 50 bp, homo sapien
ttgttcagagtggaaatgtgtagtaygaccaatgcagtccttttttacag

SEQ ID NO: 110187 - DNA, 50 bp, homo sapien
tatctataacacaaggcagaaatacragttaaataatgtaatgaaagtga

SEQ ID NO: 110188 - DNA, 50 bp, homo sapien
acaaccaggattaaattaatacttaygtgcaactactgtgtactcggtac

SEQ ID NO: 110189 - DNA, 50 bp, homo sapien
cccctcaaatgtgctttgatcgatgyggttgttctttcctctgctaagtt

SEQ ID NO: 110190 - DNA, 50 bp, homo sapien
gagaaatcttcaaataggtcatatamactaactgacttttaattggtcct

SEQ ID NO: 110191 - DNA, 50 bp, homo sapien
gtattaatataagctgtatattttcycagttatcatgttgcaagagctgt

SEQ ID NO: 110192 - DNA, 50 bp, homo sapien
ttctcagttttaattaactcataagwctaataggcaatgtgaattggtgc

SEQ ID NO: 110193 - DNA, 50 bp, homo sapien
tagcatattttcatgttgtgaaagaraagtttttggtcaagcaaatcatg

SEQ ID NO: 110194 - DNA, 50 bp, homo sapien
aaagcccaaacgatcaaaaaaggcaygctgaaatctgtgtcctcacctat

SEQ ID NO: 110195 - DNA, 50 bp, homo sapien
ttcctgtggtgcagtatttctctcaraagttcacaagcattggagatata

SEQ ID NO: 110196 - DNA, 50 bp, homo sapien
ttttaaaacctagatatcaggataaraaagacgaatcttctgatattgtc

SEQ ID NO: 110197 - DNA, 50 bp, homo sapien
gagttgccccaaaacagatagaatcrgaaggtgcatgacagaattcctaa

SEQ ID NO: 110198 - DNA, 50 bp, homo sapien
aactactgtatttaaattgtagttargtgtgaaggaagcatgctaacaga

SEQ ID NO: 110199 - DNA, 50 bp, homo sapien
gtgcttcacaccatctagctgatgaygcataagagtagaggaaaatgtgg

SEQ ID NO: 110200 - DNA, 50 bp, homo sapien
atgccagtattaaactacacgatgayaggggctttcattcatcactgcaa

SEQ ID NO: 110201 - DNA, 50 bp, homo sapien
tcctactttttaagattagaagaaamgattcctcttaagccaaccatctc

SEQ ID NO: 110202 - DNA, 50 bp, homo sapien
ttctctgccatcagcatacgcatctygcctcaagttgtgagaagctgtta

SEQ ID NO: 110203 - DNA, 50 bp, homo sapien
ggtggcagaatgtggagtctgaatawccattgtgaatgaacaaatgggat

SEQ ID NO: 110204 - DNA, 50 bp, homo sapien
ttagggaatctgtgtatgtattttayaaccatatcaccatatattgacat

SEQ ID NO: 110205 - DNA, 50 bp, homo sapien
aagttacaggtgaacttaggaaactkaatctatcctgtggaacataccat

SEQ ID NO: 110206 - DNA, 50 bp, homo sapien
ttttgggaaaataaggctgtaatggmagtaataaagatacctgagttggg

SEQ ID NO: 110207 - DNA, 50 bp, homo sapien
aacatttctctgtgtggataagataraaattcaatgtgtattctctgtga

SEQ ID NO: 110208 - DNA, 50 bp, homo sapien
tccaggggtaaaagtccaacagtaamcacaccaaattttagatgtcttaa

SEQ ID NO: 110209 - DNA, 50 bp, homo sapien
cacagggtaacaagaagataattccyaaagagttggtgcttttgttttgt

SEQ ID NO: 110210 - DNA, 50 bp, homo sapien
tcatcttccagaaattctaaggtacrgtaacaacatgcctcccctaaaac

SEQ ID NO: 110211 - DNA, 50 bp, homo sapien
gcttcatttcccttaaagtggacatwaaaaatgctataggtttaagaatg

SEQ ID NO: 110212 - DNA, 50 bp, homo sapien
ctggaccttagagaattttgttcacrgaagataattggcaatgtttggag

SEQ ID NO: 110213 - DNA, 50 bp, homo sapien
aaactcatgatggttgtcatttccasaacaaatgtacagagcataattct

SEQ ID NO: 110214 - DNA, 50 bp, homo sapien
atctctctttagagcttccactggcmaatatagtaaaatgagttctaaaa

SEQ ID NO: 110215 - DNA, 50 bp, homo sapien
taatgaagaaatgaatgagttagcgratggacattacaaataggaaaata

SEQ ID NO: 110216 - DNA, 50 bp, homo sapien
cattaatcctggagacgtataatgargcatcatatccaaccccacttccc

SEQ ID NO: 110217 - DNA, 50 bp, homo sapien
cattattaattgtgttggctaattayggcaatgcatacctccatttaaga

SEQ ID NO: 110218 - DNA, 50 bp, homo sapien
caattgatgctgaacaagcacttaayaaaattcaacatttattcatgata

SEQ ID NO: 110219 - DNA, 50 bp, homo sapien
gaaacaggcctagaatccttcttagyaagcacaaaaatatcttcttaccc

SEQ ID NO: 110220 - DNA, 50 bp, homo sapien
caggacttctgtagaaacatgaatayggtgagaagcagatctgagttcta

SEQ ID NO: 110221 - DNA, 50 bp, homo sapien
gccttacattggaattatttatgtcyaagtctgtctttattatcaaatta

SEQ ID NO: 110222 - DNA, 50 bp, homo sapien
tcaaaagattatacagaattaccaayaaggaaaatgaagataaagtaatc

SEQ ID NO: 110223 - DNA, 50 bp, homo sapien
acccaagatgagaaaggcacataaaygaaatacttgccatttcgaagaac

SEQ ID NO: 110224 - DNA, 50 bp, homo sapien
ttagttagaattaaatgaaggttatyaattatcaagtttgcattgtgttt

SEQ ID NO: 110225 - DNA, 50 bp, homo sapien
aaataatgctttgctctttggtgacrgcactttccattagagctgcctgc

SEQ ID NO: 110226 - DNA, 50 bp, homo sapien
tccgggagccatctggcagataaggycatgagaacccacatgctctgcag

SEQ ID NO: 110227 - DNA, 50 bp, homo sapien
ttgcttaacacttgtctaaaactcayaattctcttctgtaatttgggcaa

SEQ ID NO: 110228 - DNA, 50 bp, homo sapien
tcattggaaaccagtacagagaacayggtcacttaataagaaagatgttt

SEQ ID NO: 110229 - DNA, 50 bp, homo sapien
gctgtttaggcctaaaaatctccacygaactttctgagtttagtcttgat

SEQ ID NO: 110230 - DNA, 50 bp, homo sapien
tcctaagagaatattgttcaggcaargaagaaggagttttcactgaagcc

SEQ ID NO: 110231 - DNA, 50 bp, homo sapien
caaatctaatgagaagtcccatgaarattacaggaaggaatgaacaaagt

SEQ ID NO: 110232 - DNA, 50 bp, homo sapien
cagggaagagaaatagaagtttaggkatggacccaaggtcatacaaaagg

SEQ ID NO: 110233 - DNA, 50 bp, homo sapien
aaaagaatggcagcacagtgaaaaargtctgttttggaatcagattgctt

SEQ ID NO: 110234 - DNA, 50 bp, homo sapien
tactaatcttaattaaccaaaataartacatatccatcttttcagcttta

SEQ ID NO: 110235 - DNA, 50 bp, homo sapien
ttcacacagggaaagagaggaggcayattgtactcactggtacatagcaa

SEQ ID NO: 110236 - DNA, 50 bp, homo sapien
gaataatattttctgataatgccccrgtttggcttcctgggagtggctcc

SEQ ID NO: 110237 - DNA, 50 bp, homo sapien
aggctttatccatgttacactattcrcagaagttgagattcccactgtct

SEQ ID NO: 110238 - DNA, 50 bp, homo sapien
taactatagtcactttacggtgctgycaaaaactatcacttattctttct

SEQ ID NO: 110239 - DNA, 50 bp, homo sapien
atcacaagggcaaccaaattcaacasaagttttagagaggacaaacactt

SEQ ID NO: 110240 - DNA, 50 bp, homo sapien
aatcattataactttgtaactactayggcccttcttaaaagaatcagtac

SEQ ID NO: 110241 - DNA, 50 bp, homo sapien
cctctaccccaaatgagttttcactyagtcattcctagcctaggactgaa

SEQ ID NO: 110242 - DNA, 50 bp, homo sapien
ttgatgagactatgatgctcaagtakctaaccaggaggaaaatgtctagt

SEQ ID NO: 110243 - DNA, 50 bp, homo sapien
cacacacagcctcaatgacctaatargcagatttgcagagccataacctt

SEQ ID NO: 110244 - DNA, 50 bp, homo sapien
tatactacagagagcagtttttaatytgtgaacgtgtaagtcaacttgat

SEQ ID NO: 110245 - DNA, 50 bp, homo sapien
ttttgaggttgtggatagacatgacrgttttacaatgccaaaacagtctg

SEQ ID NO: 110246 - DNA, 50 bp, homo sapien
taattagtatcttaaacattcactcraataggtccttactattacaaagt

SEQ ID NO: 110247 - DNA, 50 bp, homo sapien
caacgatacaacttggttttatttawgaattgagatgatagcatgcctat

SEQ ID NO: 110248 - DNA, 50 bp, homo sapien
aggaaattttatggactgtaaatcgragagaagatcaattttcagttccc

SEQ ID NO: 110249 - DNA, 50 bp, homo sapien
tctgggctgcccccacaactcgatcrccattgttttattttacctttttg

SEQ ID NO: 110250 - DNA, 50 bp, homo sapien
ttactatgttctgaagatcattaatraagatgaataaacagaagagaaga

SEQ ID NO: 110251 - DNA, 50 bp, homo sapien
cacagtgtgcttcactgggtatctcraagggtaaccgggacaactaagcc

SEQ ID NO: 110252 - DNA, 50 bp, homo sapien
attgctatgcttatgtttatgagagwattttaagattttatcaagttccc

SEQ ID NO: 110253 - DNA, 50 bp, homo sapien
cctgaatatggaaaaacctgctagakaaataagtagacatgatttaaaaa

SEQ ID NO: 110254 - DNA, 50 bp, homo sapien
tgctattggcctattttcagtatacrgacttaaggtaagaacattacatg

SEQ ID NO: 110255 - DNA, 50 bp, homo sapien
aaagattaactgtagggtaggcaaaygccaaattattagaagccaaaatg

SEQ ID NO: 110256 - DNA, 50 bp, homo sapien
cttcatttggactataccatgttatyaaagaaaaagaaacaaacaaacca

SEQ ID NO: 110257 - DNA, 50 bp, homo sapien
tattactgaactgccacagaactagragatgtagaatctcaattagcaga

SEQ ID NO: 110258 - DNA, 50 bp, homo sapien
tgaactatgtgccatctctaaacaakattaccttttcacctttatcaact

SEQ ID NO: 110259 - DNA, 50 bp, homo sapien
aggcttctggaagagtttgcctcacrctgttgtttagctcatttgcaagg

SEQ ID NO: 110260 - DNA, 50 bp, homo sapien
agatttctatatgagttcaaacaaaytttaagctgacatacttaccttag

SEQ ID NO: 110261 - DNA, 50 bp, homo sapien
atctagatatatccagagaccaccayaaaaataaggtacagaatacacgg

SEQ ID NO: 110262 - DNA, 50 bp, homo sapien
attgtccatcttgttgtatatattargcatttgttcatgtttattgctga

SEQ ID NO: 110263 - DNA, 50 bp, homo sapien
ctagaggaaaggaaaggaaattctcrcctgagaagcacgagcttgcaaat

SEQ ID NO: 110264 - DNA, 50 bp, homo sapien
atcatacattcaagtaagttacacayggattaaagtattaaatgggaggc

SEQ ID NO: 110265 - DNA, 50 bp, homo sapien
cacagaggaagacgaaaactgaaaaraacagtgaacactagaactgatgg

SEQ ID NO: 110266 - DNA, 50 bp, homo sapien
gaaatgaatgagctaaacaatattargtgtcatcggtaattctagaggtg

SEQ ID NO: 110267 - DNA, 50 bp, homo sapien
ttcctcacatcatcacaggaatgaartggttggtgtatggagatctgatt

SEQ ID NO: 110268 - DNA, 50 bp, homo sapien
ctgtcaaaactgagaatctagtggamgaaatccaacatatgtacaggacc

SEQ ID NO: 110269 - DNA, 50 bp, homo sapien
aaattcaaagtattctttccttccartccaaaatcaattaaggaaaagaa

SEQ ID NO: 110270 - DNA, 50 bp, homo sapien
ggtaaagagatgaggagtgctcacargaatcttaatggaccaaaaatatg

SEQ ID NO: 110271 - DNA, 50 bp, homo sapien
tcttgaagagcagggaaatgtctaaytatcttccttatatgcaaaataaa

SEQ ID NO: 110272 - DNA, 50 bp, homo sapien
atcaaagttgatatcaagagtaagargtttatagaactgaataatcaaaa

SEQ ID NO: 110273 - DNA, 50 bp, homo sapien
ttgagataaattaaaagtaggtctcycagaagttaagatatactaaaact

SEQ ID NO: 110274 - DNA, 50 bp, homo sapien
tacccagcagtccacataactcttcractgttagcctttctgatcattgg

SEQ ID NO: 110275 - DNA, 50 bp, homo sapien
gtatttgaccactgtccaatctgtaycatatgaatgtcatgtgtcccata

SEQ ID NO: 110276 - DNA, 50 bp, homo sapien
gggtcctctatcaaatggcaactgartaataggaccttcctccaactgtt

SEQ ID NO: 110277 - DNA, 50 bp, homo sapien
caatgcagcaaatatctttcaactcyatacttttcaagttttgactgtat

SEQ ID NO: 110278 - DNA, 50 bp, homo sapien
aaagcagtttataaactagttgctamagaatcactttcagaattgtcttc

SEQ ID NO: 110279 - DNA, 50 bp, homo sapien
tcttttctcttactcaagcacttaawtattcaaaatcctccctattttta

SEQ ID NO: 110280 - DNA, 50 bp, homo sapien
acatacgtaatgagcatttatttgarctacgttgagcctgtcctgtgtgt

SEQ ID NO: 110281 - DNA, 50 bp, homo sapien
tggtaatcatttaactacacctacawcttatagaaactcatcctcctaac

SEQ ID NO: 110282 - DNA, 50 bp, homo sapien
caactggcttctatcctttaaactcrgaatttataactcacaggtcctca

SEQ ID NO: 110283 - DNA, 50 bp, homo sapien
ctgcggccccattgctgtgtgtccamtcttagagcattgttcaaagtata

SEQ ID NO: 110284 - DNA, 50 bp, homo sapien
atgacctccacttcatggtgttgaaytaaacaaacacatacttctccaga

SEQ ID NO: 110285 - DNA, 50 bp, homo sapien
cttctgtaatctatcgggaattgtayagtaggtagtatgaggtaaggatg

SEQ ID NO: 110286 - DNA, 50 bp, homo sapien
acccattttggcttaattcactttarctacctggttcccacttctgaatt

SEQ ID NO: 110287 - DNA, 50 bp, homo sapien
tacagtttagtaagcagttgtggtamagaaatgtgtctattcatcattgc

SEQ ID NO: 110288 - DNA, 50 bp, homo sapien
tgttaaattttgggttatgtcatcartctgattttggaaaattgtatatc

SEQ ID NO: 110289 - DNA, 50 bp, homo sapien
ttatgttagtcatgaacacaacgtarcttaaaaatatagcaattgctgta

SEQ ID NO: 110290 - DNA, 50 bp, homo sapien
tttatttattgtttaattcctatcartcaggcatttgctacatgtcactc

SEQ ID NO: 110291 - DNA, 50 bp, homo sapien
aaagcgaggagtactgagtttggaayagatacctgagtgttaaaatgtat

SEQ ID NO: 110292 - DNA, 32 bp, homo sapien
ttctgttctgaatgccrattacataaaacaaa

SEQ ID NO: 110293 - DNA, 50 bp, homo sapien
ataccaaatcctagagatttagagayaaaaaagtagagttcttgtcttca

SEQ ID NO: 110294 - DNA, 50 bp, homo sapien
actgaattacaagcagtaaaatctckatggcaggatatgttcctcctttt

SEQ ID NO: 110295 - DNA, 50 bp, homo sapien
taatttatccatccatttatttatgmaaaaatattgcctgcctgctaggt

SEQ ID NO: 110296 - DNA, 50 bp, homo sapien
atatgaaatgattccttgcctgactwaaacgtgaaaaacactatcaagaa

SEQ ID NO: 110297 - DNA, 50 bp, homo sapien
tctagaataccagaagagagaactcyggacactctacaataacattgcta

SEQ ID NO: 110298 - DNA, 50 bp, homo sapien
ttaaccagccaaatatcttactataygatgaatacattgtccctaggttt

SEQ ID NO: 110299 - DNA, 50 bp, homo sapien
cctgtaaattatctacaatagtatayagaaaaaaagttagaaattattct

SEQ ID NO: 110300 - DNA, 50 bp, homo sapien
ctggctttaatttggtcaccgcaagragtaaggtctgaggaaagcaggac

SEQ ID NO: 110301 - DNA, 50 bp, homo sapien
tgatgatgggagtgttaactagaatwaccaccttgcaaaatggactgaca

SEQ ID NO: 110302 - DNA, 50 bp, homo sapien
aataactaaataggaacagataagarcaccttaaagtccttttgctgccc

SEQ ID NO: 110303 - DNA, 50 bp, homo sapien
aaagcccatctgaattactaacatcmcatccatatctatgttaagcagca

SEQ ID NO: 110304 - DNA, 50 bp, homo sapien
gaatttagagtaaaacaattggaaamtatcataatgtcatgattataaat

SEQ ID NO: 110305 - DNA, 50 bp, homo sapien
tttctacctgcccggatttcagtcartaaagatgtgagaggaaaacataa

SEQ ID NO: 110306 - DNA, 50 bp, homo sapien
tttctttaattattttgactttcccrttgcagtggctaagacttccattt

SEQ ID NO: 110307 - DNA, 50 bp, homo sapien
ggataattaattacactatgattccraattaaaatgagaacccacaggct

SEQ ID NO: 110308 - DNA, 50 bp, homo sapien
acttaccggcaacctaatttatatcragcctcttctcatgctttaaagat

SEQ ID NO: 110309 - DNA, 50 bp, homo sapien
ctattccactttctcttctgtttcastggacatacaatactgcaggtcca

SEQ ID NO: 110310 - DNA, 50 bp, homo sapien
tcaggcttggtttttggtcagctcaraagtgtagatttgagggatgaatg

SEQ ID NO: 110311 - DNA, 50 bp, homo sapien
aaattgtaatgtaatagatatttcaraagacattttaagcataatttaga

SEQ ID NO: 110312 - DNA, 50 bp, homo sapien
gtcaagtgtcaaatttaagtccagartatcatagttagttgttttttttt

SEQ ID NO: 110313 - DNA, 50 bp, homo sapien
gttaatcacacatgtgcaacaataaytctcatacctggacccagccagta

SEQ ID NO: 110314 - DNA, 50 bp, homo sapien
tgaccttgagctattaatcatggatsagttgctagtcttgtggatcattg

SEQ ID NO: 110315 - DNA, 50 bp, homo sapien
gaagaaactgagggtcaaagaggtcrctttactttcctaaactcacacaa

SEQ ID NO: 110316 - DNA, 50 bp, homo sapien
tacactattgcacacacacatgctcragagttcttcagaattttatttga

SEQ ID NO: 110317 - DNA, 50 bp, homo sapien
tgaatggcccataaccaccagtaaamtattaaagtgaaaaagcaaactta

SEQ ID NO: 110318 - DNA, 50 bp, homo sapien
gatagcttctttctagttttttatcrtgtgatattctgttttttactaca

SEQ ID NO: 110319 - DNA, 50 bp, homo sapien
ttcataagttctaacaaacctctgayagaagctgtttccagccctttcat

SEQ ID NO: 110320 - DNA, 50 bp, homo sapien
tgactggcagggagcttaataaatcsaggctgttctcattacctgtgttt

SEQ ID NO: 110321 - DNA, 50 bp, homo sapien
aaggccaggcggctccaagccgcgaygatagcttgcactaacaaagcagg

SEQ ID NO: 110322 - DNA, 50 bp, homo sapien
taatttcaagttgcctctgcagagckgaaatagtacctttttcacagaca

SEQ ID NO: 110323 - DNA, 50 bp, homo sapien
tctgtgagttggtctactctatctayggacaagaggaggaggggctttga

SEQ ID NO: 110324 - DNA, 50 bp, homo sapien
tacaattaactgcttaattggggaargatattgtattagtctgcttgagt

SEQ ID NO: 110325 - DNA, 50 bp, homo sapien
cagtcagcagttaaacgttaaacackcatctaacctgagctaagagggtg

SEQ ID NO: 110326 - DNA, 50 bp, homo sapien
taacacaattagaaatgcttcttaamctgataaccatttacctccagatc

SEQ ID NO: 110327 - DNA, 50 bp, homo sapien
aattacattcatgtggtaatctctarctctactatgaatggctctcacca

SEQ ID NO: 110328 - DNA, 50 bp, homo sapien
ccttctttagttgagaaagaatatcrcaagctcttttcaataccttacca

SEQ ID NO: 110329 - DNA, 50 bp, homo sapien
atttgtccaggtagaactcactaccraggatcgttgaaacctagactgaa

SEQ ID NO: 110330 - DNA, 50 bp, homo sapien
acaagggctttaactgtttacactayggcatatggttttgcatcctttct

SEQ ID NO: 110331 - DNA, 50 bp, homo sapien
caatgcagttgaaagcagtgataaaygcaatgggacaataatgtaggcta

SEQ ID NO: 110332 - DNA, 50 bp, homo sapien
aaatcgcccagttattttacaaacawctgtcctcaatcttaatctttatt

SEQ ID NO: 110333 - DNA, 50 bp, homo sapien
accccaggctgcaaacaccatcatgsctaactcgggactcaatcactatc

SEQ ID NO: 110334 - DNA, 50 bp, homo sapien
ctaaatatgatttttaaatcacatawgctcctcctctattgtaccacata

SEQ ID NO: 110335 - DNA, 50 bp, homo sapien
ctttgccttctctaaagatccatggrcatttttatttggtcacagaggcc

SEQ ID NO: 110336 - DNA, 50 bp, homo sapien
taacctgtgatagagctcattcttamgactgtttccttttacttcatatt

SEQ ID NO: 110337 - DNA, 50 bp, homo sapien
ccgcccacactgctcctcttcctgcrttcaggtgtagtcctgggttttat

SEQ ID NO: 110338 - DNA, 50 bp, homo sapien
aaaaaaaaaaatccatattaagggcygaatcatcttgtcactggccagct

SEQ ID NO: 110339 - DNA, 50 bp, homo sapien
ctcaataaagtttcccttcttataaytggttgccctgtctcctctagacc

SEQ ID NO: 110340 - DNA, 50 bp, homo sapien
aaactgaaagtaaaataatagattayggaatcagaagaagaaaataaaat

SEQ ID NO: 110341 - DNA, 50 bp, homo sapien
gaaattaaagaccatgaaaatatacygggcactgccatgtattctaatct

SEQ ID NO: 110342 - DNA, 50 bp, homo sapien
gttttcctcagacaggaccttgtcarcgctttcaaatatgtaggctgttt

SEQ ID NO: 110343 - DNA, 50 bp, homo sapien
agaaatctagagttgaactgatgaamaacaaatctccagatggatttatg

SEQ ID NO: 110344 - DNA, 50 bp, homo sapien
tgtttaataactaaatggatttgaarcttttagactgacattatgacatt

SEQ ID NO: 110345 - DNA, 50 bp, homo sapien
aatttcttgaattaaagaggagtatragggaggctgttgtgaggtaggtt

SEQ ID NO: 110346 - DNA, 50 bp, homo sapien
ttgtgccagatcttgtgttagaagasagaataaaaccatggctagaacaa

SEQ ID NO: 110347 - DNA, 50 bp, homo sapien
tctctggcaaatcacccgctccagargctctcactccttatctacaaaac

SEQ ID NO: 110348 - DNA, 50 bp, homo sapien
tgtgagcttgtccaagagaacttaayggttttccagacctttaaagtcaa

SEQ ID NO: 110349 - DNA, 50 bp, homo sapien
aaatcatgagctgtggttccatatcragatatttggcacattgttctcca

SEQ ID NO: 110350 - DNA, 50 bp, homo sapien
ataaaaagccaatgtttcctaataaytctattgacaatgaacaaaaaaac

SEQ ID NO: 110351 - DNA, 50 bp, homo sapien
tgtaagtcagtatagcttttgctackctcttttgttcccggccaagggcc

SEQ ID NO: 110352 - DNA, 50 bp, homo sapien
tctcaggcacaggccagtttacacasatattaaaggaaaacatttttctt

SEQ ID NO: 110353 - DNA, 50 bp, homo sapien
tatccttggggtctttctcactcaamaattctatgcttctgtcccttcct

SEQ ID NO: 110354 - DNA, 50 bp, homo sapien
gtggttcggggcagcaataggattckcggactttggtgtgcagtgcaggg

SEQ ID NO: 110355 - DNA, 50 bp, homo sapien
tgggagctgaagtttgaatttctaartcacggcagttgatgtttgggaga

SEQ ID NO: 110356 - DNA, 50 bp, homo sapien
acactgatttatatgagtgttaaagmaagataccacacaatagagacaga

SEQ ID NO: 110357 - DNA, 50 bp, homo sapien
tttaacactcatataaatcagtgtcratcaatcctaccaatatagtaact

SEQ ID NO: 110358 - DNA, 50 bp, homo sapien
gcaggaatgaattctacaaagaccawgatttggaatatcttcctctaagt

SEQ ID NO: 110359 - DNA, 50 bp, homo sapien
attgaattcagctgtaacaatagaakaatgcaacttttcctaaaatttcc

SEQ ID NO: 110360 - DNA, 50 bp, homo sapien
ttcaagagtttgagacttgcattcakgatataagctttgaaaaacaggtt

SEQ ID NO: 110361 - DNA, 50 bp, homo sapien
ttcttagtatatccatgcgcagtttwaaaatttccaggaaaattgtagca

SEQ ID NO: 110362 - DNA, 50 bp, homo sapien
aactttggcaaagaaggtttgggtcrttctgtcaggtaaaatatcacaat

SEQ ID NO: 110363 - DNA, 50 bp, homo sapien
agtagttaaaagtaggaagtaattaragggaacataatcgaaggttttaa

SEQ ID NO: 110364 - DNA, 50 bp, homo sapien
tcacactagccactttcaagtattarcaatcgagtctggccagtggctac

SEQ ID NO: 110365 - DNA, 50 bp, homo sapien
tagttaaatatgtacttcaaataaartctcataggggagtccaacagata

SEQ ID NO: 110366 - DNA, 50 bp, homo sapien
cattcatgtaaactcagaaatttccraagcacattttccccaaagcaaaa

SEQ ID NO: 110367 - DNA, 50 bp, homo sapien
gaatggaagattcaacaaagtcatcrccagcttgtctaccctgtatagct

SEQ ID NO: 110368 - DNA, 50 bp, homo sapien
actataatcagttgtggagaaggaaraaggttatattttgcacccctcaa

SEQ ID NO: 110369 - DNA, 50 bp, homo sapien
ttacataatgcctagatattttaagsaaggactggaaggataacatttca

SEQ ID NO: 110370 - DNA, 50 bp, homo sapien
aggtagcagaggatcatggccccagsaaaaaggtaagcaaagggttggga

SEQ ID NO: 110371 - DNA, 50 bp, homo sapien
gaagaaattaacttcattcagtccastgctgtttaaagctccgttgtgtc

SEQ ID NO: 110372 - DNA, 50 bp, homo sapien
aggaggaatgcattcttgctgtgttyttctcgagtagactgaactacagc

SEQ ID NO: 110373 - DNA, 50 bp, homo sapien
gataaaatgccagactgatgagattyttcatggtgcattcagtgagtcag

SEQ ID NO: 110374 - DNA, 50 bp, homo sapien
atatggaggactaactgtattgttaygttataggcactttggagggaaaa

SEQ ID NO: 110375 - DNA, 50 bp, homo sapien
tttgcgataaagttgcctgaggagayaaaaagaaaggaatcctcttctag

SEQ ID NO: 110376 - DNA, 50 bp, homo sapien
ctgggttagaacatgtgctgcagcarcgaggcttccagaggccttggctc

SEQ ID NO: 110377 - DNA, 50 bp, homo sapien
ctaagagttaaaatcttgctcttaarcctaaatctaagaaaggatgacct

SEQ ID NO: 110378 - DNA, 50 bp, homo sapien
aaatgttaactttactcaagttgatrtaggtttaagttatgtaaatgttt

SEQ ID NO: 110379 - DNA, 50 bp, homo sapien
taacatagttggaaattacttaatgmaaatctactctcttatgtatttct

SEQ ID NO: 110380 - DNA, 50 bp, homo sapien
tccaatgtgcagtaaaaaattgctaytaaggctcatactgcccatttcaa

SEQ ID NO: 110381 - DNA, 50 bp, homo sapien
ttttgggtttttttaataggatagcractcagggaaagacttgtttatgg

SEQ ID NO: 110382 - DNA, 50 bp, homo sapien
ctccacgccgcaccaggaggagggayggaaacgcgggagagccacaccct

SEQ ID NO: 110383 - DNA, 50 bp, homo sapien
ccaggccctgctccctcacagaattraagtctcaaccttgggaagaacac

SEQ ID NO: 110384 - DNA, 50 bp, homo sapien
gaaaatatgtatccttgtagcaaaarctgctgtctttcagtatctactct

SEQ ID NO: 110385 - DNA, 50 bp, homo sapien
ctgaggtgggaaagctattctcacartgtagcttcttccaagatggtttc

SEQ ID NO: 110386 - DNA, 50 bp, homo sapien
aacactctgtgccactccctattgamgtccgagttgattttaatggtcag

SEQ ID NO: 110387 - DNA, 50 bp, homo sapien
gttgtatggccttaagtcatttaacygccctaagcttcagtctcctcaag

SEQ ID NO: 110388 - DNA, 50 bp, homo sapien
aactttatcttaatttaactgctcakctatatccttggtcctattggtaa

SEQ ID NO: 110389 - DNA, 50 bp, homo sapien
ctgtgggagttatgtatatgcttccraaagaggccaaattctcacaggat

SEQ ID NO: 110390 - DNA, 50 bp, homo sapien
atgttactcctgcacgggtataatcycataaaatttggaagggactgatg

SEQ ID NO: 110391 - DNA, 50 bp, homo sapien
gaagagatttaaacatacaaaattasaaatagcaattcacataaagctgt

SEQ ID NO: 110392 - DNA, 50 bp, homo sapien
atttgccatcattttagtcactagtmaattagctgtgaagacaagagtca

SEQ ID NO: 110393 - DNA, 50 bp, homo sapien
gcctgatgacttgggaatgtcagaastaggaaatgtatgcccctagcatc

SEQ ID NO: 110394 - DNA, 50 bp, homo sapien
ggcaggaatgtagaagtataaactaraaacttgagttctaacaagttaga

SEQ ID NO: 110395 - DNA, 50 bp, homo sapien
tgtggaaaattggaaacatgcctaargatggtaaagaaaagatcagggga

SEQ ID NO: 110396 - DNA, 50 bp, homo sapien
tccttgtctcccttctttcctacctsaaccttagactccaggactagggt

SEQ ID NO: 110397 - DNA, 50 bp, homo sapien
acagaatatcatattctcctactccsgaacccctgactctgaccttgact

SEQ ID NO: 110398 - DNA, 50 bp, homo sapien
gttaagatgttgttttgatttagtcsaaagcctagattttattcataggc

SEQ ID NO: 110399 - DNA, 50 bp, homo sapien
aaaatacacacacaagcatcaaagtrttaataagaacattttcccagtta

SEQ ID NO: 110400 - DNA, 50 bp, homo sapien
tggagaagttttaacatttctgggarcatatctaagaagtgaagaagtta

SEQ ID NO: 110401 - DNA, 50 bp, homo sapien
agatgtaaaggaaatgactgctgaaktatcagggaagtattatattccct

SEQ ID NO: 110402 - DNA, 50 bp, homo sapien
aaacatatcaggactttgttttccartagaaatcattcactgttgaaaat

SEQ ID NO: 110403 - DNA, 50 bp, homo sapien
ggaagtattatattccctatgctgaragttgttaagtataagggatgtgc

SEQ ID NO: 110404 - DNA, 50 bp, homo sapien
attttaaaactcatgatgttcccagstcatttggcttctggataccgtcc

SEQ ID NO: 110405 - DNA, 50 bp, homo sapien
cttcctcatttccctatccacttcayacaatcctttgcattttggcttta

SEQ ID NO: 110406 - DNA, 50 bp, homo sapien
attattgaactattttatggtcattkaacctcattgcagaagctttgaga

SEQ ID NO: 110407 - DNA, 50 bp, homo sapien
ctctgtggtgattgtactttgattaygtgcaggaatttagctataagtat

SEQ ID NO: 110408 - DNA, 50 bp, homo sapien
taatgttatcagtagaagattgttayagcaaaaactcctggatttaaaat

SEQ ID NO: 110409 - DNA, 50 bp, homo sapien
tgaaaactactgtttcttatctatcrctattcatgactgtggaagcaaat

SEQ ID NO: 110410 - DNA, 50 bp, homo sapien
tcacttacattaagtgtctaactcargttggaaagaataaatagaaaagc

SEQ ID NO: 110411 - DNA, 50 bp, homo sapien
cctagaatataattagctttttaaawgggagccttctgtgagctacttac

SEQ ID NO: 110412 - DNA, 50 bp, homo sapien
gtctcctagtgagtcataggataggrcagattcttgaaagccaccacaga

SEQ ID NO: 110413 - DNA, 50 bp, homo sapien
ctttttaatggctttataagggaaawctgacataagtgccaacatctgtt

SEQ ID NO: 110414 - DNA, 50 bp, homo sapien
ctcattcaggcatttcttcagcaaayattaagtggccaatccacaccctt

SEQ ID NO: 110415 - DNA, 50 bp, homo sapien
tgtccataaaattactccaaaaatayaatatcaggtgttaaaacatcaga

SEQ ID NO: 110416 - DNA, 50 bp, homo sapien
ttctatatagctgtaatgaactatgraaacatttttaaaattccatttat

SEQ ID NO: 110417 - DNA, 50 bp, homo sapien
tattacccaaaatgctggatgactasgcagcttaattatagagaaaagta

SEQ ID NO: 110418 - DNA, 50 bp, homo sapien
gtcttcagaattccaaatctcaaaaytatgataaagtgactaaaacatta

SEQ ID NO: 110419 - DNA, 50 bp, homo sapien
cctcaacgcttacattacaacatacrctaaatgtaactggaaatacatca

SEQ ID NO: 110420 - DNA, 50 bp, homo sapien
gaagtagtaataattgcccaattcarcttgaaggcctgatactgatagga

SEQ ID NO: 110421 - DNA, 50 bp, homo sapien
ccataccgtgtatacttgtgtaatamattcataaggaagttgattaaaaa

SEQ ID NO: 110422 - DNA, 50 bp, homo sapien
ccaggtgagactccctacatcataaycacagaagcagaaaaatagctaaa

SEQ ID NO: 110423 - DNA, 50 bp, homo sapien
tgtcatgctgtaagtattgttcaaayatgctattgttcaatacatgtgaa

SEQ ID NO: 110424 - DNA, 50 bp, homo sapien
tgtgccatggcacccagagaaaatayggccagaggtcagggagcaccaag

SEQ ID NO: 110425 - DNA, 50 bp, homo sapien
tttgtgggcataaaaaatgaaacaartgacaaatgattacttcaaaagat

SEQ ID NO: 110426 - DNA, 50 bp, homo sapien
ctaaaaaagtggtgccctctatacawgcaactatgcccagtgttgctcag

SEQ ID NO: 110427 - DNA, 50 bp, homo sapien
tgttctaaagaaaaaggagagaatasgatcaagaaacaagagtgcaggct

SEQ ID NO: 110428 - DNA, 50 bp, homo sapien
ctctgccttttgcttctcaagtcaamaaatatcctcaagtttctgtcatc

SEQ ID NO: 110429 - DNA, 50 bp, homo sapien
ttaaaactagaatcctcttcttttaygaagtcctacaaccaagttcctct

SEQ ID NO: 110430 - DNA, 50 bp, homo sapien
cttgaaataagggaaatggaaattargatggcatttaaggggaagaagat

SEQ ID NO: 110431 - DNA, 50 bp, homo sapien
gctttctttcttttgtgttgacataygttgtttactttatgatatataaa

SEQ ID NO: 110432 - DNA, 50 bp, homo sapien
gagcagcttccatggctttctgatarcagtgataagaaaattatttgtcc

SEQ ID NO: 110433 - DNA, 50 bp, homo sapien
acaagttaaatataattacattttgracaaagggcacacaacttgattga

SEQ ID NO: 110434 - DNA, 50 bp, homo sapien
tgagcatggcgtcattccaatgaaayttaattacaaaaacaggtggcagg

SEQ ID NO: 110435 - DNA, 50 bp, homo sapien
cattctgtgatttcttcagagattayacagttgaagttttagcattgagt

SEQ ID NO: 110436 - DNA, 50 bp, homo sapien
ttctgtgtattctgttacagggttayatgcatttgactttgtagttcaga

SEQ ID NO: 110437 - DNA, 50 bp, homo sapien
ttttctggaccagaaataatcctaarctcacagtaaaatgtgttaattta

SEQ ID NO: 110438 - DNA, 50 bp, homo sapien
cactctgttttgacagagactcacasgtaggcaaagaaagtggaaagttt

SEQ ID NO: 110439 - DNA, 50 bp, homo sapien
cttcttttgatgaccaatcattaaasgttgcataagactcagcttgtgcc

SEQ ID NO: 110440 - DNA, 50 bp, homo sapien
tttgtttttggtaaatatgattgtcrcctcctgaattaaaggaggagtta

SEQ ID NO: 110441 - DNA, 50 bp, homo sapien
gagatttactcatctgaacttggtayggttattcactccaaattagataa

SEQ ID NO: 110442 - DNA, 50 bp, homo sapien
aagaaactaatgtcctgaatgaggcraagttaacactagatccttctcaa

SEQ ID NO: 110443 - DNA, 50 bp, homo sapien
gaaagcagtaaatccaaaaactgaaygatgtggaacaaaaacacacaggg

SEQ ID NO: 110444 - DNA, 50 bp, homo sapien
ttccatttaacacaaattatagtcaycctagttgttgtgaagtggtatca

SEQ ID NO: 110445 - DNA, 50 bp, homo sapien
ctgttgggcacttgaaatgtgtttawcttgaattgctctgcactatgggc

SEQ ID NO: 110446 - DNA, 50 bp, homo sapien
ttttccaaggcagggcatgctaaacsagatcctgaaattgtggttcaggg

SEQ ID NO: 110447 - DNA, 50 bp, homo sapien
gaattatcagattttggtataacgayatgcaaactctgatctcaatacat

SEQ ID NO: 110448 - DNA, 50 bp, homo sapien
ttccttaataattaaagcaagaagamgaatcattccgatttgtgaaagcc

SEQ ID NO: 110449 - DNA, 50 bp, homo sapien
tgaattctttgtcatgcttttaccaytcaccatcattgagggaacagtgg

SEQ ID NO: 110450 - DNA, 50 bp, homo sapien
gaaaataaggctgatgatacagaagyggaagcctgagcaaagagggtgag

SEQ ID NO: 110451 - DNA, 50 bp, homo sapien
gccctggggcatcctgccggcacgaytaatgctcgctgcccttccccttg

SEQ ID NO: 110452 - DNA, 50 bp, homo sapien
tgatgacataacaattaaggagtaartcaggagaaatgaaaatacaagct

SEQ ID NO: 110453 - DNA, 50 bp, homo sapien
agttctgagggaaaactatattcaaygtgaaattcggtatttagataaac

SEQ ID NO: 110454 - DNA, 50 bp, homo sapien
agcagtgggagaagtagtaaaaggaratctgtgggattctgcatgcaggt

SEQ ID NO: 110455 - DNA, 50 bp, homo sapien
gggtctactcctgctaggcatttacmatctcaaaaccatgtatttaagat

SEQ ID NO: 110456 - DNA, 50 bp, homo sapien
tgcatgcaggtgaggtgtggagagamtttttatgggcagagcattaactg

SEQ ID NO: 110457 - DNA, 50 bp, homo sapien
tgctctgttttcaagttatttgacawaatttctcatgtacatataggcac

SEQ ID NO: 110458 - DNA, 50 bp, homo sapien
ttattccttgcaaggttcaaagatargtcctttccatactttattttact

SEQ ID NO: 110459 - DNA, 50 bp, homo sapien
cggcattttaatacactgatcacgaragaataaactataaagactttcct

SEQ ID NO: 110460 - DNA, 50 bp, homo sapien
gcccaaatgaatcccctcgtcttaaytagatgtcttaaaaatagctacct

SEQ ID NO: 110461 - DNA, 50 bp, homo sapien
atgtaattgctgggtgacaatatgargatttttaaggcttctgatttata

SEQ ID NO: 110462 - DNA, 50 bp, homo sapien
aaagagaaagggactgcactcattarggaacattataaggaaattcagaa

SEQ ID NO: 110463 - DNA, 50 bp, homo sapien
gtctgagaaaacccatcttactgtakgaaaaatcaattctccaagttata

SEQ ID NO: 110464 - DNA, 50 bp, homo sapien
attaacacaaatatatttaaccagarattgcacacttgccaggacagtta

SEQ ID NO: 110465 - DNA, 50 bp, homo sapien
ctgctttaaccttaaacattaaacawgaattaactggaaatagattttat

SEQ ID NO: 110466 - DNA, 50 bp, homo sapien
aatgtggggaaaaattgtcaactccraaagagaaactcaacattttcttg

SEQ ID NO: 110467 - DNA, 50 bp, homo sapien
gggtctcttgaccacctgtgaacatkacaatctcagcaggtgattaacca

SEQ ID NO: 110468 - DNA, 50 bp, homo sapien
acaggctttaatagttagtgtgacaytgggaactagttataatttcattt

SEQ ID NO: 110469 - DNA, 50 bp, homo sapien
caaatagccttagaacttaatttgaygtagttaatacaagattgatgctt

SEQ ID NO: 110470 - DNA, 50 bp, homo sapien
gattaacaaataagaacaacgcttcrcaggcttgaaagaactatccatta

SEQ ID NO: 110471 - DNA, 50 bp, homo sapien
cacaattataagttgaaggctttaawgtactaagtgttaactaagattta

SEQ ID NO: 110472 - DNA, 50 bp, homo sapien
ttaaaatgatgtttgcctttctgtakccagtcatcccaaggccttcatgc

SEQ ID NO: 110473 - DNA, 50 bp, homo sapien
atttctgtaggatatttatgcaaaaktaacagattacagaaccagttcag

SEQ ID NO: 110474 - DNA, 50 bp, homo sapien
tcccccactgtgaagtatcccctgcrcttgtaaaggatcttttgggttcc

SEQ ID NO: 110475 - DNA, 50 bp, homo sapien
gcatgtcccttcatacaggaaagaayaagggctttgaaataaaacagacg

SEQ ID NO: 110476 - DNA, 50 bp, homo sapien
atctttcactttccttcttcaacaaygtgctcttcctctactttcacaaa

SEQ ID NO: 110477 - DNA, 50 bp, homo sapien
acagtaaatgcaattaagtgcaacartaatggagtgtaataacaagtaat

SEQ ID NO: 110478 - DNA, 50 bp, homo sapien
ctccaaatttcttccagtccactaawctactacttgtcttagtccatttg

SEQ ID NO: 110479 - DNA, 50 bp, homo sapien
acactaccaacaatgaaatggaccartaaatctgcctggtggcccagtta

SEQ ID NO: 110480 - DNA, 50 bp, homo sapien
agggatgggggctgaataaccaaaawactgatgtttcccacacaggcctg

SEQ ID NO: 110481 - DNA, 50 bp, homo sapien
tgaaagcccactcttggatcccaatsatctgtggccagattggagtcaac

SEQ ID NO: 110482 - DNA, 50 bp, homo sapien
ctagcctaaaacagacttatcaacasaagcacacttactaacttactgat

SEQ ID NO: 110483 - DNA, 50 bp, homo sapien
gaaagggaaagataagagacctggaractggttgagaggccagtacgctt

SEQ ID NO: 110484 - DNA, 50 bp, homo sapien
acgcttgtacaaacaaaacttactgmatgtgtgggcaacatggagaggag

SEQ ID NO: 110485 - DNA, 50 bp, homo sapien
caattatgtggagatttagcagctgratatctatgttactttatcaagtt

SEQ ID NO: 110486 - DNA, 50 bp, homo sapien
gttgtttcctaaaagtgtttgaaggktcagtcacgtctcaccacctcaca

SEQ ID NO: 110487 - DNA, 50 bp, homo sapien
ggaaatgttcacacatattttaggcmagaaaaacctgcaaagtgcaagac

SEQ ID NO: 110488 - DNA, 50 bp, homo sapien
ccagcctcatctcatgcaactttccrctttgctcgctgaatttctgccac

SEQ ID NO: 110489 - DNA, 50 bp, homo sapien
taggaagaaaataagaaagattcaartactaatttaaaaatatagagaat

SEQ ID NO: 110490 - DNA, 50 bp, homo sapien
tttctgtttcttaaggtgaaagttarataattgaattaagatctttcttc

SEQ ID NO: 110491 - DNA, 50 bp, homo sapien
agacccttaaaacttgctaccaatgwcatctctgtttagctaccattgtg

SEQ ID NO: 110492 - DNA, 50 bp, homo sapien
tgttttttgagattctgaatgcccaygttaagtaacaaacattcatctag

SEQ ID NO: 110493 - DNA, 50 bp, homo sapien
aaaatactattgcttaaccaaaagawtctgtaaggcatacccttatatat

SEQ ID NO: 110494 - DNA, 50 bp, homo sapien
tatttttggacaaacaaagctatcamgaggagagaactgttccttaagtg

SEQ ID NO: 110495 - DNA, 50 bp, homo sapien
acaaattcagattgtaatatgcatcyaatttacactaaaggacaaataag

SEQ ID NO: 110496 - DNA, 50 bp, homo sapien
ataactcttactataaagctgtttgmaatacatgacacttaaagaaaaat

SEQ ID NO: 110497 - DNA, 50 bp, homo sapien
ttcttacatgtgatagaattgtgtcyaccctgttgtttaaaaaactcata

SEQ ID NO: 110498 - DNA, 50 bp, homo sapien
tgacctacagttacaggtttggatgyattccctacactgtaatatatggt

SEQ ID NO: 110499 - DNA, 50 bp, homo sapien
ggtaatttgcggttgtcagattttaygcaggaattttcacaaggcctttt

SEQ ID NO: 110500 - DNA, 50 bp, homo sapien
ctttacggtgactcgtaggtttatgyaatattcacccaaactgacattta

SEQ ID NO: 110501 - DNA, 50 bp, homo sapien
ttccatcttcccttcaaatgtagcckcaatttctccagaaagtgtgtagg

SEQ ID NO: 110502 - DNA, 50 bp, homo sapien
gagagccactgcttacatctaatgaraaaagactccttaaaattatctcc

SEQ ID NO: 110503 - DNA, 50 bp, homo sapien
agttgggtttgcataagcacataaamgcattctaagtgtaaagtataaca

SEQ ID NO: 110504 - DNA, 50 bp, homo sapien
atgagaaagaacagcagggaaagtaytaacatttggttcctaacatcata

SEQ ID NO: 110505 - DNA, 50 bp, homo sapien
tggacactgtggtgccatttggacargattcaattatttattaaatttca

SEQ ID NO: 110506 - DNA, 50 bp, homo sapien
gaaatggcaaaatatagtgtgtaatsaggaaatattaatagcaaggatct

SEQ ID NO: 110507 - DNA, 50 bp, homo sapien
acctggctacagtgttgtggagttaycgtatcaggaaagttgaagaagat

SEQ ID NO: 110508 - DNA, 50 bp, homo sapien
ctcgtcctaaataaatcagcggtgarctcttttacctctattatttctca

SEQ ID NO: 110509 - DNA, 50 bp, homo sapien
gtttttgagcctaaacagtatgtgartttctcctttaatctatcttgaag

SEQ ID NO: 110510 - DNA, 50 bp, homo sapien
tcttccagatgtcactctccaagtayaaggcatgagagtgaagttatgtg

SEQ ID NO: 110511 - DNA, 50 bp, homo sapien
gatctcagctctatcatatacactargctttaggatttgctttctacaca

SEQ ID NO: 110512 - DNA, 50 bp, homo sapien
agaggattcaagattatgaaacccasaaaacaaagactcaaaggtgttta

SEQ ID NO: 110513 - DNA, 50 bp, homo sapien
tgaggataaaataagcaaatctatayaaattacatggttcacttgaggac

SEQ ID NO: 110514 - DNA, 50 bp, homo sapien
gtcacttggggatgggtattgtaatyggagcagggctgcagcatctgatg

SEQ ID NO: 110515 - DNA, 50 bp, homo sapien
ctccattcacaaataccaactgtcaycttttatgtcacacacacataatg

SEQ ID NO: 110516 - DNA, 50 bp, homo sapien
gaaatcagggcagtattgggagtctmaataccaattcaactttttccatc

SEQ ID NO: 110517 - DNA, 50 bp, homo sapien
agaagaggggatgtcattatcatgcyagctaaaattggccagtttgggat

SEQ ID NO: 110518 - DNA, 50 bp, homo sapien
agttaatgtatgacatggtaagtccwatgatagagttatgcacaggaaca

SEQ ID NO: 110519 - DNA, 50 bp, homo sapien
caaggtcccccaacatcttaactcaytacagcttcaagtccaaaatctca

SEQ ID NO: 110520 - DNA, 50 bp, homo sapien
tttcagataatatcatgtcctagcakgtaacttgagatttagagacctga

SEQ ID NO: 110521 - DNA, 50 bp, homo sapien
tgaagaagttctccctaatacctcckgctgttatttgagcagccccctcc

SEQ ID NO: 110522 - DNA, 50 bp, homo sapien
cattcatcaaagctcaacataagtayaagtcaatttttggcctctgtatt

SEQ ID NO: 110523 - DNA, 50 bp, homo sapien
tgtcattgttgtctcctttattctaygtctttaaagctccccctgacgtg

SEQ ID NO: 110524 - DNA, 50 bp, homo sapien
ctactctataaagatctttctttcakcaagtgttatgttaggtttatata

SEQ ID NO: 110525 - DNA, 50 bp, homo sapien
ttttgagtagaaaacaacatgattgraactatgagttaattaactgtgag

SEQ ID NO: 110526 - DNA, 50 bp, homo sapien
acaaaggtgctgtgcttagtaacgcratggggagacacagatgaagcagc

SEQ ID NO: 110527 - DNA, 50 bp, homo sapien
ctaaagcttccctctctctgccttayaggtttttaacaatcaacccattt

SEQ ID NO: 110528 - DNA, 50 bp, homo sapien
acagaccaggagactgccttcgccaygacacactatcaacagatgatcca

SEQ ID NO: 110529 - DNA, 50 bp, homo sapien
gaggtataactctgcctgaaaattgsatcatctgttgatagtgtgtcgtg

SEQ ID NO: 110530 - DNA, 50 bp, homo sapien
gatgggactactatttagatccccakgtatgaatgtaaacaagggtaact

SEQ ID NO: 110531 - DNA, 50 bp, homo sapien
ttggactcatgaatctcaggtcctgyacaagttcaaacgtttttaaggaa

SEQ ID NO: 110532 - DNA, 50 bp, homo sapien
cttgtgcagaacaggatgttgaagaygccccatcgtggtgttttattttg

SEQ ID NO: 110533 - DNA, 50 bp, homo sapien
tttgcattaaacatcatgataaatamaatacaggcttcaaatttcataga

SEQ ID NO: 110534 - DNA, 50 bp, homo sapien
gtttattttaaaatcaaaaggtaaargatagagactcttataaaaagtgg

SEQ ID NO: 110535 - DNA, 50 bp, homo sapien
gtgcaaagccccaagatggggtgaamttagcatatccatgggaaaatgaa

SEQ ID NO: 110536 - DNA, 50 bp, homo sapien
ttatcttgctgtgatgttagtgcatytcatggatacaatctcatggttga

SEQ ID NO: 110537 - DNA, 50 bp, homo sapien
gattcgaatatgcattgtatctgccrctgattgctgttaaaaatgaggtt

SEQ ID NO: 110538 - DNA, 50 bp, homo sapien
ctacagttattccaaaataaaaataytaaagacatgtaagtaagtactcg

SEQ ID NO: 110539 - DNA, 50 bp, homo sapien
aaatgcatgaaaaatagatgaaaaamttaatagtgggagtctttaatcag

SEQ ID NO: 110540 - DNA, 50 bp, homo sapien
atttactatgtttttgaaaaccgcargcagcaatttatagaaaagattag

SEQ ID NO: 110541 - DNA, 50 bp, homo sapien
gaaatgtatatgcctattcaaaaagyaaattgctacagctgctgctctaa

SEQ ID NO: 110542 - DNA, 50 bp, homo sapien
gaagtcacctctttattggcacttarcgttacgcataaataggaccactg

SEQ ID NO: 110543 - DNA, 50 bp, homo sapien
attttcagaaattcttgacaactatwaaaggcttgtacagtctaactgcg

SEQ ID NO: 110544 - DNA, 50 bp, homo sapien
gatatttacaaaaacagctgattatwaaaggaatacatattgcttgtaga

SEQ ID NO: 110545 - DNA, 50 bp, homo sapien
tcataacaacctgtttttacagtaartgatatatgtggacaaatacatat

SEQ ID NO: 110546 - DNA, 50 bp, homo sapien
aaaaagacacagtttgttataaagayagtgaattagaagagagaaatggg

SEQ ID NO: 110547 - DNA, 50 bp, homo sapien
gttgtgcagcctcttcttgaacatarctaacttgaggaacctgctcctcc

SEQ ID NO: 110548 - DNA, 50 bp, homo sapien
gtgactattgattgaaagataactgyagattaagaaaacaattgtattca

SEQ ID NO: 110549 - DNA, 50 bp, homo sapien
acatctgctgtatgcaacggactatkagcaatgtgccaaaacctttatgc

SEQ ID NO: 110550 - DNA, 50 bp, homo sapien
catttaccttagaaaggatcaactaygtaatcatctatttataatatgta

SEQ ID NO: 110551 - DNA, 50 bp, homo sapien
tactacctccaaacacaaacacatasagcataaaagaatacactgtgttc

SEQ ID NO: 110552 - DNA, 50 bp, homo sapien
cctgtcttcaccccttcaactcctaktaaatgttctaatccattgcaact

SEQ ID NO: 110553 - DNA, 50 bp, homo sapien
gtcaatgaaaaaaccattagaacagkagaagtgtactctcttggacccta

SEQ ID NO: 110554 - DNA, 50 bp, homo sapien
aatcatggctgcttttggaaagatamgtggactagcatgcagcatggaga

SEQ ID NO: 110555 - DNA, 50 bp, homo sapien
gcctagcatagcacatagcaaagaayaggtgctcaattagcacttgttga

SEQ ID NO: 110556 - DNA, 50 bp, homo sapien
tacattctggtttttctgaaatatayggcttaaaacctacagtttaagaa

SEQ ID NO: 110557 - DNA, 50 bp, homo sapien
aggcagactttattcaagagagctayggtgatagggtcaccaccatgggg

SEQ ID NO: 110558 - DNA, 50 bp, homo sapien
ttttacctaaacatctaagtaggccygatgtgaaagagaactaacagtaa

SEQ ID NO: 110559 - DNA, 50 bp, homo sapien
tcgtattagccccattttgcaactartaaactgagactcaggaatgttgt

SEQ ID NO: 110560 - DNA, 50 bp, homo sapien
acccagtgaaaaagcgaagtgaaaakaatgcattaaggtttttttctgag

SEQ ID NO: 110561 - DNA, 50 bp, homo sapien
tagcaattgcaattctaattcaatgycactgattttttaatactttatgg

SEQ ID NO: 110562 - DNA, 50 bp, homo sapien
attttgagaaacttgcaaagagatcrgaattaagacgggggatgacaaat

SEQ ID NO: 110563 - DNA, 50 bp, homo sapien
ttctgggtaagatttctggaagtaaytggcatcatcagaatgaatttgtc

SEQ ID NO: 110564 - DNA, 50 bp, homo sapien
cttttaaacttttcacagaaagtccrcattaaaagaaaatgtaccggctg

SEQ ID NO: 110565 - DNA, 50 bp, homo sapien
tttaggtcttttgaaagcattatagmattttagacaccatgataaatgac

SEQ ID NO: 110566 - DNA, 50 bp, homo sapien
atatgtctttctaaataaatgtctgygattaggttattcattcttcttac

SEQ ID NO: 110567 - DNA, 50 bp, homo sapien
atgaggttacaatcagaagcataacwctaaaatgctcatggttagatgta

SEQ ID NO: 110568 - DNA, 50 bp, homo sapien
gtcaaaaatcccctttgcctcaaccrcatcctaatccataaaattaagag

SEQ ID NO: 110569 - DNA, 50 bp, homo sapien
ccaagaaggttttttccactgtgaargccttgggcacacataaacattgt

SEQ ID NO: 110570 - DNA, 50 bp, homo sapien
gcttggacactcattttgggaaggayaaattggtgtggatccatctcgct

SEQ ID NO: 110571 - DNA, 50 bp, homo sapien
tgttctccactgccaactccactctkaaaattccttgttttatggtatgc

SEQ ID NO: 110572 - DNA, 50 bp, homo sapien
cactggctcagtttaagaaagtgagkcagattacgggtcttttttttttt

SEQ ID NO: 110573 - DNA, 50 bp, homo sapien
ggattatgaatattcaggtaatgagmcctcttgaataatcaaagcaatag

SEQ ID NO: 110574 - DNA, 50 bp, homo sapien
ggagatctaccgttctgccttcttcstttgttggcagcattctgaggaag

SEQ ID NO: 110575 - DNA, 50 bp, homo sapien
ttggctttcacagcatgctcataaaragagttatttaaacacacacacaa

SEQ ID NO: 110576 - DNA, 50 bp, homo sapien
acttaaaaatggtatcatcagcaaaractgtactattaggattctctgga

SEQ ID NO: 110577 - DNA, 50 bp, homo sapien
acacatcatgatcacctagaatccayagtttacaacgcctttggtgctgt

SEQ ID NO: 110578 - DNA, 50 bp, homo sapien
attttcacatgaaattggtaaaatayattcctactcatttacttttgatt

SEQ ID NO: 110579 - DNA, 50 bp, homo sapien
atatgtcaaaattagaaaactgtacrctttccacatttgtggtgtattgt

SEQ ID NO: 110580 - DNA, 50 bp, homo sapien
taggctttgcttttatataactttaygcccaaggaaagcaaaaccttacc

SEQ ID NO: 110581 - DNA, 50 bp, homo sapien
gtagaggctggccagtccaaaatcckcagagcagagttaatgttgcagct

SEQ ID NO: 110582 - DNA, 50 bp, homo sapien
aagaaataattaagacagtgcccatrgacggccataatcccaaatcctgt

SEQ ID NO: 110583 - DNA, 50 bp, homo sapien
acattaaacacagatcaggtagcaartaattggaacaaatgtgtgggatt

SEQ ID NO: 110584 - DNA, 50 bp, homo sapien
cttgctcttgagtcttagttttttcrttttctacagctttcctaaataat

SEQ ID NO: 110585 - DNA, 50 bp, homo sapien
gttccacacaacacaccaaattgagkactggaggtgttatgtaactggct

SEQ ID NO: 110586 - DNA, 50 bp, homo sapien
gcaaacttgggtataaaagcaagaamcctatattctcttcctgcctctac

SEQ ID NO: 110587 - DNA, 50 bp, homo sapien
tgtgaaccatagatatcccaaggtcygaattctaattgtaattatccaga

SEQ ID NO: 110588 - DNA, 50 bp, homo sapien
gatgaatttcttaattacctgaaaaygcataagtattcctaatcatgatt

SEQ ID NO: 110589 - DNA, 50 bp, homo sapien
tacaactagttgtagcgcccagatcractgcaaccgcagaagctataggt

SEQ ID NO: 110590 - DNA, 50 bp, homo sapien
tctgagatattattggagaccaagaygttaagatgtttacttccattcta

SEQ ID NO: 110591 - DNA, 50 bp, homo sapien
actgaagtttgattgtcatcttaccytggaagtctccatgttgatacttc

SEQ ID NO: 110592 - DNA, 50 bp, homo sapien
tccttgggtaaccattttgataaacrccacttacaccagtttccatgatt

SEQ ID NO: 110593 - DNA, 50 bp, homo sapien
gaatgattctgtccatgaaattataycatatgctggtgttatttaaatat

SEQ ID NO: 110594 - DNA, 50 bp, homo sapien
atctcaacataatacatattgctatwacacagatttagacacaaaacaag

SEQ ID NO: 110595 - DNA, 50 bp, homo sapien
ataatctatatctgaaaaaccataamcttgattatccatctaaacccagc

SEQ ID NO: 110596 - DNA, 50 bp, homo sapien
tataactactcaatctatgtatcaarccctaatttttttccgactctaaa

SEQ ID NO: 110597 - DNA, 50 bp, homo sapien
tcatcatactcaaaagcattcacaaratagagcccaagttaaaactggat

SEQ ID NO: 110598 - DNA, 50 bp, homo sapien
aagtcttttactgatggtttatggarcagataaggaagcaagaaatctaa

SEQ ID NO: 110599 - DNA, 50 bp, homo sapien
ggttagatgtcatgtattcctgatcsgagcactgattacatagctgtctt

SEQ ID NO: 110600 - DNA, 50 bp, homo sapien
tgaatttcttgagtcctaggtctccrctcttaggttaacaacaaacagct

SEQ ID NO: 110601 - DNA, 50 bp, homo sapien
atttggctctttcatttcgtgtctayaactccctctcccttccaatttct

SEQ ID NO: 110602 - DNA, 50 bp, homo sapien
tgcttctaaaggccagttatttttcwcttcaatgaagctgtctaatacta

SEQ ID NO: 110603 - DNA, 50 bp, homo sapien
aggaagagggcagtctggagtagaaraggtagctgggatgttaaatacaa

SEQ ID NO: 110604 - DNA, 50 bp, homo sapien
acagggagattttaggtagttctaastgccatcatttttcttcataagaa

SEQ ID NO: 110605 - DNA, 50 bp, homo sapien
gtctctcaagcagaagtaagtctgckaaatacctacaagaactaagatta

SEQ ID NO: 110606 - DNA, 50 bp, homo sapien
gagaataaaggaagaaaataatcgayccagagagtgtgatttggaggtta

SEQ ID NO: 110607 - DNA, 50 bp, homo sapien
caagccctagtctgcttattaaatcrgaattccaggggcagcggcttgcc

SEQ ID NO: 110608 - DNA, 50 bp, homo sapien
ttgtttctccctgaatatcttgaacrgcacttttattgatctgtttctaa

SEQ ID NO: 110609 - DNA, 50 bp, homo sapien
attctttcaaggatgtgaattatgarccaataaggcaagaatcaggattc

SEQ ID NO: 110610 - DNA, 50 bp, homo sapien
catgatataagaaactcttaggaagmagaataatgcatatctacccctgt

SEQ ID NO: 110611 - DNA, 50 bp, homo sapien
attcttatagacatcaaagcatgagraccactaacatagtaatgaagcct

SEQ ID NO: 110612 - DNA, 50 bp, homo sapien
gatcatttgataggacttggtgtagsccttttggtatagatgactaatga

SEQ ID NO: 110613 - DNA, 50 bp, homo sapien
attaatattttcattctatagagtgmaaactgaccattatatgacttaac

SEQ ID NO: 110614 - DNA, 50 bp, homo sapien
acatctgcagtgacctattgtgagayggcccctgggactgatcacgccac

SEQ ID NO: 110615 - DNA, 50 bp, homo sapien
aggactcccgccagagctgtgggaaycttgcttcacaataggaaatctgg

SEQ ID NO: 110616 - DNA, 50 bp, homo sapien
aaatgattttcaaacagtgggataamtagtattgagagaaaagttgcatt

SEQ ID NO: 110617 - DNA, 50 bp, homo sapien
gtaatcttatagaaactataggcacmaaagttaaacattaaatgtgaaaa

SEQ ID NO: 110618 - DNA, 50 bp, homo sapien
ttggcatggtggaaggaagcttgaamattctctactgattgatttatatt

SEQ ID NO: 110619 - DNA, 50 bp, homo sapien
cactattttacagctagtaaccaaaytgcttaagtaaactgagttgaata

SEQ ID NO: 110620 - DNA, 50 bp, homo sapien
ttgggttcatttagagtagaggccaygttagctgtattataaacatggtg

SEQ ID NO: 110621 - DNA, 50 bp, homo sapien
ttatggctctgattttatacattcayggaacatctttgtgtaaaagtttt

SEQ ID NO: 110622 - DNA, 50 bp, homo sapien
ttttgaaagatgagcagaagttgacycagtggagatgggagatgggttgg

SEQ ID NO: 110623 - DNA, 50 bp, homo sapien
gttcgtgcataagtatataaaaacgyatcttggaatataaaaattttagc

SEQ ID NO: 110624 - DNA, 50 bp, homo sapien
atgcacgaacacatatatgcccttaygcgtttaaacttatatgtttatta

SEQ ID NO: 110625 - DNA, 50 bp, homo sapien
aaaatggcactggctctactactaaytcttcactaacttattcccacaca

SEQ ID NO: 110626 - DNA, 50 bp, homo sapien
agaatgtttcatatgtatgtttttaycttgctgtacaaaataaggtatta

SEQ ID NO: 110627 - DNA, 50 bp, homo sapien
ttttttcaaagaaagatttgagctaygagataagaatgaagttaccagaa

SEQ ID NO: 110628 - DNA, 50 bp, homo sapien
gtcattcaagccacactgaaaaccaraactaagaaatactttcaagcatc

SEQ ID NO: 110629 - DNA, 50 bp, homo sapien
aggctgccctcgagggagactgaaasgtagagccttattcatctagaccc

SEQ ID NO: 110630 - DNA, 50 bp, homo sapien
ctgaggagatgttgaccttaaagacmcagcaaagcctgtggaaccatttc

SEQ ID NO: 110631 - DNA, 50 bp, homo sapien
gtgggcccagacggggatcatggctkaattatgtgaaagcttaataactc

SEQ ID NO: 110632 - DNA, 50 bp, homo sapien
agcatgtggaacttcttaacagtgtraaatatgagaggggtgggcaaata

SEQ ID NO: 110633 - DNA, 50 bp, homo sapien
aacaaagctttacaattaaaaccatsagtatacaaacatgtgcttgtaat

SEQ ID NO: 110634 - DNA, 50 bp, homo sapien
actgaatcaatattggttcaatttawattttctaagacacaaatattttc

SEQ ID NO: 110635 - DNA, 50 bp, homo sapien
caaccctagaggtaaacattgctaayaatttggagtttatcctacttggt

SEQ ID NO: 110636 - DNA, 50 bp, homo sapien
gaaagaaagtccaccggggacataaytcatcagtaaggctcagactagac

SEQ ID NO: 110637 - DNA, 50 bp, homo sapien
ttactttggagggggccacattgaaygggttcatctgaaattagaaaaat

SEQ ID NO: 110638 - DNA, 50 bp, homo sapien
ctctcaaggctccatttctacttacrgcagatgattaatcttaccatttc

SEQ ID NO: 110639 - DNA, 50 bp, homo sapien
cttaacacaggaacatgatagcatcyctctgaaaatcctaaaaattgtat

SEQ ID NO: 110640 - DNA, 50 bp, homo sapien
gggcaatgctatgtcattgtaagccrcacagtccagcaacttctagaggt

SEQ ID NO: 110641 - DNA, 50 bp, homo sapien
cacccatgttgccacatatgatgtaygttatgtgactcataaaaaccaga

SEQ ID NO: 110642 - DNA, 50 bp, homo sapien
gtcaatcattcactgtgtaggattargatcatgtgttttgaaactcatgt

SEQ ID NO: 110643 - DNA, 50 bp, homo sapien
gcttatttaacacggaccgtggtaasaaaatcactgacaaattcctacca

SEQ ID NO: 110644 - DNA, 50 bp, homo sapien
agtaagctctcatatggctctgtaastcaaaaaagatttctcctaaattt

SEQ ID NO: 110645 - DNA, 50 bp, homo sapien
atttaacttattggccctcacaaagmaaagtagaaacaggctacacggta

SEQ ID NO: 110646 - DNA, 50 bp, homo sapien
tcatttttgtggttgctgctcacgcygatggttctcttcggttattatcc

SEQ ID NO: 110647 - DNA, 50 bp, homo sapien
ctatcactacagaaccaagtaaacartcaagaataataaatgcctggaat

SEQ ID NO: 110648 - DNA, 50 bp, homo sapien
cccagctgagccaggcacatttctawcagccttcacctagagtactctta

SEQ ID NO: 110649 - DNA, 50 bp, homo sapien
aagttggtatttggacagtatggtaygggctttagatctactggaagtgt

SEQ ID NO: 110650 - DNA, 50 bp, homo sapien
tcacttatccctttacacaccctcamtcttatacttacgcacacatacac

SEQ ID NO: 110651 - DNA, 50 bp, homo sapien
acacacacagtcatacacaatcacaygtacctacccttcctacctcaatg

SEQ ID NO: 110652 - DNA, 50 bp, homo sapien
attttggaaaaggctgggtattgagrcagtgcggcatggagttctcatac

SEQ ID NO: 110653 - DNA, 50 bp, homo sapien
aacctgggaagttaagggaacctgayataagttcctccctaatgtccctc

SEQ ID NO: 110654 - DNA, 50 bp, homo sapien
agaaaggaaaccagttctctttaggkcaatcattgtagtaccttccacat

SEQ ID NO: 110655 - DNA, 50 bp, homo sapien
caggaattctgtttcggccttgcaayggcaactgaatatatttgaacaat

SEQ ID NO: 110656 - DNA, 50 bp, homo sapien
agtattgtaccttagaatactgacaytgaacaacacaaatttggtaaatc

SEQ ID NO: 110657 - DNA, 50 bp, homo sapien
gagcattagaagttaattgaaagacmagaatgatgaaactttagaataaa

SEQ ID NO: 110658 - DNA, 50 bp, homo sapien
tttgtgcatttgtagcacattgtgartcctccataaatggttgcttttgt

SEQ ID NO: 110659 - DNA, 50 bp, homo sapien
aaacaatgaacaacaacaatatatgmcaaacattttaataaacaacactt

SEQ ID NO: 110660 - DNA, 50 bp, homo sapien
acattgtattatcagctagcccaaastatgtcatcagcaatcagaagtca

SEQ ID NO: 110661 - DNA, 50 bp, homo sapien
ccatctccagaagactgcattataakggaagaacctaattaatttaacct

SEQ ID NO: 110662 - DNA, 50 bp, homo sapien
agatttctctgagtgttcagctttarggtaacaactggcagcagcagcag

SEQ ID NO: 110663 - DNA, 50 bp, homo sapien
ttagtgctactactcagagggttgcrttgcatgtcagtatgtccatatat

SEQ ID NO: 110664 - DNA, 50 bp, homo sapien
ctgctatgctatctctcttacagtamctatttcccgaggcattatgtact

SEQ ID NO: 110665 - DNA, 50 bp, homo sapien
ccaaaaaatgcggggatgtccataamggcgagaagagactatgctttact

SEQ ID NO: 110666 - DNA, 50 bp, homo sapien
tctactgtgatagccttgttctctcyaatccattctcttgagtagttcca

SEQ ID NO: 110667 - DNA, 50 bp, homo sapien
tcctccagtcagctagacaaccttcytacagctatcctagggtgaaattg

SEQ ID NO: 110668 - DNA, 50 bp, homo sapien
taaaatacatgacaagaaaagccacmgacttacattactactgctctggc

SEQ ID NO: 110669 - DNA, 50 bp, homo sapien
tcattttaccggagaatactatcaamatgaaatgctcactacacactaaa

SEQ ID NO: 110670 - DNA, 50 bp, homo sapien
aatcattttggtcgactttaatgggyacgtttcaagtcattttaccggag

SEQ ID NO: 110671 - DNA, 50 bp, homo sapien
gacattgtcctgatctcagtcatcargaacaactagaaattaggttaagg

SEQ ID NO: 110672 - DNA, 50 bp, homo sapien
aagtttgaattagtgacatagtttasggagtagccaacttatagttgatc

SEQ ID NO: 110673 - DNA, 50 bp, homo sapien
tttaaaagctacagaaggaatcaaawcatgttgcttataaattaaatacc

SEQ ID NO: 110674 - DNA, 50 bp, homo sapien
taatcctctggtttagggcaaccaargacataagtttctcctcctttact

SEQ ID NO: 110675 - DNA, 50 bp, homo sapien
ctcctaatattgactcctgttcctaycactatcatgacatgtgtcacata

SEQ ID NO: 110676 - DNA, 50 bp, homo sapien
ctctgcatttatgatgctaagaggaygatttttattccatggagccaaag

SEQ ID NO: 110677 - DNA, 50 bp, homo sapien
gagtagttagccagaagaaatgggarctgttctgatcctgccctactagg

SEQ ID NO: 110678 - DNA, 50 bp, homo sapien
attagatgatgagactgacatgagayaatcagattaaacactaccattag

SEQ ID NO: 110679 - DNA, 50 bp, homo sapien
agtttagcttcttcatcaaccaccayggaagaaaatcctccaccaaaaga

SEQ ID NO: 110680 - DNA, 50 bp, homo sapien
tgtaaagttcttgcaatagtctgaaygtttgtattcttccaaaattcacg

SEQ ID NO: 110681 - DNA, 50 bp, homo sapien
tctagatttgattatctcacaggaartgtgcaataaagaaataaagaaaa

SEQ ID NO: 110682 - DNA, 50 bp, homo sapien
gaatggttaagtaatttatagtgtaygttattcgataaaatattatgcaa

SEQ ID NO: 110683 - DNA, 50 bp, homo sapien
aattttccctggcatgatgagcaaaytcctactattatttattttcagcc

SEQ ID NO: 110684 - DNA, 50 bp, homo sapien
acatgcagggagccatgtggcatgtmtcgtggcaatctttataattccac

SEQ ID NO: 110685 - DNA, 50 bp, homo sapien
ccaacttctatctaacagttatttcmgaaagatggacatttttaaaaaga

SEQ ID NO: 110686 - DNA, 50 bp, homo sapien
aaactccaggagaaagcagccaaacrgaatatctgagctagaggcagccc

SEQ ID NO: 110687 - DNA, 50 bp, homo sapien
taaaaaaccaatctaaatggacatargcagttaaggcctccgtggactct

SEQ ID NO: 110688 - DNA, 50 bp, homo sapien
atggcagtaaattctgattaattccrcaacagcacaaggatcagcacaac

SEQ ID NO: 110689 - DNA, 50 bp, homo sapien
ttttaaaacatgaatgatatgaacarttaacatttcttggacacatgttt

SEQ ID NO: 110690 - DNA, 50 bp, homo sapien
aatttaaaagtctgtctgtagcagartattttaattggatcagttaggtg

SEQ ID NO: 110691 - DNA, 50 bp, homo sapien
atatttctttggtgagttctccaaargtctagcttagtatgtacattaat

SEQ ID NO: 110692 - DNA, 50 bp, homo sapien
acaaagaagaggacaaagtcactcayggtctaaagaattctgctgagagc

SEQ ID NO: 110693 - DNA, 50 bp, homo sapien
taggaaacagctggtcacaaaatggmaatcttttcttggccagtgagaag

SEQ ID NO: 110694 - DNA, 50 bp, homo sapien
gatctcggagacaaagccaatgaagrataaatgagtgctctgccagttca

SEQ ID NO: 110695 - DNA, 50 bp, homo sapien
gtattgcatagcaagaatgctccacratgttgtaaaacatcaacagaaaa

SEQ ID NO: 110696 - DNA, 50 bp, homo sapien
atgacatagtatcatttgtgactaayggtaacttaactttgaccttaagt

SEQ ID NO: 110697 - DNA, 50 bp, homo sapien
gaactgagatatcagatcttatttawaaccaggttctcaaactttctaga

SEQ ID NO: 110698 - DNA, 50 bp, homo sapien
acttgttacagaatgaatctaatgamctttaaaaatatttattcagttat

SEQ ID NO: 110699 - DNA, 50 bp, homo sapien
gtgtaagtaactccaagtacaagaastgaaaacaaaagatgaaacactct

SEQ ID NO: 110700 - DNA, 50 bp, homo sapien
tctattggtggatggaacctaagatractcaataatctccccttatagta

SEQ ID NO: 110701 - DNA, 50 bp, homo sapien
cttcgattgaaagtcataagagctasatccaggcattcctttaaaagttg

SEQ ID NO: 110702 - DNA, 50 bp, homo sapien
tgagacgggtgctgaaatagcaataygtatctgtacactgggacaagagg

SEQ ID NO: 110703 - DNA, 50 bp, homo sapien
ggaagaattgaaaatggcatacataygaaagttggtattattaatagaat

SEQ ID NO: 110704 - DNA, 50 bp, homo sapien
agtgcaccgtggtttctatctaaaamttcaagtgttggacattagcagtg

SEQ ID NO: 110705 - DNA, 50 bp, homo sapien
aaaaagtgtaggcatttagccaaaascacaagataggaaaaagtatgcct

SEQ ID NO: 110706 - DNA, 50 bp, homo sapien
accctactccactaaacaccctagaygaaaatggaggatatgatcaggac

SEQ ID NO: 110707 - DNA, 50 bp, homo sapien
gatcctcatgaaaatagaagttaatraacacatgccaaagactccaaatg

SEQ ID NO: 110708 - DNA, 32 bp, homo sapien
aatacaatttattgaartctggttatattgtt

SEQ ID NO: 110709 - DNA, 50 bp, homo sapien
tttcataaaacaatttggcattaaarctaaacagcatagcaaaatagaat

SEQ ID NO: 110710 - DNA, 50 bp, homo sapien
ttcaagattctactcctacatgttaygcttttagatctgtcttggaggta

SEQ ID NO: 110711 - DNA, 50 bp, homo sapien
tttaagtagctgctaatccacaaacygttaccttctttatggttgtgctt

SEQ ID NO: 110712 - DNA, 50 bp, homo sapien
tccaaaattaagaagtttggaaataycaactcatgtttcagtccctaatc

SEQ ID NO: 110713 - DNA, 50 bp, homo sapien
agcatactttttagactgattcttaraaaacatgaaaaatattactgttc

SEQ ID NO: 110714 - DNA, 50 bp, homo sapien
atagacaaataaaatagacagcccartaatggaccattgcatatagggtc

SEQ ID NO: 110715 - DNA, 50 bp, homo sapien
ttctttcttgtcttctctttctgtaytaattaggactctgggattttgac

SEQ ID NO: 110716 - DNA, 50 bp, homo sapien
ccaccaatttttattattatttcaaygcctaattagttgttagttgatat

SEQ ID NO: 110717 - DNA, 50 bp, homo sapien
caactttcctgtcatgacctgtagaygtagataactttgactcatctgac

SEQ ID NO: 110718 - DNA, 50 bp, homo sapien
agagagcatgaagtatatgtacaaargcaagacttacacagttaaatatt

SEQ ID NO: 110719 - DNA, 50 bp, homo sapien
ttgactcatctgactcctcatcttgratctgcaggaaatcctatgttgat

SEQ ID NO: 110720 - DNA, 50 bp, homo sapien
aaaactggtcaggcaccgactactcmaaaggaaaagattaatttctggac

SEQ ID NO: 110721 - DNA, 50 bp, homo sapien
aactgagaagcacgtaaatagacgaygaacttgattcagagagagacaaa

SEQ ID NO: 110722 - DNA, 50 bp, homo sapien
gtggagaatgaagggtgcccaataasatagaccacgattgatctagattg

SEQ ID NO: 110723 - DNA, 50 bp, homo sapien
ctgtgaagtatttccagaatatagayccagtgttatcagctgcactgatt

SEQ ID NO: 110724 - DNA, 50 bp, homo sapien
ggactttctaaaggaaaccacttaarcttgtgtgagaacattaattttta

SEQ ID NO: 110725 - DNA, 50 bp, homo sapien
aactctctgagcctcaatttttttckttttaatccatgaaatccagatag

SEQ ID NO: 110726 - DNA, 50 bp, homo sapien
aatacactgtcttcacagagtcaacraaagtagatccagagaaactaata

SEQ ID NO: 110727 - DNA, 50 bp, homo sapien
tctgactttccttaggagaagcatargctgactgtttccctgggaaggtt

SEQ ID NO: 110728 - DNA, 50 bp, homo sapien
tttttgtttctaattcatatcctaarccattaaagaaagtaaataaatca

SEQ ID NO: 110729 - DNA, 50 bp, homo sapien
gaggtgatttggagaatggactacaractagagggactggatactgagag

SEQ ID NO: 110730 - DNA, 50 bp, homo sapien
aggagaaaggaagaagatgggaaccragaaggaaaacagggactataaag

SEQ ID NO: 110731 - DNA, 50 bp, homo sapien
tctggaagtttattttgaacagcgcratccaaaactgactttccacaaga

SEQ ID NO: 110732 - DNA, 50 bp, homo sapien
acctcaaagattaatatatcaatacratagtgaagcttaaatttcaggga

SEQ ID NO: 110733 - DNA, 50 bp, homo sapien
aaatctctagagcaggggaaaaatgycaccaatctctttgctaatatgta

SEQ ID NO: 110734 - DNA, 50 bp, homo sapien
tttgatgactaagtgagatagtccayaaaaacacttcataaaatgcctaa

SEQ ID NO: 110735 - DNA, 50 bp, homo sapien
tggttttaatttgaatttccctaacrttaagcatttttgctaggcatata

SEQ ID NO: 110736 - DNA, 50 bp, homo sapien
atcaatttgtttcttaatggttcatwgttttggtattgtatctaccaact

SEQ ID NO: 110737 - DNA, 50 bp, homo sapien
aaatggaggctgatgagttagccttsaagaagaggatgtacatatctttt

SEQ ID NO: 110738 - DNA, 50 bp, homo sapien
gttagaaagtgattatgctctgatcygaaattttaataagaataaaatga

SEQ ID NO: 110739 - DNA, 50 bp, homo sapien
tctgaatagcatgaatctatttactycagaagcagtttcaagtcattatg

SEQ ID NO: 110740 - DNA, 50 bp, homo sapien
aagtacttttttattcacaaagttaygatgtaaagtcatgggtgaatatt

SEQ ID NO: 110741 - DNA, 50 bp, homo sapien
gagaacaacaagttaaagttcttaawctaacatgaagaagaggtttttgt

SEQ ID NO: 110742 - DNA, 50 bp, homo sapien
ctcaactcacctgaaaccgtttccaytgctctctgcattcagatctcact

SEQ ID NO: 110743 - DNA, 32 bp, homo sapien
tactaataacatgtgascacaaaataaatgca

SEQ ID NO: 110744 - DNA, 50 bp, homo sapien
gccacccaaagccctgtctttcctaygtgccataaagtcataagccactg

SEQ ID NO: 110745 - DNA, 50 bp, homo sapien
atataactaccaggtagataccctargaaatatgttctgttctgagagtt

SEQ ID NO: 110746 - DNA, 50 bp, homo sapien
atttattgatccaatacttaaccaamcaatggccacattaaaaacaatcc

SEQ ID NO: 110747 - DNA, 50 bp, homo sapien
tagtggttggtgcttgggaaaataaytaatagcaagaccttgggcatgag

SEQ ID NO: 110748 - DNA, 50 bp, homo sapien
catgactcttcccacagtgcactaayaagtagtaaaagctgaaaggaaga

SEQ ID NO: 110749 - DNA, 50 bp, homo sapien
gtgatatttttattcttgctctcctsactcattaaaaactatgcagtgcc

SEQ ID NO: 110750 - DNA, 50 bp, homo sapien
ctactttttgacagcagtcattttarggtagtgtcatggcatctattcat

SEQ ID NO: 110751 - DNA, 50 bp, homo sapien
tgtgtgactaagaccagttcttgaayaatggccagtatccttattgaact

SEQ ID NO: 110752 - DNA, 50 bp, homo sapien
gaaatactatagaaataccttaacamtcatcattctaaacaagctgttga

SEQ ID NO: 110753 - DNA, 50 bp, homo sapien
gggaacaggtttcattgagaaaagarcctcttgatcatttgaaccctcta

SEQ ID NO: 110754 - DNA, 50 bp, homo sapien
tgcagtacagtgaaattgagttccaygtactttgattattagatcctgga

SEQ ID NO: 110755 - DNA, 50 bp, homo sapien
tactgtaattcatggattagataatraagatgtaaatttccgtcgagttc

SEQ ID NO: 110756 - DNA, 50 bp, homo sapien
tggttatcccagggcagtcctccatracccaattggaaaagccttaattt

SEQ ID NO: 110757 - DNA, 50 bp, homo sapien
gagttaagaatcaatcactgaagaakacataacttgactaaaacatgtgt

SEQ ID NO: 110758 - DNA, 50 bp, homo sapien
tgagcctttgtttgagatttgaaaamaacatggctccatcacatattccc

SEQ ID NO: 110759 - DNA, 50 bp, homo sapien
tttgtccaaagtactttcgcgcccaygatttgaagttaccccagggtatc

SEQ ID NO: 110760 - DNA, 50 bp, homo sapien
gtatcttgtaaacatcatgtccagtraaaaggagtaacaaatagaaatga

SEQ ID NO: 110761 - DNA, 50 bp, homo sapien
ataaaggttgagcactcctggcctaygtaaaagtgaattatctcccctca

SEQ ID NO: 110762 - DNA, 50 bp, homo sapien
ggaggatttgaggagaaaagacacartcagaacatttacttatacaacct

SEQ ID NO: 110763 - DNA, 50 bp, homo sapien
tgaacagatttgtgatcatcataacmattagttttaaatgaaggcttttt

SEQ ID NO: 110764 - DNA, 50 bp, homo sapien
ggttctttcttaggccagacacttayattttacactgtgaactgagatat

SEQ ID NO: 110765 - DNA, 50 bp, homo sapien
aagggtaaggcctaaaggaatgtaakatgcagttgataaaagagttagct

SEQ ID NO: 110766 - DNA, 50 bp, homo sapien
tggttcttttccatgcctaccaaaayacaagcaagcccaaaaactatgtg

SEQ ID NO: 110767 - DNA, 50 bp, homo sapien
gctgtagtgaatacattaacacactraactgtacacatgcattaatctct

SEQ ID NO: 110768 - DNA, 50 bp, homo sapien
ttatttgcaaatgatgtcttgaacaktgagtttattgattccctgtcttc

SEQ ID NO: 110769 - DNA, 50 bp, homo sapien
acgtttggagaacagtagggcataaytccaagagggcataacctgggtct

SEQ ID NO: 110770 - DNA, 50 bp, homo sapien
gagtgcataataaaatgcatgattcragtattattacgtgagttatgttt

SEQ ID NO: 110771 - DNA, 50 bp, homo sapien
ataaggacatagcagtagataaacasagggattgcaggattagcaggtaa

SEQ ID NO: 110772 - DNA, 50 bp, homo sapien
tgcgggacagaaaactagttatgaargattaacattcagaaaaacactct

SEQ ID NO: 110773 - DNA, 50 bp, homo sapien
taacaattcttagttgtaggctcatrtgtaaaagttgggataagaattgc

SEQ ID NO: 110774 - DNA, 50 bp, homo sapien
gtcacatgtacaatttatcctcttawcatgcatatcaaacccaaagagag

SEQ ID NO: 110775 - DNA, 50 bp, homo sapien
ccatcttttacagcttgcccaagacragatcacacagacagatgactgaa

SEQ ID NO: 110776 - DNA, 50 bp, homo sapien
ctaaattatgcagtactaaatatgtyacaagaagtctcagagtttgttcc

SEQ ID NO: 110777 - DNA, 50 bp, homo sapien
gtcaagatgtgaactacaggtgtacmaagatatctacctgctcagcctca

SEQ ID NO: 110778 - DNA, 50 bp, homo sapien
caatacctttacatcttttttttgasaaatagccacatcatttaggaatc

SEQ ID NO: 110779 - DNA, 50 bp, homo sapien
gttctcttgataatgtcttttataayttacttgagaggagataatctgaa

SEQ ID NO: 110780 - DNA, 50 bp, homo sapien
cagtgtacaggctttgattgagtacygccactttaaattatacttctgaa

SEQ ID NO: 110781 - DNA, 50 bp, homo sapien
tctgtggcctctgaatgtgcttataycattactggatttagctttatttt

SEQ ID NO: 110782 - DNA, 50 bp, homo sapien
caacctgatgattgggtttaatcacrgaatggagatgacagatcgaatca

SEQ ID NO: 110783 - DNA, 50 bp, homo sapien
gtggtgggaggcaggatcagttagcrctccacttaccactggtgtgatca

SEQ ID NO: 110784 - DNA, 50 bp, homo sapien
gctaaaaatgtctaatgaggaaagaytaagaaaactgatactacagttat

SEQ ID NO: 110785 - DNA, 50 bp, homo sapien
gtagtcttgttataaaattagttcartagacagagttgatgtccttggag

SEQ ID NO: 110786 - DNA, 50 bp, homo sapien
tatttacctaggctacagtaaagccraaaaaaaatgtccagttctactat

SEQ ID NO: 110787 - DNA, 50 bp, homo sapien
tgaaaaatctaagcatagccttcacygaaaaattaaagagtattttacat

SEQ ID NO: 110788 - DNA, 50 bp, homo sapien
aaggacattcccccatttccatttgytctgccattcaaaaccttgtgagg

SEQ ID NO: 110789 - DNA, 50 bp, homo sapien
aaccatacatttaaatgaagatatgwcaggagacccaagaagaacagaga

SEQ ID NO: 110790 - DNA, 50 bp, homo sapien
cataatttctctcatctccaatcaamaccttggagtaatttgatttttct

SEQ ID NO: 110791 - DNA, 50 bp, homo sapien
ggctatgctactgtataagtggtacyagcatagtcattaaagataagtct

SEQ ID NO: 110792 - DNA, 50 bp, homo sapien
agagaccttctatgaaagtctaataktgcaattctttcccttggctatct

SEQ ID NO: 110793 - DNA, 50 bp, homo sapien
ataagacttagaattgtattcattcratggtttacataatctcatagcta

SEQ ID NO: 110794 - DNA, 50 bp, homo sapien
cctcttccctcctcctcccttggcaragttccactgttgttcttcctccc

SEQ ID NO: 110795 - DNA, 50 bp, homo sapien
agtcaatgcttgagcaggattgcaakgagagatacatattagggaaaact

SEQ ID NO: 110796 - DNA, 50 bp, homo sapien
catttttggcccaactacatccaacyattaacagaaaatccttcttcaat

SEQ ID NO: 110797 - DNA, 50 bp, homo sapien
ttacttcaaaagatgaaggcttctayctacattgcatctctttcttttga

SEQ ID NO: 110798 - DNA, 50 bp, homo sapien
gcacaggcatggagagctggaatggyatatgcaagcaactgtgtattttg

SEQ ID NO: 110799 - DNA, 50 bp, homo sapien
tcagaactttcccacccacctacatmagacattgaggatgcctgacctgg

SEQ ID NO: 110800 - DNA, 50 bp, homo sapien
tggaactggagcatcctcactcaagragacaggtgaagaggagacagacc

SEQ ID NO: 110801 - DNA, 50 bp, homo sapien
atccacagaaattgattcatgtcccyactcatctttaccttagatcctct

SEQ ID NO: 110802 - DNA, 50 bp, homo sapien
tatgtccatctatagcttttgttcargtctgtatgaccagccaggttgtg

SEQ ID NO: 110803 - DNA, 50 bp, homo sapien
tacagacctgaacaaaagctatagayggacatatccagccaccttagaat

SEQ ID NO: 110804 - DNA, 50 bp, homo sapien
cataccaggtgtcagaaaggttattrgagatagttgggtagatagtattt

SEQ ID NO: 110805 - DNA, 50 bp, homo sapien
gagattttcagtttcttatgtattamaaatgttacacattggcaaagatt

SEQ ID NO: 110806 - DNA, 50 bp, homo sapien
acctttgtaatactaaaatatgaaamgattcaaaatggccttttaaaaaa

SEQ ID NO: 110807 - DNA, 50 bp, homo sapien
agggccaaggcaaacctggccaataygatcaatacctggatgcttaaaat

SEQ ID NO: 110808 - DNA, 50 bp, homo sapien
ctccaaccccatcatctgcatttcastttaatgaatctctatattttcat

SEQ ID NO: 110809 - DNA, 50 bp, homo sapien
ttttttgtctgccactgagcctaaaygacctgtagaagtgcagaaaccat

SEQ ID NO: 110810 - DNA, 50 bp, homo sapien
gattattcacatagcagttttcaaaygcaaaagtgttccctagtaattga

SEQ ID NO: 110811 - DNA, 50 bp, homo sapien
accctttccccggcacttttgccatkgtcctggtgtgttaccatcactca

SEQ ID NO: 110812 - DNA, 50 bp, homo sapien
aatacagcctttgccttcaaaatagycatggtctaaagaaatgacagcaa

SEQ ID NO: 110813 - DNA, 50 bp, homo sapien
tataccattattgatattctgggacrataaaacactcagaaaggcattct

SEQ ID NO: 110814 - DNA, 50 bp, homo sapien
cccagaatatcaataatggtataggrcattcccatcatcccacaccaggg

SEQ ID NO: 110815 - DNA, 50 bp, homo sapien
tgtcagagactggctggctcttcacyaagcccgtttgtttgttctcctcc

SEQ ID NO: 110816 - DNA, 50 bp, homo sapien
actggaatttttttggttatccactsacatgcaatttgacaaccataata

SEQ ID NO: 110817 - DNA, 50 bp, homo sapien
ttgctccccaatgtggaactgtgtcytgctatgcctgactgttgtgtgaa

SEQ ID NO: 110818 - DNA, 50 bp, homo sapien
tgtatattagctgatctattttagargccattgctccagttttatcctag

SEQ ID NO: 110819 - DNA, 50 bp, homo sapien
cgccagcttctgcttccactgtagayactttgatgatgattcttttggaa

SEQ ID NO: 110820 - DNA, 50 bp, homo sapien
ggtacctccagtcccagagaaccgcrcctagtaaacatatttggaggtgg

SEQ ID NO: 110821 - DNA, 50 bp, homo sapien
agggaaggcctcagagacgtggtagyatttgagatgaatattcgttggta

SEQ ID NO: 110822 - DNA, 50 bp, homo sapien
cttgcaggagctgaagtgtgatcctsagaggcaccaggaaatagctggag

SEQ ID NO: 110823 - DNA, 50 bp, homo sapien
cttattaaatatttactttgtgtcartaatactagttctcagtgctgaag

SEQ ID NO: 110824 - DNA, 50 bp, homo sapien
atccactgttctgaaatgtcctaacratgtagctttttggagtaattttc

SEQ ID NO: 110825 - DNA, 50 bp, homo sapien
atcctatcattgataataaagaaccrccttaacaacaatagttttattaa

SEQ ID NO: 110826 - DNA, 50 bp, homo sapien
tgaaagtggctagtaaagaatgaaartatcagaaaatttagaatgccatg

SEQ ID NO: 110827 - DNA, 50 bp, homo sapien
gctctagtgaataaatcgttcatagwcctatacagattcatccatactct

SEQ ID NO: 110828 - DNA, 50 bp, homo sapien
ggccacctctgtgcatctttcataayccacgtgtccaggtggccgtggac

SEQ ID NO: 110829 - DNA, 50 bp, homo sapien
agacgtgaccctagatcaccatatawaatgtttgcaaatatttttatggt

SEQ ID NO: 110830 - DNA, 50 bp, homo sapien
cctatggtctctataagatccagtgwagagttcatcctactcactgttga

SEQ ID NO: 110831 - DNA, 50 bp, homo sapien
aagagttctgtaaacaaccagacttyggaatagttggacagaaaggtgtt

SEQ ID NO: 110832 - DNA, 50 bp, homo sapien
acaccctgttggcaaaatgttttggratacgactcttgggctcaatacag

SEQ ID NO: 110833 - DNA, 50 bp, homo sapien
ccattgtttagataatttatttaacrcattctccaacatttggcttgtag

SEQ ID NO: 110834 - DNA, 50 bp, homo sapien
aaagcagaaaattttgttaagatccrcagacttttgattatagagttaac

SEQ ID NO: 110835 - DNA, 50 bp, homo sapien
gtatgtattttaagaaaaatgcccaytatttggtactactcttaccaatt

SEQ ID NO: 110836 - DNA, 50 bp, homo sapien
tgactaatctggatgtactaatatcragacaaacaaatgaaaaccaagta

SEQ ID NO: 110837 - DNA, 50 bp, homo sapien
gcactgtcattagcctcctgtggctraattctgattgtgtccacttcatt

SEQ ID NO: 110838 - DNA, 50 bp, homo sapien
actggtgccaagcaacatgtaacagycatgggagtgagatgcagaacttc

SEQ ID NO: 110839 - DNA, 50 bp, homo sapien
aatcaaagtaccttactagaatcacrggaatccacaatagacattacagt

SEQ ID NO: 110840 - DNA, 50 bp, homo sapien
agttcaccttctaatgtcaaccgaarcaaatttggaatttaaaggatatg

SEQ ID NO: 110841 - DNA, 50 bp, homo sapien
tgtttccctttgaacattgaggaagsctgaatcctttagaatacaatatc

SEQ ID NO: 110842 - DNA, 50 bp, homo sapien
tgaagagcgatgggtagtgttactcyaaattgctggcttcagttttttgg

SEQ ID NO: 110843 - DNA, 50 bp, homo sapien
gctggagtgagcaaagtctgttcccrgaagaagactgtcacaggaagatt

SEQ ID NO: 110844 - DNA, 50 bp, homo sapien
tgaagttgagccacttgtcaaaggcracagttagtaagagatgaagctga

SEQ ID NO: 110845 - DNA, 50 bp, homo sapien
gttaagaccattttaacctgacttgyagcaatggagtgggctttagctct

SEQ ID NO: 110846 - DNA, 50 bp, homo sapien
ctagcttcagtgagctcttattcccrcctgaatactcaataagggagaac

SEQ ID NO: 110847 - DNA, 50 bp, homo sapien
gcaaagttaatattgaccataaagaragagaagccttagttagaaccatt

SEQ ID NO: 110848 - DNA, 50 bp, homo sapien
agaaagcatctaaacttttcaaatayacgaggcaagatttacattcctct

SEQ ID NO: 110849 - DNA, 50 bp, homo sapien
gctgacaaagagaaattaaggctgakaatgcaaaactgagtcagcatggt

SEQ ID NO: 110850 - DNA, 50 bp, homo sapien
agcctattttggtcatttgttcaaaygtttacttgttatgagaactgggg

SEQ ID NO: 110851 - DNA, 50 bp, homo sapien
cataaatgataataactcatgaacamttttaagaattacatcctgcagat

SEQ ID NO: 110852 - DNA, 50 bp, homo sapien
ctttccttcaatgatccacaatactractagcaatctgagactgaaagtt

SEQ ID NO: 110853 - DNA, 50 bp, homo sapien
tgagtaataaagttccattaagaatsaagtttgcagcaaagaccaggtta

SEQ ID NO: 110854 - DNA, 50 bp, homo sapien
catgaaccatcagcgaactatggtamagttgacctagacttggaagaata

SEQ ID NO: 110855 - DNA, 50 bp, homo sapien
accacagaatttctgttaggtgaccyggattaggacagttcaagttacac

SEQ ID NO: 110856 - DNA, 50 bp, homo sapien
atggctattggtgggattattttaaygactgctgcctccactataatgtc

SEQ ID NO: 110857 - DNA, 50 bp, homo sapien
ggaccgtccttgtgatttgctttgaygtacaagtatttcaagaaaattat

SEQ ID NO: 110858 - DNA, 50 bp, homo sapien
atagtttaatgaaacatactcaaatrtaagtagacataagtatattcagc

SEQ ID NO: 110859 - DNA, 50 bp, homo sapien
aggagagtatgctcagcatgttccaygtatgattgagtatgctttttgtt

SEQ ID NO: 110860 - DNA, 50 bp, homo sapien
tgagaggaagaaaagttagaagtcakaagaaggcctgtcaatcaattgac

SEQ ID NO: 110861 - DNA, 50 bp, homo sapien
agttaagaaaattgataatactggaraataggactcattgtaggcaatct

SEQ ID NO: 110862 - DNA, 50 bp, homo sapien
ttcttatccatgtaataagactcatmatagtatgtaataagattccagtg

SEQ ID NO: 110863 - DNA, 50 bp, homo sapien
aatcaaaatttaaaaaataaacctasatcagagtgggccccagagtgcgt

SEQ ID NO: 110864 - DNA, 50 bp, homo sapien
ccttccctcaggtacgttaggctctratgaaacctcagcagatcaagctc

SEQ ID NO: 110865 - DNA, 50 bp, homo sapien
ttcaaatacctcatgtaatatataakgtctaattccttgcatcttttctc

SEQ ID NO: 110866 - DNA, 50 bp, homo sapien
ttgcctatatcaaaaggttatcaaaytaatgtacatttatatgttttcaa

SEQ ID NO: 110867 - DNA, 50 bp, homo sapien
aattcagattatatgactagtgcaaygtaatcataggactttcctagtat

SEQ ID NO: 110868 - DNA, 50 bp, homo sapien
gtgggtgtgattcaaacagtggacayggaacataaattggcagacataca

SEQ ID NO: 110869 - DNA, 50 bp, homo sapien
gggacttgggaccaacaaaatgctarccagtgaaataagttgtagagcct

SEQ ID NO: 110870 - DNA, 50 bp, homo sapien
tcataagactctcagaccctgtataygtaaaaccagctatctagacagtg

SEQ ID NO: 110871 - DNA, 50 bp, homo sapien
ggtcttcccatttgtacaaatgcaayataaagtctaagatatttatccgt

SEQ ID NO: 110872 - DNA, 50 bp, homo sapien
cttaaaatactagactcttagtacartgaaacatgaatcacataatgaga

SEQ ID NO: 110873 - DNA, 50 bp, homo sapien
ttaatttgctttatatttcactttaygtataatctgtgcttagccagatc

SEQ ID NO: 110874 - DNA, 50 bp, homo sapien
gaatatctcacaagaacttaatttarcatgagattgagaatttctgactg

SEQ ID NO: 110875 - DNA, 50 bp, homo sapien
gaactcatattttgttctggtaagaygtgcagtgactacttattaaatag

SEQ ID NO: 110876 - DNA, 50 bp, homo sapien
ttatttaatggacaaatacatgcackatcaggtggttacatgaatctcca

SEQ ID NO: 110877 - DNA, 50 bp, homo sapien
aagagaaatgagaaaatggaagttayaatgatgttaagtatatctcccag

SEQ ID NO: 110878 - DNA, 50 bp, homo sapien
tttaatatattaagtaagcagggtamgtgattgattttccttctgtgtcc

SEQ ID NO: 110879 - DNA, 50 bp, homo sapien
aaagtgtttcctttgttctaataaasagaagtctctcctcactgcacttc

SEQ ID NO: 110880 - DNA, 50 bp, homo sapien
tttcttgacttgggccctatttaacrctagtcttctaagtcacctaatgg

SEQ ID NO: 110881 - DNA, 50 bp, homo sapien
actcctgacaggaaaggattccagasagtaactgaaataaaagatagaca

SEQ ID NO: 110882 - DNA, 50 bp, homo sapien
cttttgttctcatctataatctggakgagattgtaacaattttttttctg

SEQ ID NO: 110883 - DNA, 50 bp, homo sapien
attgggaacatttccaaggtcataaraaaggacacatcaggctctagagt

SEQ ID NO: 110884 - DNA, 50 bp, homo sapien
taggatgaatattgtgtgagattcayggtataaaaatattgcattgaaat

SEQ ID NO: 110885 - DNA, 50 bp, homo sapien
gggcttcttccaagagctggaaaacsgcatttgttccacagaataagaag

SEQ ID NO: 110886 - DNA, 50 bp, homo sapien
tcctgttatttgagccaaggtttaayatgattcttgtacttagttggctt

SEQ ID NO: 110887 - DNA, 50 bp, homo sapien
tatagactctttcatgtacatgatamctctttaactctgagcatgtggtg

SEQ ID NO: 110888 - DNA, 50 bp, homo sapien
ttatcagcaaacttatagaaagaaaytatctttgaagactagcaagctgc

SEQ ID NO: 110889 - DNA, 50 bp, homo sapien
taccaattatttaatgaactatcccraaagtacaaggatagaaatatgta

SEQ ID NO: 110890 - DNA, 50 bp, homo sapien
gttatcgatccagtggggattatgcraaaaacgatgacttgctgatctag

SEQ ID NO: 110891 - DNA, 50 bp, homo sapien
gattcaaagcagacctatccattggyattgagagaaacagtgtctctttt

SEQ ID NO: 110892 - DNA, 50 bp, homo sapien
aagagggggaaacagaagtaaagacrctatgcatttgggaatgtcgcact

SEQ ID NO: 110893 - DNA, 50 bp, homo sapien
ctgaatagacaaatactaagttccawaattgaattaataataaaaaccct

SEQ ID NO: 110894 - DNA, 50 bp, homo sapien
gattctagaaagaagtgtggttcagrcagtttacaattaaagaaggaggg

SEQ ID NO: 110895 - DNA, 50 bp, homo sapien
gaggttccattctccaggacacgaargtatagaaatgctcaacattttgt

SEQ ID NO: 110896 - DNA, 50 bp, homo sapien
tgttgaatagggatggtatttttgayagcaaataacaaagctcagaacct

SEQ ID NO: 110897 - DNA, 50 bp, homo sapien
tgagcctaacaaatcaatgatttgartagacatggaagaaatacgattac

SEQ ID NO: 110898 - DNA, 50 bp, homo sapien
aggcagtgagagcaagactgacataygttgggaaagtcaaatgttgaggc

SEQ ID NO: 110899 - DNA, 50 bp, homo sapien
cttttaaggttggcactgagagctaygggaactggacttgacaatactta

SEQ ID NO: 110900 - DNA, 50 bp, homo sapien
gaagcacaggagttaagatcagagamcacatttttcctggcaccagactg

SEQ ID NO: 110901 - DNA, 50 bp, homo sapien
atgatttttattttagaaagaaatartatacctcaccaccctcaaaatta

SEQ ID NO: 110902 - DNA, 50 bp, homo sapien
ccagactgtaagaaggagtgtatcasctagatctttagaaacatgacaat

SEQ ID NO: 110903 - DNA, 50 bp, homo sapien
ttctggaagtgcaaaggacagacacraaatttggagagcactttagggga

SEQ ID NO: 110904 - DNA, 50 bp, homo sapien
acattattcattcatgagagacctaratttgagaaaaccaattatcctgt

SEQ ID NO: 110905 - DNA, 50 bp, homo sapien
tcaacgtaactggctaaggcttcaarttcttcaataagaaattgaggcca

SEQ ID NO: 110906 - DNA, 50 bp, homo sapien
ctcctattttttgcattttcttaccyatggtgccataacccaggaatgtg

SEQ ID NO: 110907 - DNA, 50 bp, homo sapien
gggaaaagatagcctcttcaataaayagcgatgagaaaactgaatatcca

SEQ ID NO: 110908 - DNA, 50 bp, homo sapien
gtttacaatggaaatgactaggaaaygctggaagtgactaaatttggcca

SEQ ID NO: 110909 - DNA, 50 bp, homo sapien
ccaaaaggtgggggaaaaaaatctcrccttatgactcggccaatttattc

SEQ ID NO: 110910 - DNA, 50 bp, homo sapien
aggatttttgtgtccatgttcattargaatattatcctgtaatttccttt

SEQ ID NO: 110911 - DNA, 50 bp, homo sapien
ttctgatttcacactaggcaatctaygtgcagcaccttcttttaaagaat

SEQ ID NO: 110912 - DNA, 50 bp, homo sapien
cccactccagttcccacgtggcttgyactttgtatcttgtgttcaagcaa

SEQ ID NO: 110913 - DNA, 50 bp, homo sapien
acaaaaaaaagaaaactacaagtcartcttcctgatgaacacagatgcaa

SEQ ID NO: 110914 - DNA, 50 bp, homo sapien
agcccattacaagagcctcggagacwatttgtaggtgcagggaaacactg

SEQ ID NO: 110915 - DNA, 50 bp, homo sapien
aacaaaataagtgtctgacagaaaaytgtgttcacagaagtcaagccact

SEQ ID NO: 110916 - DNA, 50 bp, homo sapien
aatcattgttatccacataagaaacygaggtctggaattctaggttatca

SEQ ID NO: 110917 - DNA, 50 bp, homo sapien
ttctatttttctctcattttcagaasaacttggcagcatttgtagtattg

SEQ ID NO: 110918 - DNA, 50 bp, homo sapien
ggcaaaagaaacgataataagggaayaggaactgttttaaacaaaatgcc

SEQ ID NO: 110919 - DNA, 50 bp, homo sapien
accataactagtaccatactaacacrattaccattatatccagggtggtg

SEQ ID NO: 110920 - DNA, 50 bp, homo sapien
aatgttttatcaacccttctatgccrtacttatcactgtgttcctctgag

SEQ ID NO: 110921 - DNA, 50 bp, homo sapien
tcctcacatccactgctttcaataaytcactccacttatgtcttacaaaa

SEQ ID NO: 110922 - DNA, 50 bp, homo sapien
aatcatctttatatttaccaacataraatggaaagaaagaaataaaagta

SEQ ID NO: 110923 - DNA, 50 bp, homo sapien
agtacagaggcattagcattatgacwatatcactacttaaaaattatttt

SEQ ID NO: 110924 - DNA, 50 bp, homo sapien
aagtgtaatagagaaaaatagggacwagagtttccaggtaaaaacatttc

SEQ ID NO: 110925 - DNA, 50 bp, homo sapien
cagcacttcaaaacatccattatgcraaagccttgagctacaacatctat

SEQ ID NO: 110926 - DNA, 50 bp, homo sapien
tgttcattgtcatagtcccctgtcawatagaagacgctccataaataatt

SEQ ID NO: 110927 - DNA, 50 bp, homo sapien
acttgaaggaatagaaagagaatagwcagtttacatgcaccagtcagggt

SEQ ID NO: 110928 - DNA, 50 bp, homo sapien
catggttcttgagaaatacctaagtsacctctgcaaaactttaagtgtag

SEQ ID NO: 110929 - DNA, 50 bp, homo sapien
cttttcttgtttttgtcaagtttgtsaattaggtgttcaattaggaaaag

SEQ ID NO: 110930 - DNA, 50 bp, homo sapien
tagagttcataaggttgaactatcasattttttctaaagttaataaaaca

SEQ ID NO: 110931 - DNA, 50 bp, homo sapien
aaaggactgtttttatgtaacaaaakgtatggattcaagaagaagcaaag

SEQ ID NO: 110932 - DNA, 50 bp, homo sapien
tttttaggggaaactaatggaattamaattacaatgtcataggaaaattt

SEQ ID NO: 110933 - DNA, 50 bp, homo sapien
ttgagtatcttctctaaacaaggcartagaaagtagtagggttctagagt

SEQ ID NO: 110934 - DNA, 50 bp, homo sapien
attagacatttgagacctggcataakgtcatatacctcgggattacatgg

SEQ ID NO: 110935 - DNA, 50 bp, homo sapien
aagttctcttgcttcttttttaatartatatctttgaggttgagtgctat

SEQ ID NO: 110936 - DNA, 50 bp, homo sapien
acacagatagaatcataccaatccawgtgttatataagtaaaaacaaatc

SEQ ID NO: 110937 - DNA, 50 bp, homo sapien
aacattctagggtgccctaggatgawccatttagaaagccaagatcagag

SEQ ID NO: 110938 - DNA, 50 bp, homo sapien
gacacaaaattgaaaaatagacctcyagcattagtcacatacttactcct

SEQ ID NO: 110939 - DNA, 50 bp, homo sapien
ataagactacatgatttagaaccaaraaaaacaatagaaatggaaatgca

SEQ ID NO: 110940 - DNA, 50 bp, homo sapien
aatcatgtgaggtaaaagtcttctartagaaccagcatgatcttccagaa

SEQ ID NO: 110941 - DNA, 50 bp, homo sapien
agtcaatgcctagtttcaaagattcraagaataagctaactctcttagta

SEQ ID NO: 110942 - DNA, 50 bp, homo sapien
atttcagtggccaaaaggcaggtacratgggacaaaataaataacttcaa

SEQ ID NO: 110943 - DNA, 50 bp, homo sapien
catctttgacaccgagagaagttacygaacaaaaggctgctctactccct

SEQ ID NO: 110944 - DNA, 50 bp, homo sapien
gtccttgggttagttatttccagtargaacagtgaattaggagagccagg

SEQ ID NO: 110945 - DNA, 50 bp, homo sapien
cttgtttgactgtttcaaaaatataytaatttatcccagtctagaggaaa

SEQ ID NO: 110946 - DNA, 50 bp, homo sapien
cagtgccccatattttcttgaggaawcttccagtggtggtagatgtaact

SEQ ID NO: 110947 - DNA, 50 bp, homo sapien
cagtagcttttgttatttataatgarcctgttttgatcatacctgagttt

SEQ ID NO: 110948 - DNA, 50 bp, homo sapien
ttcatggcaagcatttcttaccttayctgaactctagcagtctccaaagt

SEQ ID NO: 110949 - DNA, 50 bp, homo sapien
atgtagagaaactgtaaaacacatasaccaattctaaaactttggttact

SEQ ID NO: 110950 - DNA, 50 bp, homo sapien
tgaactatttttaataaaatatcaamtatggacagaatgcatgtatccta

SEQ ID NO: 110951 - DNA, 50 bp, homo sapien
ttcataaccatgatacagatttcaamcatataactcttttaaaaacacaa

SEQ ID NO: 110952 - DNA, 50 bp, homo sapien
taataaaattattaaatagcaaagaytcttcatgagataagaactttttt

SEQ ID NO: 110953 - DNA, 50 bp, homo sapien
gattaaatacctatgtagtgaatgamtagctgagatcttcagcaagttac

SEQ ID NO: 110954 - DNA, 50 bp, homo sapien
tgcaggatacatgcctagcacctaayaagtttccaaaaatgatcattagt

SEQ ID NO: 110955 - DNA, 50 bp, homo sapien
ttaattataaaaatcttctatggtgmaactttccttgctatgcacttaat

SEQ ID NO: 110956 - DNA, 50 bp, homo sapien
ggacattacttcaactgaagtaggcragaaaaataacagcttcccaatat

SEQ ID NO: 110957 - DNA, 50 bp, homo sapien
gaatgaatgcatgccgaaaaatggaytagactggagaggaagtaatgtca

SEQ ID NO: 110958 - DNA, 50 bp, homo sapien
ttagaattaaaaattcacaacagaawgattaagttcatcatctgattaag

SEQ ID NO: 110959 - DNA, 50 bp, homo sapien
acctgtacataatttttctacctgcyatgtgatcttgttaactgaaaata

SEQ ID NO: 110960 - DNA, 50 bp, homo sapien
aagggaatggtggttgaaagcaatayaatgcaaagtggaaagaatcaagg

SEQ ID NO: 110961 - DNA, 50 bp, homo sapien
taggaagcatttgaattctacctaaygttacaactatgcagtctttagat

SEQ ID NO: 110962 - DNA, 50 bp, homo sapien
ctttgcttttttagagattttggaawtattagtgcactttgagatttagc

SEQ ID NO: 110963 - DNA, 50 bp, homo sapien
aactttacctactacattgattgaarggctattccattcatagtgtgata

SEQ ID NO: 110964 - DNA, 50 bp, homo sapien
tctaaaaaagcaaagtttttacttaygttgtgaaccagattgtgaaagtt

SEQ ID NO: 110965 - DNA, 50 bp, homo sapien
tatttttgtatttgtaattctgtgaygtctatatttactttttctgttta

SEQ ID NO: 110966 - DNA, 50 bp, homo sapien
agagaaccatcattcactatccaggraccacttaacatactgtgattacc

SEQ ID NO: 110967 - DNA, 50 bp, homo sapien
atgagttttgttgcagcatggattarctatacatttgtattaaaaaggtg

SEQ ID NO: 110968 - DNA, 50 bp, homo sapien
aatgctaatttgtgacaatggaacaracacattatttcaactggttggag

SEQ ID NO: 110969 - DNA, 50 bp, homo sapien
actcagtttgtatttgtttatttatyacataagtgacactttggcaagtt

SEQ ID NO: 110970 - DNA, 50 bp, homo sapien
tcagattccttatgattcagacctaygtgattagattcagaacataatag

SEQ ID NO: 110971 - DNA, 50 bp, homo sapien
aatccataaaatccattttatgtcargaaaggaataatttgtagtccatg

SEQ ID NO: 110972 - DNA, 50 bp, homo sapien
ctggcacaggaaaattcttcaaagaygacgtgttgaattgtagctttata

SEQ ID NO: 110973 - DNA, 50 bp, homo sapien
ccatattctttttttccctcagtcaytgacaattggtagttatttataaa

SEQ ID NO: 110974 - DNA, 50 bp, homo sapien
tggtcttttagagaaggctactgcartcttagatctggtctaaatagcca

SEQ ID NO: 110975 - DNA, 50 bp, homo sapien
agtcttgagctaggagactaagtggwtagaaaagacatgcatctgagggc

SEQ ID NO: 110976 - DNA, 50 bp, homo sapien
agatcagttattcataaactcacaarataaaacacattaacaacacaata

SEQ ID NO: 110977 - DNA, 50 bp, homo sapien
acatctgggtggcactagccaaggcygcagtgttgtagaaggatgtgaaa

SEQ ID NO: 110978 - DNA, 50 bp, homo sapien
actgtaacattactaagattataggyagatgaagtgaaatacaatagtct

SEQ ID NO: 110979 - DNA, 50 bp, homo sapien
gataatatatcattagtataaaatcracaaggaagaggtaaaacctgatt

SEQ ID NO: 110980 - DNA, 50 bp, homo sapien
tttatttggaatgcaatcagtatctraagaatggcctacaagggctttga

SEQ ID NO: 110981 - DNA, 50 bp, homo sapien
tgctattctagaatgtttattttctsaaaacaggaattttttctcattca

SEQ ID NO: 110982 - DNA, 50 bp, homo sapien
tctcatcctacatttaaaatcacaaygctttgttctgaaactatgactga

SEQ ID NO: 110983 - DNA, 50 bp, homo sapien
atctgaattttatagtcaagttgaasgaatatacattttttctaggtaca

SEQ ID NO: 110984 - DNA, 50 bp, homo sapien
aagatattcagcttttgaatagtatyagacacttttaaatagcaagattc

SEQ ID NO: 110985 - DNA, 50 bp, homo sapien
gccttaaaagtgcctgattcccagastacaatatggtatgtcttgctccc

SEQ ID NO: 110986 - DNA, 50 bp, homo sapien
tggtacaaactgctgaagaaacactractgtgaaacagatccaaaaaatt

SEQ ID NO: 110987 - DNA, 50 bp, homo sapien
aaaacatagctgggccgccctgaaaygaatcagaggaaaaagggaacaac

SEQ ID NO: 110988 - DNA, 50 bp, homo sapien
ttatgggcgatgcgaccactgaataytactgagtttcttctgaagcctgt

SEQ ID NO: 110989 - DNA, 50 bp, homo sapien
ttagcgttttattcactaatgactayaatacaaaccctaaagaatctttc

SEQ ID NO: 110990 - DNA, 50 bp, homo sapien
tggtgcagattaaaacttgagatacsgaacatcattcttttattttcctg

SEQ ID NO: 110991 - DNA, 50 bp, homo sapien
agtgtcatgcaaatgacttttctgarcaaagatctactccaaaattgttt

SEQ ID NO: 110992 - DNA, 50 bp, homo sapien
ggtggagctcaggtagtaataccaaygatggggagtggctgtaaatgcag

SEQ ID NO: 110993 - DNA, 50 bp, homo sapien
caataaaaaagacattttatgcctaktaataaagaagacattttgtaagg

SEQ ID NO: 110994 - DNA, 50 bp, homo sapien
taaaatgtcttttttattgatattcrcagctggaatgaaaaatgcttaaa

SEQ ID NO: 110995 - DNA, 50 bp, homo sapien
gatgaacacatttcaaatggtcttaygtacttctccatcagatactcttg

SEQ ID NO: 110996 - DNA, 50 bp, homo sapien
aaccctaagatagcaatggttgttaraattgacagatcaccctaatattt

SEQ ID NO: 110997 - DNA, 50 bp, homo sapien
tctatgcacatccttttgtatacttsaaattatctttagagtacctaata

SEQ ID NO: 110998 - DNA, 50 bp, homo sapien
acacacctttggccagaaagtaaccygaggacttgaaggaaacaacccag

SEQ ID NO: 110999 - DNA, 50 bp, homo sapien
gaaggagtaatgtgggaaaaaaacawctgcttagaagcacaggaatataa

SEQ ID NO: 111000 - DNA, 50 bp, homo sapien
ctctaaatgactaagataattatacygtaaatgtcaagtttagcattcct

SEQ ID NO: 111001 - DNA, 50 bp, homo sapien
aatctaaggagcaagcccatgatgastattattagaatcaaggttcttgt

SEQ ID NO: 111002 - DNA, 50 bp, homo sapien
ttatggaaaagacatgatttagcaayagtattaaaggcagaaactttaaa

SEQ ID NO: 111003 - DNA, 50 bp, homo sapien
aattatatttgctaattggaactacragtaagaataagattatagagaag

SEQ ID NO: 111004 - DNA, 50 bp, homo sapien
catgtatatttatgtagaagtgaagygtaaaatctaatctcttaggattt

SEQ ID NO: 111005 - DNA, 50 bp, homo sapien
ttattactgcttgtaccacaaagtasaattcacaacacttaaaaaataca

SEQ ID NO: 111006 - DNA, 50 bp, homo sapien
gtatgtgaaggaggtgtgattgataygcaggacttggagattaactgtgt

SEQ ID NO: 111007 - DNA, 50 bp, homo sapien
agtaattgaacataaaaacatttggracaagaaggactgtataaatgaac

SEQ ID NO: 111008 - DNA, 50 bp, homo sapien
ccagtcaagggcactatatctacaakgtacactcaaatttcctggatttg

SEQ ID NO: 111009 - DNA, 50 bp, homo sapien
aaactggagttatttaggtttagaarcattttagctaataaaggtatttc

SEQ ID NO: 111010 - DNA, 50 bp, homo sapien
ccactacgtaagatttcagaatgggycaagcttaggtaactaactttgca

SEQ ID NO: 111011 - DNA, 50 bp, homo sapien
gcctcatctgcctcaggttctctgaraagtcaaattgcacttgggaattc

SEQ ID NO: 111012 - DNA, 50 bp, homo sapien
gctggccaatgggtacaagaaataaytgggtgagcaagtgcgtttctttg

SEQ ID NO: 111013 - DNA, 50 bp, homo sapien
gtattatgtttgaatccacacttagrccaatttgcagatatcattagtgt

SEQ ID NO: 111014 - DNA, 50 bp, homo sapien
agaataagattatagagaaggattayggagacagaaaatgacaggttaag

SEQ ID NO: 111015 - DNA, 50 bp, homo sapien
tatagaaagtcattattactgtcaamtaataagtcatactagattttttt

SEQ ID NO: 111016 - DNA, 50 bp, homo sapien
gctgtgagctcagcaacccaggaaaygtaccacctctctggtgactctac

SEQ ID NO: 111017 - DNA, 50 bp, homo sapien
tcatcaaatattttgccattgcatartaaggggtatcagattatcagctt

SEQ ID NO: 111018 - DNA, 50 bp, homo sapien
tttgtgttgttgcttgtaaatcgatygctttctttctgagctgaaatctt

SEQ ID NO: 111019 - DNA, 50 bp, homo sapien
ccatggagctcatagtcaagataacratcatctattcaaaatggcacatg

SEQ ID NO: 111020 - DNA, 50 bp, homo sapien
tttcctcccaatttttatagctttamggcctcgatgattttatggttaat

SEQ ID NO: 111021 - DNA, 50 bp, homo sapien
ttgagtttgcaattacagtctctcayaggcattacctgtgatcagctgca

SEQ ID NO: 111022 - DNA, 50 bp, homo sapien
actagaaactattgacaagtaagacygaatatttgtgttgtaatgtctac

SEQ ID NO: 111023 - DNA, 50 bp, homo sapien
ccttgctgcttttctgtgccacttayggaatttgaggtgatgactttggc

SEQ ID NO: 111024 - DNA, 50 bp, homo sapien
aagtttaatatgcttatatatgggartaagtgacttaactttttgtagaa

SEQ ID NO: 111025 - DNA, 50 bp, homo sapien
tatattggtgcttataatatgttatsagaagaatagtttttgctgcatgt

SEQ ID NO: 111026 - DNA, 50 bp, homo sapien
tcgtttacaaacaaatataaacgtamcttatgatagagttattctgtaaa

SEQ ID NO: 111027 - DNA, 50 bp, homo sapien
aaaagctcattttctaggcataatayattttgaggttaatgcactgtaat

SEQ ID NO: 111028 - DNA, 50 bp, homo sapien
ctttcatagataaataatgagctacsattaactccaaaattattccatga

SEQ ID NO: 111029 - DNA, 50 bp, homo sapien
aggtatctaaacaagtgcatgaaaaraataggactgaaaagtatgatggc

SEQ ID NO: 111030 - DNA, 50 bp, homo sapien
tcccataatttgcaagttgtcttgaragcacaagtgccagaaaggcagag

SEQ ID NO: 111031 - DNA, 50 bp, homo sapien
ctgattaccttcatctttaatattcrcacttattagatcaatctccctgt

SEQ ID NO: 111032 - DNA, 50 bp, homo sapien
tatctcagaaaaatgaccagttcttyctaagtctttcattttattgaata

SEQ ID NO: 111033 - DNA, 50 bp, homo sapien
gttgttgttttctgggggcatggaartaattgtgatttgaagtttctgtt

SEQ ID NO: 111034 - DNA, 50 bp, homo sapien
tagcgagttgttctccatcatacaaytaacaagtagaagagccgaggcca

SEQ ID NO: 111035 - DNA, 50 bp, homo sapien
cagccctgttcatgctaattttaaakctctcttaatcttacagtaaatgt

SEQ ID NO: 111036 - DNA, 50 bp, homo sapien
tagagtagaccagactaagataaacsaacattgcagatgagcattaagac

SEQ ID NO: 111037 - DNA, 50 bp, homo sapien
accagtctgagacaacagatggaaakatagatgattataataaggatgaa

SEQ ID NO: 111038 - DNA, 50 bp, homo sapien
caacatttttttgtatgactttagcrcagtgaacataacagaacacataa

SEQ ID NO: 111039 - DNA, 50 bp, homo sapien
tctgtgtttagaattttgacattcargacaggtccatcttcattatggta

SEQ ID NO: 111040 - DNA, 50 bp, homo sapien
agcaattagtaccctaagcgtgcacrgagaagtttgtaaaagtcattctt

SEQ ID NO: 111041 - DNA, 50 bp, homo sapien
aaataggcctttttaagctcaaaatsagttctgtatgctgaatggactct

SEQ ID NO: 111042 - DNA, 50 bp, homo sapien
caatagttaattcatgattttgtacyggtaatattttgatataataataa

SEQ ID NO: 111043 - DNA, 50 bp, homo sapien
agaaagtaaagtactaatgtaagagyaaagtgttatataagatcgtctac

SEQ ID NO: 111044 - DNA, 50 bp, homo sapien
agcactggcagaggaaaggattagartaatgagataactttctacaatat

SEQ ID NO: 111045 - DNA, 50 bp, homo sapien
gtatctaggtttacgctctttggaaratgatatttgctgtggaacagaag

SEQ ID NO: 111046 - DNA, 50 bp, homo sapien
tgtgaaagtttattaactactaaaayggatttgtattgattataaaatag

SEQ ID NO: 111047 - DNA, 50 bp, homo sapien
cttagaattaatttttcctctcttarccatctcataaatcctaaattcct

SEQ ID NO: 111048 - DNA, 50 bp, homo sapien
atcatttcatgatacaataacattgraactgagcatatcagaaattaacc

SEQ ID NO: 111049 - DNA, 50 bp, homo sapien
tttcatcaatgccataattatacaasgtggcaacggcttgatctgcactt

SEQ ID NO: 111050 - DNA, 50 bp, homo sapien
gtgaagacaaacacagaagcagatamatataacacagactcacaaacaga

SEQ ID NO: 111051 - DNA, 50 bp, homo sapien
tgccagttaataacatgtttcaaaasacaaggcagcattgagcttgtaaa

SEQ ID NO: 111052 - DNA, 50 bp, homo sapien
cacccctgtcagcagtgtgtggcagrcctttaggaacaatgaaatcctca

SEQ ID NO: 111053 - DNA, 50 bp, homo sapien
tgatacttctgaaaacatgactttasgaaataaacaagaacaaaatctaa

SEQ ID NO: 111054 - DNA, 50 bp, homo sapien
ccaatagcactgaaccaaaggacaayattctggcagaatgacagtggcag

SEQ ID NO: 111055 - DNA, 50 bp, homo sapien
ggacattttaacaacattcattctaycaatctataaacatacctttttat

SEQ ID NO: 111056 - DNA, 50 bp, homo sapien
tcagtcagccaacatttcttgaacamcttttatgtgtgaagaataattct

SEQ ID NO: 111057 - DNA, 50 bp, homo sapien
ctgttttctggcactattattcaaamaaaatcatgtaaaaactgtgtcca

SEQ ID NO: 111058 - DNA, 50 bp, homo sapien
caatgcaactgtggtgaacaggaccrctattattccttagatcaaaagga

SEQ ID NO: 111059 - DNA, 50 bp, homo sapien
gaccttacttgtcttgtactccactkcattcccagtacctggaacagtgc

SEQ ID NO: 111060 - DNA, 50 bp, homo sapien
ttacataaatttattataagtcatayagattgtggatgaaccagcattcc

SEQ ID NO: 111061 - DNA, 50 bp, homo sapien
ggactaaagtaaatctcttgccttamcctggaaataactaggttgggaaa

SEQ ID NO: 111062 - DNA, 50 bp, homo sapien
tactgctccaagaagtcaaatggaaratacggaaaagattattcacaaca

SEQ ID NO: 111063 - DNA, 50 bp, homo sapien
cagcgttaatggtattagctactacraaactgccaattaatactaatttt

SEQ ID NO: 111064 - DNA, 50 bp, homo sapien
ttaacattattttctatggtttgaastcttggtaattacctcctcaaaca

SEQ ID NO: 111065 - DNA, 50 bp, homo sapien
aagtatttattcaataaatgtttccrgataaagaataatatctaacactt

SEQ ID NO: 111066 - DNA, 50 bp, homo sapien
aaaaagtatgcacttatattcctaastccgtatctcagtagtctcaattt

SEQ ID NO: 111067 - DNA, 50 bp, homo sapien
gacatatttattcaatgcaagtgtcyattctggtgaccagtcacaatttc

SEQ ID NO: 111068 - DNA, 50 bp, homo sapien
atccaccattttgaaatctaattcasgctcaaaactatatctggtttgtg

SEQ ID NO: 111069 - DNA, 50 bp, homo sapien
gaaaattgaatgtgacaggtgttcartaaataattggttcaataaattgg

SEQ ID NO: 111070 - DNA, 50 bp, homo sapien
ataggcacagtatccatctacctcaraatatttaaaacagtcatactaag

SEQ ID NO: 111071 - DNA, 50 bp, homo sapien
caaataaggtgtcatgttcaagtacrctatctcttcaaattgttttgaag

SEQ ID NO: 111072 - DNA, 50 bp, homo sapien
acaggaatcgcttatggtaatatgaractctgagaatatccccccccaaa

SEQ ID NO: 111073 - DNA, 50 bp, homo sapien
agacatgcgcttctgaagacctgtgmagtagggaaagccgagttttttga

SEQ ID NO: 111074 - DNA, 50 bp, homo sapien
attgaaagcaacaggaatttttataracagatggttgaagtgaaagtcca

SEQ ID NO: 111075 - DNA, 50 bp, homo sapien
ctctactgaatgaaagtgatagaatyaaataagagaaagggataggggag

SEQ ID NO: 111076 - DNA, 50 bp, homo sapien
acttttaacggttcctggaattttayaactgcataggcataagaacattt

SEQ ID NO: 111077 - DNA, 50 bp, homo sapien
agccaacctcaacaaagttttatctyggtgaactacctgagtcttctcac

SEQ ID NO: 111078 - DNA, 50 bp, homo sapien
tggctttcttcctggttctatgagcyactattttactgtatgcttaaaag

SEQ ID NO: 111079 - DNA, 50 bp, homo sapien
gtgcaggagccgtgttgaaagtggawccgttagtccattcagcctccaaa

SEQ ID NO: 111080 - DNA, 50 bp, homo sapien
agaaaaaaagtaacacagatcatcarcttatttggaacattatggaataa

SEQ ID NO: 111081 - DNA, 50 bp, homo sapien
acaattacttaatggttttgaaatasatatgccaggcactaaagaaaatt

SEQ ID NO: 111082 - DNA, 50 bp, homo sapien
atggttttcccacttaattttctgckcttagaatgctcctgctaccatgt

SEQ ID NO: 111083 - DNA, 50 bp, homo sapien
agcacctggcataggcaaagtactayatagcggtactgatttgagcattt

SEQ ID NO: 111084 - DNA, 50 bp, homo sapien
acaaaaagtgtactgtatgctctgtwaattcaaagttgctttttctgtaa

SEQ ID NO: 111085 - DNA, 50 bp, homo sapien
ctcctcaattccaaatggagccctayagaaactatctcgatttcatcaag

SEQ ID NO: 111086 - DNA, 50 bp, homo sapien
aagccctaaacttgtatgaccttacragtgaacatccaccatttatgata

SEQ ID NO: 111087 - DNA, 50 bp, homo sapien
aaaaataaaataaacgaacaaaaaargaggagcaatatttccgtgtaaag

SEQ ID NO: 111088 - DNA, 50 bp, homo sapien
gcacaacttgtcatcctcttctgacrgctattttatttaagatagtctag

SEQ ID NO: 111089 - DNA, 50 bp, homo sapien
aaataaggagcttttgagtgactgarcaaagaacactttcccagctactc

SEQ ID NO: 111090 - DNA, 50 bp, homo sapien
caataaagagcacaagtgggaaatcyatgatgtcaagtaatctatctttg

SEQ ID NO: 111091 - DNA, 50 bp, homo sapien
ttctctttatatttagtgcctaaaarttcaaccacttaggaagaggtttc

SEQ ID NO: 111092 - DNA, 50 bp, homo sapien
acccatggccacaggtactgttctcratatgcaattactgaatatttaca

SEQ ID NO: 111093 - DNA, 50 bp, homo sapien
gcttcctttttatagatggtataagmcatggtattttccactttttgtgg

SEQ ID NO: 111094 - DNA, 50 bp, homo sapien
ttattaagcctttgcaaggcattccrgccaatatgtacatgtaaaaggaa

SEQ ID NO: 111095 - DNA, 50 bp, homo sapien
cagtccaaagaggccgttctgcttcyaaatgcctactgaaagtgaaatgc

SEQ ID NO: 111096 - DNA, 50 bp, homo sapien
tctatccttgtgactggcaccttcawctatctactgcccaagtcagaaaa

SEQ ID NO: 111097 - DNA, 50 bp, homo sapien
aaataaaggttagcactagaactatyagcttagaggggatggagttaatg

SEQ ID NO: 111098 - DNA, 50 bp, homo sapien
tgaaggttctgaatgttaattcatartatagattggcacctttgaccaca

SEQ ID NO: 111099 - DNA, 50 bp, homo sapien
tctaaggtgtcctattgatatgatawtagtttatgccatcttttgaaggt

SEQ ID NO: 111100 - DNA, 50 bp, homo sapien
caatatttaaaaaaaagtctaactaygtatgctaaccatatagaaaaata

SEQ ID NO: 111101 - DNA, 50 bp, homo sapien
cgtgataggcatatttgtttgctgakaactatatggaaaaggcctactgt

SEQ ID NO: 111102 - DNA, 50 bp, homo sapien
tcctatctgtccccaccacacttccrcaaacaacgagggagtctaacaat

SEQ ID NO: 111103 - DNA, 50 bp, homo sapien
gtgattacttagtgcagtaataatgyatatcttaccttacctgattaaag

SEQ ID NO: 111104 - DNA, 50 bp, homo sapien
attacagatattcaggttgtgcctcyattcaacttatcctcagtttagca

SEQ ID NO: 111105 - DNA, 50 bp, homo sapien
aaagaaggtacagaccaaaggaagayctgtagacatgattcagcttgcct

SEQ ID NO: 111106 - DNA, 50 bp, homo sapien
gtttatgacttatttcacggaaacaytgactttggaaaggcacaagctgt

SEQ ID NO: 111107 - DNA, 50 bp, homo sapien
aaaaatagtttaaatactgtatgaakgctcatctatatataaaacacaac

SEQ ID NO: 111108 - DNA, 50 bp, homo sapien
cttaggtaagcttaaaaattttgcascatacgaccttcacagtagcattt

SEQ ID NO: 111109 - DNA, 50 bp, homo sapien
ttctactttggtaagtattttgaagsctcttttatctttatgagttctca

SEQ ID NO: 111110 - DNA, 50 bp, homo sapien
ggatggaagctgaaactatttagtayggtctgcctcctgcactgttgagg

SEQ ID NO: 111111 - DNA, 50 bp, homo sapien
aaccgtcctaatttatagtttagtayctcctatgcactgaatgtttgtga

SEQ ID NO: 111112 - DNA, 50 bp, homo sapien
agactcaaaattgtctaagacattayacttcagcaaaaaaagggatcaaa

SEQ ID NO: 111113 - DNA, 50 bp, homo sapien
ctagtttttctttaatcaggtgcaakacatataataacattaaccttttt

SEQ ID NO: 111114 - DNA, 50 bp, homo sapien
tgttgagtaaaaggaaatcttacccwggaacttaatacagaaattttgca

SEQ ID NO: 111115 - DNA, 50 bp, homo sapien
ttgttactgaaattaccactctttgmagtaaactatattctagaaactat

SEQ ID NO: 111116 - DNA, 50 bp, homo sapien
tttcaaatgaatctcattttaagacmgtatatataacattcctccacgca

SEQ ID NO: 111117 - DNA, 32 bp, homo sapien
cagttaatcttttgcamcatgaattggaattt

SEQ ID NO: 111118 - DNA, 50 bp, homo sapien
tataagcagaaaaaaatgcaacttgyactaaaacatttggctataaacca

SEQ ID NO: 111119 - DNA, 50 bp, homo sapien
tctctaccatcatcgcttctcctcawtcggctttttcattgaggagcagt

SEQ ID NO: 111120 - DNA, 50 bp, homo sapien
accgttcccaatcaccattaactatraatcaaaatgttatgtttcctcag

SEQ ID NO: 111121 - DNA, 50 bp, homo sapien
tactcactttgtacctttttagatasagcacaattatttcaaatttatcc

SEQ ID NO: 111122 - DNA, 50 bp, homo sapien
gcatgaatctatcccaatagtaacaygtacagagaggatgcaagatgctt

SEQ ID NO: 111123 - DNA, 50 bp, homo sapien
tatactttcatttaatcttcacaacwccttggagctattcacttaaggct

SEQ ID NO: 111124 - DNA, 50 bp, homo sapien
tccatttacatggaatgactgagaamtaattgatacattaaattcacctt

SEQ ID NO: 111125 - DNA, 50 bp, homo sapien
tgagaacaatcagtgcatctactaasaggtaacattaatttctagaactt

SEQ ID NO: 111126 - DNA, 50 bp, homo sapien
gcagcaagttttgggcaaagaatatsactgaatttgcatatttatctttg

SEQ ID NO: 111127 - DNA, 50 bp, homo sapien
tatgagcaatatcttatcagctcacratacatttatgaagcaatatccta

SEQ ID NO: 111128 - DNA, 50 bp, homo sapien
cttccaagagaaagatttttaactcmatatatacgtatcaattctatact

SEQ ID NO: 111129 - DNA, 50 bp, homo sapien
gcattgagataatttcttttttataytaattcaggctcccgtaggggtat

SEQ ID NO: 111130 - DNA, 50 bp, homo sapien
ataacatttacagttaactattaagkccaggtaaaagattactatttttc

SEQ ID NO: 111131 - DNA, 50 bp, homo sapien
agacacttgcctaattagacatcaartaaatattaaattatgagctagcc

SEQ ID NO: 111132 - DNA, 50 bp, homo sapien
atagttcagtcatttagctgatttaractcaatgtaacaaattcttttct

SEQ ID NO: 111133 - DNA, 50 bp, homo sapien
gcagggcacctcaaacctggatagayacctgtaaggagctgattttgatc

SEQ ID NO: 111134 - DNA, 50 bp, homo sapien
gtgctagaaagagggtgtattaatcmagacctttgtctacaagttaatag

SEQ ID NO: 111135 - DNA, 50 bp, homo sapien
aaccaaacggcctgccttgccctggycaattctgcaggacgtaatggcca

SEQ ID NO: 111136 - DNA, 50 bp, homo sapien
agaacatagatgtttccagactttaygaacagtctatgtaatcaacacat

SEQ ID NO: 111137 - DNA, 50 bp, homo sapien
catacctttattgcttagaggctcaycattgtaatttaaaagtgtcaaac

SEQ ID NO: 111138 - DNA, 50 bp, homo sapien
tatgatgcacaatttcctaacctaastgattcatgatctgtgtagaatat

SEQ ID NO: 111139 - DNA, 50 bp, homo sapien
tgaagacttctctactattatgagaygcttatctttcaatatttttctct

SEQ ID NO: 111140 - DNA, 50 bp, homo sapien
tgattggagagtcaaagtccacatgyaagttgagacctggaagtaggcat

SEQ ID NO: 111141 - DNA, 50 bp, homo sapien
ctggccattgtgtgtctgaaattaaygggacatggaggcttaaagaatgg

SEQ ID NO: 111142 - DNA, 50 bp, homo sapien
ttgtacattaaaatatttgaaaaaawtgatgaaatagataattttctgga

SEQ ID NO: 111143 - DNA, 50 bp, homo sapien
cttatagtctctttctctcatgtcckcacaaccctaggtctaatctttaa

SEQ ID NO: 111144 - DNA, 50 bp, homo sapien
taattatctaaatattgtcatgttakgcttttcctaattttttccgtgta

SEQ ID NO: 111145 - DNA, 50 bp, homo sapien
ggatagtgaatattcattttcagagsaaccggcattgaattgggctatgt

SEQ ID NO: 111146 - DNA, 50 bp, homo sapien
attgaaataaatgacatatataatascagatgcagccctataacctttct

SEQ ID NO: 111147 - DNA, 50 bp, homo sapien
gaactattggaactatactactaaarcaaatccctgcgttgtgttattaa

SEQ ID NO: 111148 - DNA, 50 bp, homo sapien
aggctctgaaatgtcatagatatcaycattacttctgtaaatgtagcatt

SEQ ID NO: 111149 - DNA, 50 bp, homo sapien
ggttgtcagcaacgattgttcgagayttacatgctcatgactgcaggact

SEQ ID NO: 111150 - DNA, 50 bp, homo sapien
acttttatgaccctttctacctataytaccatcatcctgttaaaaaatac

SEQ ID NO: 111151 - DNA, 50 bp, homo sapien
tggcattacatatctccctaaccaaygttcttaaagatgaccagtgaact

SEQ ID NO: 111152 - DNA, 50 bp, homo sapien
aacaaaagttggagttcagaacctawcaatgtggaggcattctagcaatg

SEQ ID NO: 111153 - DNA, 50 bp, homo sapien
tttgctgctcaatttttatgctagaratgctattcatatatagactcaga

SEQ ID NO: 111154 - DNA, 50 bp, homo sapien
aatgtggaagcagtgtcagagaaaarcgatgtgaagaggtggtaatacga

SEQ ID NO: 111155 - DNA, 50 bp, homo sapien
cttcagtgtcattagcaatagctgaraaatgactgtcattcactaagcac

SEQ ID NO: 111156 - DNA, 50 bp, homo sapien
atgtgcttatacttttacacacttawctttttacgattaattgttctttc

SEQ ID NO: 111157 - DNA, 50 bp, homo sapien
tccagggagctttacaactagttacygctgatatgttaataatgctttga

SEQ ID NO: 111158 - DNA, 50 bp, homo sapien
tcaacaaatggtaggtatatgtataygttaatctggaagctgaaggagta

SEQ ID NO: 111159 - DNA, 50 bp, homo sapien
tttcttcagttggtgatctggaagartagcaggagactgagcaatgaatg

SEQ ID NO: 111160 - DNA, 50 bp, homo sapien
aacctcatgaacgaatccttcatatragccaatatctcatgagtcaatac

SEQ ID NO: 111161 - DNA, 50 bp, homo sapien
taaacaagatattccaactaatatcrtgaaactgattttgcatataattt

SEQ ID NO: 111162 - DNA, 50 bp, homo sapien
ggaaatgatcacgtaacatcaatagycattccaatatacatcctaataag

SEQ ID NO: 111163 - DNA, 50 bp, homo sapien
ctttttcatcttgagtcctgagtagyaagacctaattatcatgttaacaa

SEQ ID NO: 111164 - DNA, 50 bp, homo sapien
cccagagtttgggggcatcacaaaasgttaatgaaaaaaatgtgtttttt

SEQ ID NO: 111165 - DNA, 50 bp, homo sapien
gctacccaaggtgctactagattaargaattctgtcaccaagcaggctgt

SEQ ID NO: 111166 - DNA, 50 bp, homo sapien
tgtaaattgagataaaagtcatatamtacaaagtccaccatttcaaaatg

SEQ ID NO: 111167 - DNA, 50 bp, homo sapien
gaagttaatctctgctacataccaastctcaagggtgggacaattctgag

SEQ ID NO: 111168 - DNA, 50 bp, homo sapien
taaaacatggtcattaaaatcgggaratgcttttctgaggaagagatact

SEQ ID NO: 111169 - DNA, 50 bp, homo sapien
tatttgactagaaatttatagtccartaactgaaattctcatcaaggtaa

SEQ ID NO: 111170 - DNA, 50 bp, homo sapien
ttggttaaatagatgtggctaaatawacaaaaatcatcacttaggaagca

SEQ ID NO: 111171 - DNA, 50 bp, homo sapien
cacaggaatgcctgtagttgctcatraaagaagtctgaaggtgtatgaga

SEQ ID NO: 111172 - DNA, 50 bp, homo sapien
attgtccccttattaaagatgttgawactaagtcttagagtggtttggaa

SEQ ID NO: 111173 - DNA, 50 bp, homo sapien
aaatgatagagaaaagtaatatgaasactaaatgtagaaactgccttaaa

SEQ ID NO: 111174 - DNA, 50 bp, homo sapien
tttggagtgtgaatggaagtcacaaygtctctgttctaagctaacatgat

SEQ ID NO: 111175 - DNA, 50 bp, homo sapien
actcctgcgtcaagttcttttgtaaygacattgggaggcaggaagctgag

SEQ ID NO: 111176 - DNA, 50 bp, homo sapien
atgtgctatcactttggggcaaagakgtaggaatatctctacctaattgt

SEQ ID NO: 111177 - DNA, 50 bp, homo sapien
agacatacaaactgctacagaaataygccatgggagtaactaatctactg

SEQ ID NO: 111178 - DNA, 50 bp, homo sapien
cacatgaaaaagcatgaaattggaaycttgtcttgcaccatataggaaaa

SEQ ID NO: 111179 - DNA, 50 bp, homo sapien
ctttgacaatatgtaccaataagacraaaaggatagaatttgtagaactc

SEQ ID NO: 111180 - DNA, 50 bp, homo sapien
tatgtgtgtttctgggtataagcacycatactgttctctttttctttaga

SEQ ID NO: 111181 - DNA, 50 bp, homo sapien
agaaaacctgatcacacagccacaakgtagaggtgtaaatgctgaacttt

SEQ ID NO: 111182 - DNA, 50 bp, homo sapien
tacctacatccacaggaatttgcaayacttacacattttaccatcatgtc

SEQ ID NO: 111183 - DNA, 50 bp, homo sapien
tttaataactttttctggttctcatkacttgtcagaaacattaatttccc

SEQ ID NO: 111184 - DNA, 50 bp, homo sapien
gctacttctttatatgttacctaaaytattacctaaaatcataatgtaca

SEQ ID NO: 111185 - DNA, 50 bp, homo sapien
ttattgtgactcctgttttgtgtcaygaataatttagatgtgtttcttaa

SEQ ID NO: 111186 - DNA, 50 bp, homo sapien
ggcaaagtcatgtttgataaggacarggaatttaagctatttgattttgc

SEQ ID NO: 111187 - DNA, 50 bp, homo sapien
aatattctgcatatcaacaaatatcrcatgacttcatattttatttgttt

SEQ ID NO: 111188 - DNA, 50 bp, homo sapien
tagtaatatgggacagctctcctctyaattatgggctacattggaataaa

SEQ ID NO: 111189 - DNA, 50 bp, homo sapien
ctggagcacaattgatcacacgaaaygtttagtagaaagagtaatgttat

SEQ ID NO: 111190 - DNA, 50 bp, homo sapien
taccattctcctttctctggttaaayactatactgggtttcttattattt

SEQ ID NO: 111191 - DNA, 50 bp, homo sapien
gatgctaagcatgggaccttaataaraattactatcaggtcaatattgag

SEQ ID NO: 111192 - DNA, 50 bp, homo sapien
catgtattctaaaaatgatgggtgtycaaaaagtgttaacatagcaagtc

SEQ ID NO: 111193 - DNA, 50 bp, homo sapien
gtgtgttatttcactctgttagaaamgtcttttataatatctaaagaaga

SEQ ID NO: 111194 - DNA, 50 bp, homo sapien
ctatttgctcattggcttaaagagargtttattaaatacactctgaaatt

SEQ ID NO: 111195 - DNA, 50 bp, homo sapien
ttcaaaggtttttttttttcctataygcacataaccaagctattaataat

SEQ ID NO: 111196 - DNA, 50 bp, homo sapien
tggatttttaaaaacactcaacttaygctgcctataagaggcttgcttca

SEQ ID NO: 111197 - DNA, 50 bp, homo sapien
ccccttatagtctgaggtttaactgragcgcatccattggagtaacacgt

SEQ ID NO: 111198 - DNA, 50 bp, homo sapien
ctactatcctacattaatttttacakctactttagtccagatagaacaga

SEQ ID NO: 111199 - DNA, 50 bp, homo sapien
agtgcagtaagtgatggttaatcaayagagtcagccttcagaagctattc

SEQ ID NO: 111200 - DNA, 50 bp, homo sapien
cttgatacattgaaatacttaactaygcaacctctccatcaaagaaacac

SEQ ID NO: 111201 - DNA, 50 bp, homo sapien
tggctcacaaataaaagtgtctaatraaatctgctcaggggcatgggtaa

SEQ ID NO: 111202 - DNA, 50 bp, homo sapien
gacaattaagtgaaaattgatgctasagtgaattgattcaatgataattt

SEQ ID NO: 111203 - DNA, 50 bp, homo sapien
gatggacacttctccaattctttccrccagatgagaatatatgacaatta

SEQ ID NO: 111204 - DNA, 50 bp, homo sapien
cgtattttctcaagtctgtgtcaaaycacataggacatttttcaatttta

SEQ ID NO: 111205 - DNA, 50 bp, homo sapien
aaatcatgctctgggctctggtgtarcactaaaataaaaacatggaagaa

SEQ ID NO: 111206 - DNA, 50 bp, homo sapien
cattgttataaggtttgtgaaagagmatttataaaaagcattttgtgtca

SEQ ID NO: 111207 - DNA, 50 bp, homo sapien
agtaaaatgactggttatttaggaargaagtagtataggataactcagaa

SEQ ID NO: 111208 - DNA, 50 bp, homo sapien
tagcaatgtctgagatttccatgagrccttcagagatccatttccttttt

SEQ ID NO: 111209 - DNA, 50 bp, homo sapien
aaaaaaaaaatacttctatgctacargtactttttttctaattgagattt

SEQ ID NO: 111210 - DNA, 50 bp, homo sapien
cagaataaaacactcacttcttaacwattgaatgcaaccaatgacaaact

SEQ ID NO: 111211 - DNA, 50 bp, homo sapien
acaaacccagtaataggcttaattawatcatatttgcattcaatatcatc

SEQ ID NO: 111212 - DNA, 50 bp, homo sapien
caccacacacacccttcagtcagaarctggttccccgccttgaaagatct

SEQ ID NO: 111213 - DNA, 50 bp, homo sapien
tgagcagctatgattgcatgattctyaccttatgccttctttcccctgca

SEQ ID NO: 111214 - DNA, 50 bp, homo sapien
agtttccttgagcacctcaagataaytgatgtgagatctataatttagga

SEQ ID NO: 111215 - DNA, 50 bp, homo sapien
taaatgagtaattcacctgctgttayataatgtttggtgttggtagagac

SEQ ID NO: 111216 - DNA, 50 bp, homo sapien
ttcatcgactcaccgatccttgacawcctttactcagaaatttcttgctt

SEQ ID NO: 111217 - DNA, 50 bp, homo sapien
tgagtgagctggaaagagttttctcrcatctaagacattttctttaaagg

SEQ ID NO: 111218 - DNA, 50 bp, homo sapien
acatccatacttggcaaaatgaaaarttgtcatcttatgttagtccccag

SEQ ID NO: 111219 - DNA, 32 bp, homo sapien
atatttcttttctatamtagtttataaaggga

SEQ ID NO: 111220 - DNA, 50 bp, homo sapien
gagcaaatgagcaccttctaaaccamacatgctgggctttcttcctcccc

SEQ ID NO: 111221 - DNA, 50 bp, homo sapien
ggactggcagtattcacacctcattsaagagccaagtttcaagatcttgg

SEQ ID NO: 111222 - DNA, 50 bp, homo sapien
ggaatgtcatctttcctttactgtaygaaataaaagcaattatactgtat

SEQ ID NO: 111223 - DNA, 50 bp, homo sapien
gacccaatataaaaatactcttcatkagacaaatcagctcttttgggcag

SEQ ID NO: 111224 - DNA, 50 bp, homo sapien
aaaactgagagtttataatgtttacsgctgaagcagtagagataaataag

SEQ ID NO: 111225 - DNA, 50 bp, homo sapien
cagcaggatggcgaaggaactaaaarctattatgtaaaactgagagttta

SEQ ID NO: 111226 - DNA, 50 bp, homo sapien
cactctcccctaccattattctcaamgacagaaatctattttctttattt

SEQ ID NO: 111227 - DNA, 50 bp, homo sapien
tactaagatataagtggcatcaataytaaaactatgctatttgtgcatat

SEQ ID NO: 111228 - DNA, 50 bp, homo sapien
ctaaaaagttattaagaattaggtamcagtagtattcttgtttatggaaa

SEQ ID NO: 111229 - DNA, 50 bp, homo sapien
aatatcaatgtgaaccagctgtaaarataaccattgtacagatatatttc

SEQ ID NO: 111230 - DNA, 50 bp, homo sapien
ttgaatacagttatatgataaacacrctattaataggaaatggaactgag

SEQ ID NO: 111231 - DNA, 50 bp, homo sapien
tgtaaacaaattggaaaataaaaagkaccacttgagtgaaaacagatttt

SEQ ID NO: 111232 - DNA, 50 bp, homo sapien
gcttactgataatgtgcaaatttcayagataactgagtagagactatatc

SEQ ID NO: 111233 - DNA, 50 bp, homo sapien
tattgtttaaagcacgacctaaatargagatatagtctctactcagttat

SEQ ID NO: 111234 - DNA, 50 bp, homo sapien
cttatttctgggggtacttttgcaaytctaatagagattccatgcacata

SEQ ID NO: 111235 - DNA, 50 bp, homo sapien
ctctttaattttttacttttgtaaayatagcttggattagtactcttaca

SEQ ID NO: 111236 - DNA, 50 bp, homo sapien
ctggttaagagatatatagtacctcrcgcattatgactgtcctgttactt

SEQ ID NO: 111237 - DNA, 50 bp, homo sapien
atgaattaaggtgaaaaggctacaayagattgcaatatggccacaaatgc

SEQ ID NO: 111238 - DNA, 50 bp, homo sapien
gggtcaaagctagagagaagagataygactatggaaacaggttgaaatga

SEQ ID NO: 111239 - DNA, 50 bp, homo sapien
aacatgaataacaatgataacgtgaygtgataaaggattacctacagtaa

SEQ ID NO: 111240 - DNA, 50 bp, homo sapien
ggatttgatgctttaccagaaatatyaagaccctaaatgcatcttaaaca

SEQ ID NO: 111241 - DNA, 50 bp, homo sapien
cagaaaatacaagataaaataaacamgtggtctagtattgtcttttattc

SEQ ID NO: 111242 - DNA, 50 bp, homo sapien
tctctcatttaccctacacagcttamaaactaatgataacgtttgaatta

SEQ ID NO: 111243 - DNA, 50 bp, homo sapien
agactcaaatgaaatgtatctctaayttaactttccctaaactggatcct

SEQ ID NO: 111244 - DNA, 50 bp, homo sapien
agggccatgtatgtttgaatttcaaygtatggaccagcgtcttgcaacct

SEQ ID NO: 111245 - DNA, 50 bp, homo sapien
ccttaaaaactgtgggaaagaattaygggaaaagtgactatagagagcta

SEQ ID NO: 111246 - DNA, 50 bp, homo sapien
ttagtggtctcaaaaattgggaaggycaaaacaagattcactgaaatagc

SEQ ID NO: 111247 - DNA, 50 bp, homo sapien
tttacctaaaatcaaattcatgaacygtgtctcatttctgtaatgattcc

SEQ ID NO: 111248 - DNA, 50 bp, homo sapien
gggaaatatctatatcaaaatagtaracatgagtgtgttaaaaaggcgag

SEQ ID NO: 111249 - DNA, 50 bp, homo sapien
gtctggaaaacgatgaatattagtgsaccttagcttttaattaattgaat

SEQ ID NO: 111250 - DNA, 50 bp, homo sapien
gtaatgaatcataccatattggaaaygctctatcaggctggtgtgttagc

SEQ ID NO: 111251 - DNA, 50 bp, homo sapien
tcacaaacagaagagctggaagtgargttaaaaggagatctgcttgccct

SEQ ID NO: 111252 - DNA, 50 bp, homo sapien
ctggttgtagactgagatcttcaacyctttgaaagaaattgcctggagcc

SEQ ID NO: 111253 - DNA, 50 bp, homo sapien
gagtaagtaattcagaatgattaaargagagatttggagacaggaatatt

SEQ ID NO: 111254 - DNA, 50 bp, homo sapien
aactcattatcctcaatgctccaacktggtcttctcatgtcaacccagtc

SEQ ID NO: 111255 - DNA, 50 bp, homo sapien
ttagttcacattgtttgaaggtctawcttgactagtgccagaataataag

SEQ ID NO: 111256 - DNA, 50 bp, homo sapien
tccatcattccgaatctgttcttcaygtgggtcataaagtcccttatctt

SEQ ID NO: 111257 - DNA, 50 bp, homo sapien
aggaagtgtaggaatccaaggagaartatccgtggtagatttcaattaag

SEQ ID NO: 111258 - DNA, 50 bp, homo sapien
ttctgtgtactaattgaacatgacasagaatacaaaaagtaggtgtctgg

SEQ ID NO: 111259 - DNA, 50 bp, homo sapien
gtttaatacaaatgagagttattacrgagctgtgaacttcttggggaaag

SEQ ID NO: 111260 - DNA, 50 bp, homo sapien
agaagccaatgtattgcacattaaaygttcctgaggtgacctgttttctt

SEQ ID NO: 111261 - DNA, 50 bp, homo sapien
gagacagcacagtctgttggattaaraacccacaaggctctaccacccac

SEQ ID NO: 111262 - DNA, 50 bp, homo sapien
atacattggcttctccctgataaaawtttgggccaatatattactcttac

SEQ ID NO: 111263 - DNA, 50 bp, homo sapien
tcacatacctggggaatagggactawgttttatttatctctgtatcttcc

SEQ ID NO: 111264 - DNA, 50 bp, homo sapien
taaaagcatctctctctctgtcagartcaaaaaaatgccttagttcagat

SEQ ID NO: 111265 - DNA, 50 bp, homo sapien
ttgctttcatttattttactttgcarctacactcaacggagtttaatact

SEQ ID NO: 111266 - DNA, 50 bp, homo sapien
gcctggggttttaagacagtcagaarttagaagaatgactggacctacac

SEQ ID NO: 111267 - DNA, 50 bp, homo sapien
aacctttcagatatgagaagagatcractcatttacatcttgtaaatctt

SEQ ID NO: 111268 - DNA, 50 bp, homo sapien
ctcagaaagcatggatgtctcatcartatttttttcttaatgtatcccca

SEQ ID NO: 111269 - DNA, 50 bp, homo sapien
tagaaccagaatacctgattagccasaataacacattctcagaccacgct

SEQ ID NO: 111270 - DNA, 50 bp, homo sapien
ttacctgtcctcaaacttgctgctaygtactcagattgttaaggcaaatt

SEQ ID NO: 111271 - DNA, 50 bp, homo sapien
taagcccttgaattgttgagaggtawgagaagggtcaggtgtgactgcta

SEQ ID NO: 111272 - DNA, 50 bp, homo sapien
ttctaatttaatttcgacacttttaygaattatactgatggatggaattc

SEQ ID NO: 111273 - DNA, 50 bp, homo sapien
cacaaacattgatgttagagtatccraagagtttaacctttaaagggata

SEQ ID NO: 111274 - DNA, 50 bp, homo sapien
taacatatgatattcaaatattacaytaactgaaaacattctctattaga

SEQ ID NO: 111275 - DNA, 50 bp, homo sapien
tgaagcataagtcactacctgttatyaagttaagcaactagaaaggagtc

SEQ ID NO: 111276 - DNA, 50 bp, homo sapien
caaaagactgcttgaaataatgttayagtcacttgaggaagattaaaaca

SEQ ID NO: 111277 - DNA, 50 bp, homo sapien
tatctccctcttaactataatattcyaccagttacacccttacgtggttt

SEQ ID NO: 111278 - DNA, 50 bp, homo sapien
taataaatcctccaagtaggaatcayctttctagcataatcttttaatgg

SEQ ID NO: 111279 - DNA, 50 bp, homo sapien
aacggcttctctccgataaatgtacyaagcaacagcaaaatattcatgca

SEQ ID NO: 111280 - DNA, 50 bp, homo sapien
atagaaaacctgacccaataaggaargtaatacaataaggaaagttatag

SEQ ID NO: 111281 - DNA, 50 bp, homo sapien
aggctacagtagttttctcattttcraatttccagatattccacttagta

SEQ ID NO: 111282 - DNA, 50 bp, homo sapien
gtgacttatttcaattttgctaccamgagatgaaaaattgttatcaaaat

SEQ ID NO: 111283 - DNA, 50 bp, homo sapien
gcccatgtgttgtgttttcatattasactccacttacctcactattatgg

SEQ ID NO: 111284 - DNA, 50 bp, homo sapien
attgaatgagtgcatcacgagacacmaaactccattagagttactatagg

SEQ ID NO: 111285 - DNA, 50 bp, homo sapien
gagcaaatcaaaaatattccaggaargaaacaatgccctaaaaactattg

SEQ ID NO: 111286 - DNA, 50 bp, homo sapien
taaccagatctctaaaatgccttaamtaccactcaagacttgtatcatga

SEQ ID NO: 111287 - DNA, 50 bp, homo sapien
gcctatcctctgccatgctgtgaaamgataacctgctttgggtgctctga

SEQ ID NO: 111288 - DNA, 50 bp, homo sapien
gctgtcaccgtgaatcaggctagacycaacttgaagaaacatcctgggat

SEQ ID NO: 111289 - DNA, 50 bp, homo sapien
cagccacaaatggtcatgtgaaatcsatagaaccagaatacctgattagc

SEQ ID NO: 111290 - DNA, 50 bp, homo sapien
tattgattagaaagcagggatacaayacaatgagaactgatgaccacaaa

SEQ ID NO: 111291 - DNA, 50 bp, homo sapien
ataatagactaaaatagaaatttcaragcagaacttatttaagtcaaagg

SEQ ID NO: 111292 - DNA, 50 bp, homo sapien
tgtcttcacctgatggtcatgaacaycctaaaggccaactctgcagtaaa

SEQ ID NO: 111293 - DNA, 50 bp, homo sapien
ttgagaactcataattttaaaggacygtataagactctttttggtctttt

SEQ ID NO: 111294 - DNA, 50 bp, homo sapien
ttctctcccttttaattatcctctayctgaatattttaatcaccttgaat

SEQ ID NO: 111295 - DNA, 50 bp, homo sapien
aatttgatgggatttacaatgtaaasgataaagtcagaggattaaacagt

SEQ ID NO: 111296 - DNA, 50 bp, homo sapien
gtgtgttcctgttcaaaaaacttcargttaacatccattgtcctagagta

SEQ ID NO: 111297 - DNA, 50 bp, homo sapien
atatacttacaaaaagctagaaggaygatactgaacggtcacaacagaga

SEQ ID NO: 111298 - DNA, 50 bp, homo sapien
tcatatgatgaaactaagattttcaraggttaggcaattttttctaacca

SEQ ID NO: 111299 - DNA, 50 bp, homo sapien
agtgaaggttgggcaacaaaataagycataatgtctcctaatttggggta

SEQ ID NO: 111300 - DNA, 50 bp, homo sapien
aatgtgtaaagaagacaagaactccragattcctaaaagcagagtagcca

SEQ ID NO: 111301 - DNA, 50 bp, homo sapien
ttccccgtgctctgctcttttctttygtgatacttatctcaagttataat

SEQ ID NO: 111302 - DNA, 50 bp, homo sapien
aatcttcttcagcttccaagctaagwccatgtgcgccctgtgcagctccc

SEQ ID NO: 111303 - DNA, 50 bp, homo sapien
ctatagggagggaagacaacctaacygataattatggtaagtattataac

SEQ ID NO: 111304 - DNA, 50 bp, homo sapien
atgaattgtctttcactttcttaacrgtgttttttgaatcacaaaagttc

SEQ ID NO: 111305 - DNA, 50 bp, homo sapien
catgacccatgtatatcatctttgcygtgatttgagtcacactttgcctt

SEQ ID NO: 111306 - DNA, 50 bp, homo sapien
attcctaggcccaccatagtgtagasaattactgggttcagtgacatgca

SEQ ID NO: 111307 - DNA, 50 bp, homo sapien
cacactattttctgttccagctctaygtcttgatctttaccaaagattct

SEQ ID NO: 111308 - DNA, 50 bp, homo sapien
tgctttaagagccttactctggcaaygttagggatggagacaagaaccag

SEQ ID NO: 111309 - DNA, 50 bp, homo sapien
ctatcagatctgcacaatgggactaragaaacttgatgtctggatagttt

SEQ ID NO: 111310 - DNA, 50 bp, homo sapien
aagatttaggaatgtattaacagaarttctactaaagtactccatctgca

SEQ ID NO: 111311 - DNA, 50 bp, homo sapien
taagagaaatacaacctcattagcaygtcactaactaacttcaacaaatg

SEQ ID NO: 111312 - DNA, 50 bp, homo sapien
tatatcagcacaactaaaataaatargatacaaagattacacaggaatgg

SEQ ID NO: 111313 - DNA, 50 bp, homo sapien
gttgaccagtctctaattagctagtwaatgtatctggcaggtttaccaaa

SEQ ID NO: 111314 - DNA, 50 bp, homo sapien
tcattccccagttcaaaaatgtctayagttaatcccaaagtctttcttaa

SEQ ID NO: 111315 - DNA, 50 bp, homo sapien
ttgaacactcattttggttgtatgascatgagccttcttcctttgggtga

SEQ ID NO: 111316 - DNA, 50 bp, homo sapien
gctaaattggatgtaatgactaacastaaagcatccatcttgtttgatta

SEQ ID NO: 111317 - DNA, 50 bp, homo sapien
taatgtgggtgacaggaggagaagayacagaagttctaataaatgctaag

SEQ ID NO: 111318 - DNA, 50 bp, homo sapien
aagatctattttagtcttcaacttaygggtctctttgggcctcagtgact

SEQ ID NO: 111319 - DNA, 50 bp, homo sapien
ttttttttttcaaaaataaagtgcayatgtatcatttatagtcattgttt

SEQ ID NO: 111320 - DNA, 50 bp, homo sapien
atatgttttaagtagcacagatttayagagagcatatcaccaatgaagta

SEQ ID NO: 111321 - DNA, 50 bp, homo sapien
gctggctgacatttgtcttccaacaytcagttctaaggtcacatcttctg

SEQ ID NO: 111322 - DNA, 50 bp, homo sapien
tcttaatatagagtgttttataaaawagaattattggtcatctcactgaa

SEQ ID NO: 111323 - DNA, 50 bp, homo sapien
gaaagatccaccaaggtagtttctayaatggaagagtctgattctatgat

SEQ ID NO: 111324 - DNA, 50 bp, homo sapien
actgccccctctttttccagccataygacttccaagtttatgactacctc

SEQ ID NO: 111325 - DNA, 50 bp, homo sapien
caaaacttcatcaatcttagaacctwaccaaactgaattggtttatcgta

SEQ ID NO: 111326 - DNA, 50 bp, homo sapien
ctttttgttttcatgtaccaatgcawtcatttctataaatacagacccct

SEQ ID NO: 111327 - DNA, 50 bp, homo sapien
tgtgattattatgtaggagataacasagtactatgaaagtctgacattga

SEQ ID NO: 111328 - DNA, 50 bp, homo sapien
caatccaagttgacataaaatggaayattacataccctcaacgaatcccg

SEQ ID NO: 111329 - DNA, 50 bp, homo sapien
ttgttagagacaactgactattataygctcatccgccagaacagtgagac

SEQ ID NO: 111330 - DNA, 50 bp, homo sapien
agcagtctgtgtgattactctagcargttctattagaaatatgtgtattt

SEQ ID NO: 111331 - DNA, 50 bp, homo sapien
gacgaatgagtaaatggtgataccastaacagatatagaaaataccaaaa

SEQ ID NO: 111332 - DNA, 50 bp, homo sapien
agtatttactgtgtggaaatcactaygctagaatttgaccataatttgta

SEQ ID NO: 111333 - DNA, 50 bp, homo sapien
gattaaacaaaagagagagattttaragtaagtaagtattatgaaataac

SEQ ID NO: 111334 - DNA, 50 bp, homo sapien
aagagattctgaacaaattttaagcmcagaatgacattgtattttgaggc

SEQ ID NO: 111335 - DNA, 50 bp, homo sapien
agggcaaggccgtgcatcagaacagstggatccaagtattcaacagcttc

SEQ ID NO: 111336 - DNA, 50 bp, homo sapien
agaatgagtcagattttgacgagcartactgaacattctaggaatggaac

SEQ ID NO: 111337 - DNA, 50 bp, homo sapien
aaaatcccagtcacctagaattgtaygtccagattattaaagagggaaaa

SEQ ID NO: 111338 - DNA, 50 bp, homo sapien
ctattttgaaaaggtaatgagttgastataattaaggtttacccccaata

SEQ ID NO: 111339 - DNA, 50 bp, homo sapien
ggccatgtaattgttaacctattacrcctattcatcttctaattgaggtt

SEQ ID NO: 111340 - DNA, 50 bp, homo sapien
aaggcatggctgtcaagtaatgagayggtttccacatgacttgcaaataa

SEQ ID NO: 111341 - DNA, 50 bp, homo sapien
atgtcacactaatctcttacctttawgccatacgccatggtctgaatgct

SEQ ID NO: 111342 - DNA, 50 bp, homo sapien
ttcacagaatcatagaaattagagayggaaaagatttattaagtcatctt

SEQ ID NO: 111343 - DNA, 50 bp, homo sapien
gagtgaccatgaaatgtttaagaacyacttccaggagtaagatcgccagg

SEQ ID NO: 111344 - DNA, 50 bp, homo sapien
ctctcagtttatccaattttgacaarccttttcaacaatattgccatgaa

SEQ ID NO: 111345 - DNA, 50 bp, homo sapien
gatttctagataagattaaaacaacycagacacgctctctgagaagaaaa

SEQ ID NO: 111346 - DNA, 50 bp, homo sapien
gaatgaacttcttgttatatacacgracatttgtaccaaagggtctgaca

SEQ ID NO: 111347 - DNA, 50 bp, homo sapien
tttccatgatccaggtatgcaaaaartaacactccacttatggctttaaa

SEQ ID NO: 111348 - DNA, 50 bp, homo sapien
acaagccccagagattaaatagcgcrccacaggaagacacccataagaag

SEQ ID NO: 111349 - DNA, 50 bp, homo sapien
aagttttactaagttgttacttctckaatggtgcaggtgggaatatgaag

SEQ ID NO: 111350 - DNA, 50 bp, homo sapien
aacacaaagttataatttactgtgaragacagctgtgaatctatcattca

SEQ ID NO: 111351 - DNA, 50 bp, homo sapien
aaatagcttatagcagctcaaaacasattaaaattagcaataaaattcct

SEQ ID NO: 111352 - DNA, 50 bp, homo sapien
ccatgaggtaatcaacactaaaagakccatgcttatggaaatatacaaat

SEQ ID NO: 111353 - DNA, 50 bp, homo sapien
gtggagaagccagctgttaaagaatsacactaataaagttagaactctgg

SEQ ID NO: 111354 - DNA, 50 bp, homo sapien
tcctttttatgtgtccgaatgtctastaactttccagtgctcttattgta

SEQ ID NO: 111355 - DNA, 50 bp, homo sapien
ttaggggacaggttttcaggattccytggtatttttaaagttgggtcatc

SEQ ID NO: 111356 - DNA, 50 bp, homo sapien
aacattttcagagcttttccatgtaygagatgcttttttgatacatgact

SEQ ID NO: 111357 - DNA, 50 bp, homo sapien
tgttacatgaggttatacaaaataakttagccgtctcatgtttgaaattg

SEQ ID NO: 111358 - DNA, 50 bp, homo sapien
gcccagtagatgagcttattcccaayataaaaatttgcccctttgcattt

SEQ ID NO: 111359 - DNA, 50 bp, homo sapien
tgaataattaatactcaaaacaacartacaggcagactctgcttattcac

SEQ ID NO: 111360 - DNA, 50 bp, homo sapien
acgttgtttgtatcgtttgcatttargactatggccagctttagagctat

SEQ ID NO: 111361 - DNA, 50 bp, homo sapien
aaattaagtggtttattcctgtctayataagctaggcttggattagtttc

SEQ ID NO: 111362 - DNA, 50 bp, homo sapien
atcacaactggaacgtgcactttgcygaacatggatcacagtcttgagaa

SEQ ID NO: 111363 - DNA, 50 bp, homo sapien
cccactcactcaatcttgccaaaaayctaccttcaagaactttcctacta

SEQ ID NO: 111364 - DNA, 50 bp, homo sapien
taaaacagacttacagcatctattgyagtgaaattaaaatacatgcatca

SEQ ID NO: 111365 - DNA, 50 bp, homo sapien
agtgtcttaggatgatccgtctccayagttagttattaatcaaagaaaaa

SEQ ID NO: 111366 - DNA, 50 bp, homo sapien
agtaacaaacaacaaacactcatctsaaaagtgcttaaggaaacagaaac

SEQ ID NO: 111367 - DNA, 50 bp, homo sapien
tgatagagattttgcattgatctccrctgagcctttaaactctaaatata

SEQ ID NO: 111368 - DNA, 50 bp, homo sapien
taaattccagctcaggtactaggagmatagacagatcgtcagttgatgga

SEQ ID NO: 111369 - DNA, 50 bp, homo sapien
gcctgtagatgccaaatttgtaaaasagtggtggctcaagaacgccgtaa

SEQ ID NO: 111370 - DNA, 50 bp, homo sapien
catgaacaagtagatcggtcctttaygtcacctaactctgtcagtgcctc

SEQ ID NO: 111371 - DNA, 50 bp, homo sapien
aaattcttatattgttcatactcacmaagtcaaaggctaataaaagccat

SEQ ID NO: 111372 - DNA, 50 bp, homo sapien
gacactactttagtaaggatggttaygtgtaaaataataggaaaataaaa

SEQ ID NO: 111373 - DNA, 50 bp, homo sapien
aaactacaagtattctaaacatttcrgaaagaggatgtaaaaagaaatta

SEQ ID NO: 111374 - DNA, 50 bp, homo sapien
tgatgtacaggctacatttctaaaargagtcagacaatttttcatctttg

SEQ ID NO: 111375 - DNA, 50 bp, homo sapien
aagcaacaatatacttacagaacaayttaaacttagtaagatcccaggta

SEQ ID NO: 111376 - DNA, 50 bp, homo sapien
tatagaaaagaaactgagccacataygaatatacaacccctgcatttcac

SEQ ID NO: 111377 - DNA, 50 bp, homo sapien
atttttttaagacttgctgcatatcsaaggattaggttccgtgggctctc

SEQ ID NO: 111378 - DNA, 50 bp, homo sapien
tctgtgaaatgagagtagtcttaaawccttcacaataaaaaaaaaacctc

SEQ ID NO: 111379 - DNA, 50 bp, homo sapien
agaggacagattacattagttgacawcagcattacactcacctggtcatt

SEQ ID NO: 111380 - DNA, 50 bp, homo sapien
acttcctaagggccaggcacctttcyaagagtttctgtgtatgatctatt

SEQ ID NO: 111381 - DNA, 50 bp, homo sapien
tggtgtatgaatcagaccatactccratagctttatggaaactgatttaa

SEQ ID NO: 111382 - DNA, 50 bp, homo sapien
tcatttaattcctatttgtagctcawgttgcttaaacaactttggttgta

SEQ ID NO: 111383 - DNA, 50 bp, homo sapien
ctggtaacaaaaactaatttgactayacttttgctcattgaaagaggtgg

SEQ ID NO: 111384 - DNA, 50 bp, homo sapien
aaattcactcatggtggtaattaaayggagacatgttgactaaacagaga

SEQ ID NO: 111385 - DNA, 50 bp, homo sapien
gcatgtcctggcttagctcttattaycttctcagacaagcctctacccaa

SEQ ID NO: 111386 - DNA, 50 bp, homo sapien
agaaggaaaagatttgtagttgagcrcatgatagaataatcaaaatatat

SEQ ID NO: 111387 - DNA, 50 bp, homo sapien
accacttaattttaggctctatttcmaacaacaaatgtcattaattcaat

SEQ ID NO: 111388 - DNA, 50 bp, homo sapien
attagagagcatcaaaggaaaagcaygtaagcctgaaaagattgggctaa

SEQ ID NO: 111389 - DNA, 50 bp, homo sapien
ccaaactttaaggaggttcttctackgctaatactccaggtaatgaatgc

SEQ ID NO: 111390 - DNA, 50 bp, homo sapien
taagctacacagctttcttttattayatagcccaagtgtccatttgtctc

SEQ ID NO: 111391 - DNA, 50 bp, homo sapien
tctacatcattttttcaaagaagcargtgaaatttaacctaaatttaatt

SEQ ID NO: 111392 - DNA, 50 bp, homo sapien
tgtggctagaccttctatatcatgcrgaaccctccaaaatgtatacataa

SEQ ID NO: 111393 - DNA, 50 bp, homo sapien
ttctctttctcatcagagtatttcarctgtacctttcataaggcactttc

SEQ ID NO: 111394 - DNA, 50 bp, homo sapien
ttctccctggaataatgcacctatamattcatgtttcacgtaagtcttca

SEQ ID NO: 111395 - DNA, 50 bp, homo sapien
ggtaccaagaaggcatcttggaggawatgacatttgacctggattttagg

SEQ ID NO: 111396 - DNA, 50 bp, homo sapien
cccacatgtgtggtgcgtataaatcragtggttttaatttgaaatattat

SEQ ID NO: 111397 - DNA, 50 bp, homo sapien
cttttagctgattgtcacttgtagcrgatatttagctcattgaaaattcc

SEQ ID NO: 111398 - DNA, 50 bp, homo sapien
tatttataccctgaactaatctaccyaattaataaatcacaattaggtac

SEQ ID NO: 111399 - DNA, 50 bp, homo sapien
aattctattttattccatgctacttsaaaagaaaagtaggtactacaatg

SEQ ID NO: 111400 - DNA, 50 bp, homo sapien
gcaaaaatctgcctggataagtcaakaagaactttgttccttctcatagt

SEQ ID NO: 111401 - DNA, 50 bp, homo sapien
ttatgtggatcaaaaactttaaatgsagttgagagcaaatagtaatgaca

SEQ ID NO: 111402 - DNA, 50 bp, homo sapien
atcaagatatcctcctaaactccacygaaattcttctcaattgtctcttt

SEQ ID NO: 111403 - DNA, 50 bp, homo sapien
ataagcagtagccatgcagcaaaagmaagtcaagtctgttatagagtaag

SEQ ID NO: 111404 - DNA, 50 bp, homo sapien
aagacccaaattgtaggaattttacrgatatgacaagtccctcgtattca

SEQ ID NO: 111405 - DNA, 50 bp, homo sapien
ttatgttcttgaaatctacctaaacrttcattgccaagagtaaataattt

SEQ ID NO: 111406 - DNA, 50 bp, homo sapien
attttgacagctgttttattaaaatkatgtcttcccatttatgttttgct

SEQ ID NO: 111407 - DNA, 50 bp, homo sapien
taaaagccttggcaagatagaaaacrcagtctatggcaaggattcaggca

SEQ ID NO: 111408 - DNA, 50 bp, homo sapien
tgtaagtgatacaaatggcctttcastctacagtcatctggtatcaaata

SEQ ID NO: 111409 - DNA, 50 bp, homo sapien
gaaaataaagcaatggttcatgggcragaaaggctgcttttttatattat

SEQ ID NO: 111410 - DNA, 50 bp, homo sapien
ttcaccttggtaagaaatagaatcaygttgtctgactaaggattggactc

SEQ ID NO: 111411 - DNA, 50 bp, homo sapien
ttgtcataaaaaagcatttattagaygaaaagagaaaaagacaatagtat

SEQ ID NO: 111412 - DNA, 50 bp, homo sapien
tctttgaaacatcaggaacattgtcyatttataccctgaactaatctacc

SEQ ID NO: 111413 - DNA, 50 bp, homo sapien
gcattcagaactaaatctgaacttaygactacatgggttcttaatttttg

SEQ ID NO: 111414 - DNA, 50 bp, homo sapien
gaagaacagggagaaaattctgggcratgagaggagtcaagtttcaaaac

SEQ ID NO: 111415 - DNA, 50 bp, homo sapien
attagcccatttgcctgtttaactgmaaagattgattcttattagacaca

SEQ ID NO: 111416 - DNA, 50 bp, homo sapien
aagaatgacctctggataaatgaaargataacagtaggagaaaatgaatc

SEQ ID NO: 111417 - DNA, 50 bp, homo sapien
gtagagagatggacatagcactcacraatgaatagatggagtctccatag

SEQ ID NO: 111418 - DNA, 50 bp, homo sapien
tttctgctgtgatatttttggattcsaattatgcttatagcttttgaggc

SEQ ID NO: 111419 - DNA, 50 bp, homo sapien
tctaaacactgtgcagcaggtaccaytcttatttctatttgagagttgag

SEQ ID NO: 111420 - DNA, 50 bp, homo sapien
aattttttcaatgtatttatttcackaaaattccaatcactttattatct

SEQ ID NO: 111421 - DNA, 50 bp, homo sapien
acttctgtttcttccaagtttcttasactagattttaaaaagtgccatag

SEQ ID NO: 111422 - DNA, 50 bp, homo sapien
tggtactgcacctgaattttcgtacygagtccaagattcaataaactgtc

SEQ ID NO: 111423 - DNA, 50 bp, homo sapien
gagaaagactttcttctctcacaaayggtaaacgcctgtcatcatgtatc

SEQ ID NO: 111424 - DNA, 50 bp, homo sapien
tgttcctctgtaacaataagtcaaayataaacaagcttaaacttattttc

SEQ ID NO: 111425 - DNA, 50 bp, homo sapien
gacctattcaaaaaataaatgacgargattcttttgctttgtttttttgt

SEQ ID NO: 111426 - DNA, 50 bp, homo sapien
tcatttgggtccatagtttatccacygaatataataatgcagcatttaca

SEQ ID NO: 111427 - DNA, 50 bp, homo sapien
actgatactggtttcctagcagttgragtattaagtgattgaaggacaga

SEQ ID NO: 111428 - DNA, 50 bp, homo sapien
gaaaccagtatcagtttgtgagaccyattttaattaaatgtttattccct

SEQ ID NO: 111429 - DNA, 50 bp, homo sapien
ttctttccactgtgaccctattacaygtcagtcactttatatgcactagc

SEQ ID NO: 111430 - DNA, 50 bp, homo sapien
caaaagcattttcaggtatctgacaycgccagttctctgcctttcttacc

SEQ ID NO: 111431 - DNA, 50 bp, homo sapien
agatgcaagtctcttgtcggatataygtattgagatattacacctagtct

SEQ ID NO: 111432 - DNA, 50 bp, homo sapien
ctgcatagggctttattcaacagaarcactaatttactccagactgcgag

SEQ ID NO: 111433 - DNA, 50 bp, homo sapien
gaattgatatgtatgttgtgaattayggatcagggttctttttttccccc

SEQ ID NO: 111434 - DNA, 50 bp, homo sapien
actataggctactgtgtcatgagtayatttaaggtaggctaggctaagct

SEQ ID NO: 111435 - DNA, 50 bp, homo sapien
agaagcaaaaagcatcaatcatttamactcaatgctgtactcttggataa

SEQ ID NO: 111436 - DNA, 50 bp, homo sapien
tttgaagaggaggaagaacttaaaaktgattttgtccatgtctttctatt

SEQ ID NO: 111437 - DNA, 50 bp, homo sapien
tgttgtatggcatttgactaagacayccaggaatgacaaaatcccacccc

SEQ ID NO: 111438 - DNA, 50 bp, homo sapien
atgttgaaatgtacaatgtttaaatkagtgggaagagtatgtgtgactaa

SEQ ID NO: 111439 - DNA, 50 bp, homo sapien
ctgcaaaacaagagagtaataccacrcaccttaaagtggcacctggatca

SEQ ID NO: 111440 - DNA, 50 bp, homo sapien
gcttaaaacgcagagctctgagaaasgctcgacttcaaacattgtttact

SEQ ID NO: 111441 - DNA, 50 bp, homo sapien
tcaagtgtgtgaccactatttcctaygagtttgtcttctgaaatatatat

SEQ ID NO: 111442 - DNA, 50 bp, homo sapien
tgagtctttttcctttcaaattccartaatccgcttcaagtgtgtgacca

SEQ ID NO: 111443 - DNA, 50 bp, homo sapien
cagctcacagcttaatttggagtaawtagaagaagctgaaaatcaatatg

SEQ ID NO: 111444 - DNA, 50 bp, homo sapien
catgatttgctctgtcattttcagarctaccaggaatacatagcgttgaa

SEQ ID NO: 111445 - DNA, 50 bp, homo sapien
tcctcacaaaaagcccatgaagaaartaccattgttagccccattttata

SEQ ID NO: 111446 - DNA, 50 bp, homo sapien
aatttatttttcctacctcttaatarctatcacagttgttcagtaatagt

SEQ ID NO: 111447 - DNA, 50 bp, homo sapien
gaagagttatgactttccaaaattcrtctcaaattaaggtgtaaacaaaa

SEQ ID NO: 111448 - DNA, 50 bp, homo sapien
ttcctcccattctttcatccacctaygtttaatccatcttaagttctatg

SEQ ID NO: 111449 - DNA, 50 bp, homo sapien
tgagtcttactaggataaaaccacarcattgctagagctgcattccttct

SEQ ID NO: 111450 - DNA, 50 bp, homo sapien
tgctctgttaccaaggtctccccaayattacaacatgcaaaaggtatatt

SEQ ID NO: 111451 - DNA, 50 bp, homo sapien
gccccaagatcgagttgtatgtagargctccaggcaatttctttcaaagg

SEQ ID NO: 111452 - DNA, 50 bp, homo sapien
ggtactcagtttaaggtttagagtaygcatgagatttcttttcattctcc

SEQ ID NO: 111453 - DNA, 50 bp, homo sapien
aacttgaaaaactgtaattctgggaragctacatattcaggtacatattc

SEQ ID NO: 111454 - DNA, 50 bp, homo sapien
gttagttacttcccggttacaagacrgtagctgcagctcctgccatctac

SEQ ID NO: 111455 - DNA, 50 bp, homo sapien
gtaggagtgtattaaaattgttaggracagttatacagaaaacaggagaa

SEQ ID NO: 111456 - DNA, 50 bp, homo sapien
aaatatgtccatgtaataaggaaatsaagtactcttaaatgtgtaaaaac

SEQ ID NO: 111457 - DNA, 50 bp, homo sapien
caatacatgctattttcactccacartatatttataaataatttctaatg

SEQ ID NO: 111458 - DNA, 50 bp, homo sapien
cagaaatatattgagatatgatttargaacaacagaacagagatgcctgt

SEQ ID NO: 111459 - DNA, 50 bp, homo sapien
aacataacctttggaaacttttgacscagttaatctcttccctttacaga

SEQ ID NO: 111460 - DNA, 50 bp, homo sapien
tgttttatttagctttgggtcctctrtagcacttactagagttcattgca

SEQ ID NO: 111461 - DNA, 50 bp, homo sapien
ctttttcctaattttcaaagcaatgyaagcccatttatacacagaaaagc

SEQ ID NO: 111462 - DNA, 50 bp, homo sapien
tcttaactgcttattaaaagtacacratggacataaagcaaccatatgca

SEQ ID NO: 111463 - DNA, 50 bp, homo sapien
attaacatgttgttacagctaagcgkagacactgaatcaggggcatgttt

SEQ ID NO: 111464 - DNA, 50 bp, homo sapien
agttttctgacatgtgactaggagawtaatgatgtactggaaaaagttag

SEQ ID NO: 111465 - DNA, 50 bp, homo sapien
gactgaggtcagtagtataacaaacwaataaaccagtgaacacattttac

SEQ ID NO: 111466 - DNA, 50 bp, homo sapien
atcaattcacttgtaattcagtttcsatgtcttctccaatctcctggaac

SEQ ID NO: 111467 - DNA, 50 bp, homo sapien
tttcatggtgttttctcaattaacartgtacttagtgctttaattttgtg

SEQ ID NO: 111468 - DNA, 32 bp, homo sapien
gatcagccagagaagtytgaggaggataagga

SEQ ID NO: 111469 - DNA, 50 bp, homo sapien
attatctgctttctgcttgccagtgkacttagaaatataaccataaaaat

SEQ ID NO: 111470 - DNA, 50 bp, homo sapien
tttgtgggacatcagcatctaggatragacgaaaacgaagggagtggacg

SEQ ID NO: 111471 - DNA, 50 bp, homo sapien
ttaaataacctcataaaataggtcarccattcttttgaatccaactggag

SEQ ID NO: 111472 - DNA, 50 bp, homo sapien
tcaacctatcctacatgtaggccaasttaaactgtatcaagtgtggctgg

SEQ ID NO: 111473 - DNA, 50 bp, homo sapien
taacaaatgttgcaacataatatagraaagctgaacatctaagttttgaa

SEQ ID NO: 111474 - DNA, 50 bp, homo sapien
agataggcaggtagaacaaatgcagygaaatgttaattgttgaatttagg

SEQ ID NO: 111475 - DNA, 50 bp, homo sapien
gaagatagtagtcactttactggccrctttttcatttataatcactttag

SEQ ID NO: 111476 - DNA, 50 bp, homo sapien
catttattttcaagcagttcaaatamaaagtgatgtagataggcaggtag

SEQ ID NO: 111477 - DNA, 50 bp, homo sapien
gagacgcctgaatttggaagtaggasaaaagcttaattgctgtgatgcag

SEQ ID NO: 111478 - DNA, 50 bp, homo sapien
ccaatttttctctattgttctggatraatcccagcatcttcagggaaact

SEQ ID NO: 111479 - DNA, 50 bp, homo sapien
tttttccttaagtcccaaatctgctrtaaagcaaagcctccccaaagacc

SEQ ID NO: 111480 - DNA, 50 bp, homo sapien
tggttctgctccccatcaggtagtayctcaattctcaggtagagctgcct

SEQ ID NO: 111481 - DNA, 50 bp, homo sapien
tgggccatggctcagcctctccacgwccgttttggaatgtcattgtactt

SEQ ID NO: 111482 - DNA, 50 bp, homo sapien
atttgaggtcttcctcatctttcacrcacatgaaaggtacttcaaaggta

SEQ ID NO: 111483 - DNA, 50 bp, homo sapien
ccttgaatactaactattcttctaamaacacgtgtgtggagctctgggtt

SEQ ID NO: 111484 - DNA, 50 bp, homo sapien
attaaaataaccttaaatttaattcrgaacttgctacatatttacaattt

SEQ ID NO: 111485 - DNA, 50 bp, homo sapien
aataaatagagctatgaagaacatawtataaagcagtatgagaatgtggg

SEQ ID NO: 111486 - DNA, 50 bp, homo sapien
tgattcttctccaaagacttcttccraggtaactagtgttttctatttgg

SEQ ID NO: 111487 - DNA, 50 bp, homo sapien
gaaaagaatgatcataagattgtaasttaaagagccaaagagggaaagat

SEQ ID NO: 111488 - DNA, 50 bp, homo sapien
aagtaccttggccgagtcctacaatwacacatgacagagccaaggctcaa

SEQ ID NO: 111489 - DNA, 50 bp, homo sapien
ctggaggagagtaagggttaaagaasaagcagaagaaaagagacccataa

SEQ ID NO: 111490 - DNA, 50 bp, homo sapien
gtctttttatactcttagaaagttaygtgtttctcatgaaaaaatgttca

SEQ ID NO: 111491 - DNA, 50 bp, homo sapien
ttagggtgtaagcagtttatcatggkatcttcctcccccttacccttctc

SEQ ID NO: 111492 - DNA, 50 bp, homo sapien
tttggcagtttgttattaagttaaaygtacaattatacaatggttcatca

SEQ ID NO: 111493 - DNA, 50 bp, homo sapien
atcttcttctaaattaacgacagcarcctatgaaaagcaggcagttttaa

SEQ ID NO: 111494 - DNA, 50 bp, homo sapien
atctgtgttaagtatgttgggaataygcagggcgagataaatttatgtac

SEQ ID NO: 111495 - DNA, 50 bp, homo sapien
catttatacatagaggaagggcttayggactgagaaagggagaacatggt

SEQ ID NO: 111496 - DNA, 50 bp, homo sapien
tctgatatacaaatatgattattgawctaaacattttttgaagttgagca

SEQ ID NO: 111497 - DNA, 50 bp, homo sapien
gccttcttgactttcattttgtattyctgctctgtagtctctcagttgat

SEQ ID NO: 111498 - DNA, 50 bp, homo sapien
aatgaatcattctgggacaggcagaragtcttcaattaggggaatagctc

SEQ ID NO: 111499 - DNA, 50 bp, homo sapien
ttcacagtcttaatatttagaggagracatgagtaaaatcacaaataaca

SEQ ID NO: 111500 - DNA, 50 bp, homo sapien
aaataaaaaggctagagtttgaaacyggatacaaggattaaaatattcct

SEQ ID NO: 111501 - DNA, 50 bp, homo sapien
tggctagctgggatccaaatgccaaygtgtttgtttctctatgggttttg

SEQ ID NO: 111502 - DNA, 50 bp, homo sapien
ttttctagaaacacacatgaacacakaaaaggtcatagtcatcataacta

SEQ ID NO: 111503 - DNA, 50 bp, homo sapien
agactactaatagagtaactcaaatratgaactaaagaatagaaatataa

SEQ ID NO: 111504 - DNA, 50 bp, homo sapien
cttccaacaatacgttggcttggaamcattagctgtaataaaggaggtta

SEQ ID NO: 111505 - DNA, 50 bp, homo sapien
aaaatgttatccaaggaatacaagaygagatttatctctcaagcaatgac

SEQ ID NO: 111506 - DNA, 50 bp, homo sapien
attggagctaggagtaggcaggcatracgctcagatcataatgctcagac

SEQ ID NO: 111507 - DNA, 50 bp, homo sapien
ttagataagagagggtcgtgattccsagcaataaaaaggcctagagagtg

SEQ ID NO: 111508 - DNA, 50 bp, homo sapien
taaaaaagctgacagatggaactagsaaatgaattgtaaaatcaagtaag

SEQ ID NO: 111509 - DNA, 50 bp, homo sapien
tggacaagctccaggacccattcccrctcatcatgtgaaagtattcataa

SEQ ID NO: 111510 - DNA, 50 bp, homo sapien
taataccttctctttcatgtctgcartatctcccttttcatcgctgccat

SEQ ID NO: 111511 - DNA, 50 bp, homo sapien
cttgctcacaagacagcctaaagcaytctctcttcctatttcagctgcaa

SEQ ID NO: 111512 - DNA, 50 bp, homo sapien
ctgcaaacaatacagctccatggaaytgaagcgacttgaaccaggtccaa

SEQ ID NO: 111513 - DNA, 50 bp, homo sapien
tgtatctcaatgtgacagatcctaargtccttttctccctaccatgaaat

SEQ ID NO: 111514 - DNA, 50 bp, homo sapien
tatgagggattttgcaatgtgaagasaaggaggttaaccaacatcaacct

SEQ ID NO: 111515 - DNA, 50 bp, homo sapien
gacagaaatagatgaattcagaagayatttttagagataggacttataat

SEQ ID NO: 111516 - DNA, 50 bp, homo sapien
ggagaagagggtgaagagactataayaaaactctggttaagtggacaagc

SEQ ID NO: 111517 - DNA, 50 bp, homo sapien
atgaatatcttctccctatcagcagwgtcattatacaattgcaaactcct

SEQ ID NO: 111518 - DNA, 50 bp, homo sapien
agcattttctttacctctgtcttcaygcataaaaggtcatctttgatcca

SEQ ID NO: 111519 - DNA, 50 bp, homo sapien
gaaatctcacgccatttcttaaaggmatctgatggagagtagtcttaatt

SEQ ID NO: 111520 - DNA, 50 bp, homo sapien
aaaatcctgcttcagcaaaattcaasgaaggagaaatcttcctgggactg

SEQ ID NO: 111521 - DNA, 50 bp, homo sapien
gtgagtccagctgatggatgttaaaragagggagcagtctagcagggaag

SEQ ID NO: 111522 - DNA, 50 bp, homo sapien
atcataacaacataaaatattgttckctgcatagcaaatgctacaatata

SEQ ID NO: 111523 - DNA, 50 bp, homo sapien
aggtggtgtagaatgaaaggcaaaamattataaacttgagtgaagccaaa

SEQ ID NO: 111524 - DNA, 50 bp, homo sapien
aagtactgaataaaaatggtctctayggtagattaaattcttgtccccaa

SEQ ID NO: 111525 - DNA, 50 bp, homo sapien
gtaaattttttgctgggggttgaagrataagaggagtagagcttaaactt

SEQ ID NO: 111526 - DNA, 50 bp, homo sapien
ggcagcttgtggtaaggccaagggasataacttcacagagatgtagccag

SEQ ID NO: 111527 - DNA, 50 bp, homo sapien
gagagagaatatgaatgagacacaaygtgaatgagagagatgtcaaccat

SEQ ID NO: 111528 - DNA, 50 bp, homo sapien
ctagatcgtagctgcgcttaaatggwatattctttactcacataaaatca

SEQ ID NO: 111529 - DNA, 50 bp, homo sapien
cataccagacaataagaaagcaatcraagactactagggtggtctcagta

SEQ ID NO: 111530 - DNA, 50 bp, homo sapien
gaattgaagaatggatggaaagccayggttattggagttgggaatgagtc

SEQ ID NO: 111531 - DNA, 50 bp, homo sapien
tattctgtcatcttggaagcgacttygaaattattatatacgtaatttat

SEQ ID NO: 111532 - DNA, 50 bp, homo sapien
taaggtcccgtttctataaggccaasgaatctgtgaaatccgtatttttt

SEQ ID NO: 111533 - DNA, 50 bp, homo sapien
gttgcctgtaacactacaagagaatsagactatagcgatgtgtggtactt

SEQ ID NO: 111534 - DNA, 50 bp, homo sapien
aaagtccagattttaatccgagacayggtgactgcttagataaatttcat

SEQ ID NO: 111535 - DNA, 50 bp, homo sapien
ctgaacatgtactatgttccatacaytatgttatgcattaatgttagcat

SEQ ID NO: 111536 - DNA, 50 bp, homo sapien
gtaacccatttaacatattgaactasgaatctctgccatagaccggtggt

SEQ ID NO: 111537 - DNA, 50 bp, homo sapien
tctagatttaattctcaatctacagsaatttttctcactattcttagaaa

SEQ ID NO: 111538 - DNA, 50 bp, homo sapien
caggaagtttttacacatcctttagractgcattaggtaacccttctttg

SEQ ID NO: 111539 - DNA, 50 bp, homo sapien
acattgctgcaacacatcagtggcaytgcaaaactgatctgaaagcgagt

SEQ ID NO: 111540 - DNA, 50 bp, homo sapien
catcatcacaaatggctggtcaagtyaaaacattacttttgcacaaggtt

SEQ ID NO: 111541 - DNA, 50 bp, homo sapien
accagaaatctgtagtttaaggcacyagatacatttcttggctgagcctt

SEQ ID NO: 111542 - DNA, 50 bp, homo sapien
aatgctaaaagaaatagtattcacckcatggagtcactgtgataattaaa

SEQ ID NO: 111543 - DNA, 50 bp, homo sapien
cataatagaagattatagaaatttaycacaatgaggaatactatgaggtt

SEQ ID NO: 111544 - DNA, 50 bp, homo sapien
gtcaaatcattttatgcagctctaaytgatattgctattcataacaattg

SEQ ID NO: 111545 - DNA, 50 bp, homo sapien
cagatctatgctatttcaaaggctaygcttattcccctaaactggatctc

SEQ ID NO: 111546 - DNA, 50 bp, homo sapien
aaattgaggcacacaatgataagtcrctagctcaagtttagcatcttcaa

SEQ ID NO: 111547 - DNA, 50 bp, homo sapien
aagacagaatgttagacgcacacaartattcgttgatttgcaatgacaag

SEQ ID NO: 111548 - DNA, 50 bp, homo sapien
tcaagtacattttccatcatttgtarcagacagaaatgctggctcagggc

SEQ ID NO: 111549 - DNA, 50 bp, homo sapien
caggaaaaggtgccattagtaaaaaytccatcactaacattttggtacca

SEQ ID NO: 111550 - DNA, 50 bp, homo sapien
tacaatccacccaacaacagaagaaytgactaacaaaatgtataccaaaa

SEQ ID NO: 111551 - DNA, 50 bp, homo sapien
ttgtctgggtagaagttagagtatamgttagttttaaaccacagattagt

SEQ ID NO: 111552 - DNA, 50 bp, homo sapien
cttcttacatgtctctgtttttatcrggaaagaagatctttgtcagtagt

SEQ ID NO: 111553 - DNA, 50 bp, homo sapien
tggacactatggttatagaacacaaraagtagacattgtattagttttct

SEQ ID NO: 111554 - DNA, 50 bp, homo sapien
ttcttcagcacatggtttatgaccasgaatattatttatttccaagttag

SEQ ID NO: 111555 - DNA, 50 bp, homo sapien
tgggattatttatcatagttttagaygtcattaggaggtagaacttttaa

SEQ ID NO: 111556 - DNA, 50 bp, homo sapien
cactgggatcagaatggaaatactaraatctgttttgtggtatcctaaat

SEQ ID NO: 111557 - DNA, 50 bp, homo sapien
attctagacacttttattacaacagraaacctcatcagaagggagttaag

SEQ ID NO: 111558 - DNA, 50 bp, homo sapien
tagtgttgtcgactctacgcacttayaaataccccttagctgaagtcaaa

SEQ ID NO: 111559 - DNA, 50 bp, homo sapien
ccctacaggtattctgaaaagattayattagattgaacttttagaactta

SEQ ID NO: 111560 - DNA, 50 bp, homo sapien
ataaaaattcacctataatcattgtyaacattttagattttgatttacac

SEQ ID NO: 111561 - DNA, 50 bp, homo sapien
agcaaggtccttgctggtgggattgracagaaagaagctcagtgtctctc

SEQ ID NO: 111562 - DNA, 50 bp, homo sapien
atacattaaatcagttaaatctcatyagtcgattgtagccatgtgttgaa

SEQ ID NO: 111563 - DNA, 50 bp, homo sapien
tcacacattgcttaaaatctcattgkaaagatccaaaaatatataaatta

SEQ ID NO: 111564 - DNA, 50 bp, homo sapien
aagaaagttggatttggaagtcttayggaatgggaccttggctttaagat

SEQ ID NO: 111565 - DNA, 50 bp, homo sapien
gatgggagcatttgaacaggaactcraaagatgaagatttggagcctgag

SEQ ID NO: 111566 - DNA, 50 bp, homo sapien
tggtgaagaggcctcgaaactaggayaggaattctaatagttaatgaaaa

SEQ ID NO: 111567 - DNA, 50 bp, homo sapien
aaaatatttgaaaatcgtatatccarcaaaggatgatatatctatttttc

SEQ ID NO: 111568 - DNA, 50 bp, homo sapien
agagatttcttactagataagagtgmaataaacccttgaaaatcaacttc

SEQ ID NO: 111569 - DNA, 50 bp, homo sapien
ggccagctcttctctcaatcactcartaaagaattaattgatcagcacca

SEQ ID NO: 111570 - DNA, 50 bp, homo sapien
caaagaatattatttctcttacctartagaataaacagataaaaataaaa

SEQ ID NO: 111571 - DNA, 50 bp, homo sapien
agctctcattttattagttggtataygcagtgcttaaaggccttatgcgg

SEQ ID NO: 111572 - DNA, 50 bp, homo sapien
aaacagtctttctttttcttacacawgctttcataaagatgaaaaaagga

SEQ ID NO: 111573 - DNA, 50 bp, homo sapien
gtgatggatttttaaagattcaaatyaattaccaaatcctagatgctttc

SEQ ID NO: 111574 - DNA, 50 bp, homo sapien
accaattacaagtgataaacaactcrctaaccagaaaagtaagaagcagt

SEQ ID NO: 111575 - DNA, 50 bp, homo sapien
gaactacaacaagactcacagtaacyatggaaacgtaaatttggaaagtt

SEQ ID NO: 111576 - DNA, 50 bp, homo sapien
ttaccacgtggaaaaccatgagaacrgtgtataggtactatgcattcttg

SEQ ID NO: 111577 - DNA, 50 bp, homo sapien
gagtattttgtgaaaagcaggccacrattttttatgtctgtgatccatcc

SEQ ID NO: 111578 - DNA, 50 bp, homo sapien
atttaaggaaaacatatatatggagragtagtttatgtctacatttgctc

SEQ ID NO: 111579 - DNA, 50 bp, homo sapien
ggaagtttacatcaataaatggctamgtcaaaaaagtaggaagacttcaa

SEQ ID NO: 111580 - DNA, 50 bp, homo sapien
gggaatccctagactgatgaaaagayctccaaagaaactgttctattcat

SEQ ID NO: 111581 - DNA, 50 bp, homo sapien
gctgcaagcttttctgaatctgaagkctcgttaagattaatcagatactg

SEQ ID NO: 111582 - DNA, 50 bp, homo sapien
taatcccgtgaatgagataaccacartagacttagacaaatcaagtctcc

SEQ ID NO: 111583 - DNA, 50 bp, homo sapien
gaaatagaagatcttgtaagcttaaygacctaaacaaccttcctcaatcc

SEQ ID NO: 111584 - DNA, 50 bp, homo sapien
cactcttctttaaacagttgttaaawctctcttatgcatttgacattggg

SEQ ID NO: 111585 - DNA, 50 bp, homo sapien
tagatatttggagcagggtggataayggaagtagtgttttagctgaaagc

SEQ ID NO: 111586 - DNA, 50 bp, homo sapien
catcactttatggttagagggatgaygttttattatgggcccacaaactg

SEQ ID NO: 111587 - DNA, 50 bp, homo sapien
agaatgagccagcttagggtggcaartgtccctgaagttggctgcatgtc

SEQ ID NO: 111588 - DNA, 50 bp, homo sapien
catcagcaacattttaagagtaaaaytggtgattaatggtgcaagtttgc

SEQ ID NO: 111589 - DNA, 50 bp, homo sapien
attagacagattagaaacctagactsagcctttattgatggactcagtga

SEQ ID NO: 111590 - DNA, 50 bp, homo sapien
gtcaggattggtcagattgttgtgascaccagcttagttatgacacggac

SEQ ID NO: 111591 - DNA, 50 bp, homo sapien
tcttgtagcagccatggaagcatcaytaagggatcttattgttaatgtta

SEQ ID NO: 111592 - DNA, 50 bp, homo sapien
agggggtattacgacggcctcctaaytggtgtcgctagttctgtccttac

SEQ ID NO: 111593 - DNA, 50 bp, homo sapien
atgagaacaagcatttgggaaggtargaagaagaaatcattttgtgaagg

SEQ ID NO: 111594 - DNA, 50 bp, homo sapien
tatcaatgggagtagggaatattcartaaaaggatgatagtcctgaagtt

SEQ ID NO: 111595 - DNA, 50 bp, homo sapien
aaacatatgcagttttatcattctgyactgtaggaaggttgaaggaacac

SEQ ID NO: 111596 - DNA, 50 bp, homo sapien
taatcattgatgttaaggtagaaatwaaatataccagctctaaaatatgc

SEQ ID NO: 111597 - DNA, 50 bp, homo sapien
gaagagctgttaacagagtccagatyatcactttatggttagagggatga

SEQ ID NO: 111598 - DNA, 50 bp, homo sapien
ctttctctggaagagtaaaagacackcatttgcccaatacatggactttg

SEQ ID NO: 111599 - DNA, 50 bp, homo sapien
tcttgagaggaggaaatagttctgaygttgcacattgtcattctgctgga

SEQ ID NO: 111600 - DNA, 50 bp, homo sapien
cgcaattggtttaatatcttcattamctgaattcttgggtcctctgccca

SEQ ID NO: 111601 - DNA, 50 bp, homo sapien
gcaccaatttacagtatgattacackgccatgattgaatttagccagaac

SEQ ID NO: 111602 - DNA, 50 bp, homo sapien
atttaataaacttgcttaactgagaractgatttattaaatatgtgacat

SEQ ID NO: 111603 - DNA, 50 bp, homo sapien
cctaaacatagttttcatttgatgaygtatttaagaggcaaagtataagg

SEQ ID NO: 111604 - DNA, 50 bp, homo sapien
gcacttcttacatggtggtgacaagrtaaaataaggaagatgcaaaagtg

SEQ ID NO: 111605 - DNA, 50 bp, homo sapien
ttgaaagttgctttcaaattgttgaktatcttctcagcaatgccccgctc

SEQ ID NO: 111606 - DNA, 50 bp, homo sapien
aaacccagctgctcacaaactaaaaytgtcacaagtaataaaaaatcctg

SEQ ID NO: 111607 - DNA, 50 bp, homo sapien
taaaagatctttatgattcaaaagcrccttgttttaggagacagcaatag

SEQ ID NO: 111608 - DNA, 50 bp, homo sapien
agaattgatcatggattttgagagcracatatactaccttgtaaggtttg

SEQ ID NO: 111609 - DNA, 50 bp, homo sapien
caaatctgtgttgagtccttaagacrgataaagattacaagtactctttg

SEQ ID NO: 111610 - DNA, 50 bp, homo sapien
tgtttgttaacagaggtgtccaagcrcaagtcactcttttttttcttttt

SEQ ID NO: 111611 - DNA, 50 bp, homo sapien
ctggaagccatggtagctttggtagmcatattactgaaatatagcccaaa

SEQ ID NO: 111612 - DNA, 50 bp, homo sapien
ttctgatctggtttaaatttgttgayggcaattatgttatgtcatattga

SEQ ID NO: 111613 - DNA, 50 bp, homo sapien
taattgggagacactgcaaataaccygaaaataaatgcatgttttggcct

SEQ ID NO: 111614 - DNA, 50 bp, homo sapien
ctatattttaatcaatgatttatacraaaacatctctttaccttcttcaa

SEQ ID NO: 111615 - DNA, 50 bp, homo sapien
tgccacgggtcataatgatcgtgacrgatgggagacctcaggactccgtg

SEQ ID NO: 111616 - DNA, 50 bp, homo sapien
agaatgggtgaatttatgagggatcraaaataaagagcaataagcaatgt

SEQ ID NO: 111617 - DNA, 50 bp, homo sapien
ggttgctagcatatcagcatgaaacrccattggaggccaaggaagtggat

SEQ ID NO: 111618 - DNA, 50 bp, homo sapien
gatttcagagtcattttcccagaacraaaaaatgatatttccaaatcaaa

SEQ ID NO: 111619 - DNA, 50 bp, homo sapien
acatgcggaatatatttcttggcaasgttttgaagtatagacatgagggt

SEQ ID NO: 111620 - DNA, 50 bp, homo sapien
tagaaaaacagaggcctccataaatsagcaatatgcaatgggaggagaca

SEQ ID NO: 111621 - DNA, 50 bp, homo sapien
aagagccaacactggcaagcgaatgragttaaccttgagggcctttaaca

SEQ ID NO: 111622 - DNA, 50 bp, homo sapien
ttcatctgtaatgggttgtaatatargagtcattgcatgagaagcactta

SEQ ID NO: 111623 - DNA, 50 bp, homo sapien
attctaaatattgactgtattttacraccagcttacaaaatttctaaaaa

SEQ ID NO: 111624 - DNA, 50 bp, homo sapien
caaccataatgacataaacagtgaawattgttttaacccataattgtgat

SEQ ID NO: 111625 - DNA, 50 bp, homo sapien
atattgatcatggctctcttctaacyatcttattctcaagtttccagact

SEQ ID NO: 111626 - DNA, 50 bp, homo sapien
actaaatagctagagatgaggctagyagataaatagagaccaggtcatag

SEQ ID NO: 111627 - DNA, 50 bp, homo sapien
aaattcaaatgagggcatcacaaacrcagcctatcagccctgcaatctca

SEQ ID NO: 111628 - DNA, 50 bp, homo sapien
taaatagtaatgtacacaactgatayataggaaggacacatatgttttac

SEQ ID NO: 111629 - DNA, 50 bp, homo sapien
gtgtgtgcctgcacacatgtgaataytactttttgtttgttaggtttact

SEQ ID NO: 111630 - DNA, 50 bp, homo sapien
caaagagcttccttgttctgttttcyagctgcaggatttcatcgtgtgcg

SEQ ID NO: 111631 - DNA, 50 bp, homo sapien
cctgtctcggaagcaggagcctgacygaccaattgaggccttgggggaga

SEQ ID NO: 111632 - DNA, 50 bp, homo sapien
tctgcctctccagggaagatgggtcrgacaatcatggcatgaacttgagc

SEQ ID NO: 111633 - DNA, 50 bp, homo sapien
tatttcaaatgttttcatagtaaccrttgcattttttgtcttctgccatg

SEQ ID NO: 111634 - DNA, 50 bp, homo sapien
gccaggaattatttactgaattaagmaaagttgtcaacatgataataacc

SEQ ID NO: 111635 - DNA, 50 bp, homo sapien
ttcacagtgaatgacagaatgccaartcttctaggcctggaataaataaa

SEQ ID NO: 111636 - DNA, 50 bp, homo sapien
ttgaggctgagaatgaatggtaggartatcatagatgacagctcaagggc

SEQ ID NO: 111637 - DNA, 50 bp, homo sapien
ctgttcccttgtatttgataaagaaraagaattagaaataggctcaattt

SEQ ID NO: 111638 - DNA, 50 bp, homo sapien
gattaggtgcctatgttttcattgcyaggctgtatccctgcatccctctt

SEQ ID NO: 111639 - DNA, 50 bp, homo sapien
cgctcttctgactgagctccaactamagccttaattctcaccagcccttg

SEQ ID NO: 111640 - DNA, 50 bp, homo sapien
tgggcccttggcacctgaataaaggrtccaaaaaccagacagcctgagca

SEQ ID NO: 111641 - DNA, 50 bp, homo sapien
attaaattatccttgtaaccacttakcttggttttagcttagcttctctg

SEQ ID NO: 111642 - DNA, 50 bp, homo sapien
ctgaatttttgactcaaggtgggaastaaaacactaggctgggcatggtg

SEQ ID NO: 111643 - DNA, 50 bp, homo sapien
ttcttagtgaaaagacataagcccartaggcctacacctttcatacttta

SEQ ID NO: 111644 - DNA, 50 bp, homo sapien
tgctgataacggtcatttacaccgakacagagaatcatcaagtctagatt

SEQ ID NO: 111645 - DNA, 50 bp, homo sapien
aacatatagtgtatttgcattaagcrttttataaagtaatgaatcttctt

SEQ ID NO: 111646 - DNA, 50 bp, homo sapien
ctgcaagcattcacatcattaaacayaaaggaaagtaagagcaaaggcag

SEQ ID NO: 111647 - DNA, 50 bp, homo sapien
ttggtgttacatgcttcacagaatcyatttcaaaccacagagaattgcac

SEQ ID NO: 111648 - DNA, 50 bp, homo sapien
gctaaaacacatctttgcaggatgasaatgagttacacagacattaatta

SEQ ID NO: 111649 - DNA, 50 bp, homo sapien
aaaggtaaacttacttgaaatttaamagattctataccaacttggcaacc

SEQ ID NO: 111650 - DNA, 50 bp, homo sapien
atgaatagatcaactttgcttaagaytccaggatatcagcaaagaaagca

SEQ ID NO: 111651 - DNA, 50 bp, homo sapien
attgctgctacaaccttaaatataayggtgtgaatggctctgctattatt

SEQ ID NO: 111652 - DNA, 50 bp, homo sapien
gtccacttctccacacttgctctttyggaaaggtgtgctgataaaactgt

SEQ ID NO: 111653 - DNA, 50 bp, homo sapien
gttctatcaacaagaaactaatatarcatgccaaaataaaatgtataaca

SEQ ID NO: 111654 - DNA, 50 bp, homo sapien
ccaatatacagtattctttcaaaacmaaatctctaaagaataaatatgga

SEQ ID NO: 111655 - DNA, 50 bp, homo sapien
ttgctctaggccagaatgtgataaargtaaactacgataaactacatgta

SEQ ID NO: 111656 - DNA, 50 bp, homo sapien
acaatatttctatctttgtaacttayatagctctttacctttatttctcg

SEQ ID NO: 111657 - DNA, 50 bp, homo sapien
ttcatagggtttacagtcttggggartcaggtaaccaaataagaaatttt

SEQ ID NO: 111658 - DNA, 50 bp, homo sapien
ttcctggtttagataaactcagaatsaatatggttgagtaaataaacaaa

SEQ ID NO: 111659 - DNA, 50 bp, homo sapien
tttccctcagtttccatattttaaayagcctttcagatactcctattata

SEQ ID NO: 111660 - DNA, 50 bp, homo sapien
tagattatgtgggtttaacaatccartgctgtcatttactgtgaatttta

SEQ ID NO: 111661 - DNA, 50 bp, homo sapien
ttgacaactatggaaggctactggartaatatttttgggcaggtggaagg

SEQ ID NO: 111662 - DNA, 50 bp, homo sapien
acgctgctaggtacattgcacatggyggtgatcaagccagacatatactc

SEQ ID NO: 111663 - DNA, 50 bp, homo sapien
gctaagctgaactctaataaccttamgacaatagcagaggattggttact

SEQ ID NO: 111664 - DNA, 50 bp, homo sapien
gaaatgtgaagaccttcagtgtatcscatttaaattgacttgcaaggctt

SEQ ID NO: 111665 - DNA, 50 bp, homo sapien
ttccagtacagtgcttgtgttcataycatattacggtgtttttctggcat

SEQ ID NO: 111666 - DNA, 50 bp, homo sapien
ccgggagatttgatcttgaaaggtgraacatattaaaattagagggctct

SEQ ID NO: 111667 - DNA, 50 bp, homo sapien
cttaaagttctaggctactggcttcrcataattttcatatagcatcttat

SEQ ID NO: 111668 - DNA, 50 bp, homo sapien
cccatgatgtctctgctgtgagtaayggttatcgaatttttggaagttaa

SEQ ID NO: 111669 - DNA, 50 bp, homo sapien
aaactaaggtttaagaagatatgcasagtcctagttctgttcttaagaaa

SEQ ID NO: 111670 - DNA, 50 bp, homo sapien
cttctgatatttcttaaataataaarctcatcatttaaaagacaaacatg

SEQ ID NO: 111671 - DNA, 50 bp, homo sapien
cgaatcttcatactcaaggagcagayagtctttagtagagtaattttctg

SEQ ID NO: 111672 - DNA, 50 bp, homo sapien
actgtcttggttatgtagattaacartaagtcttgaagtcaggcagtagc

SEQ ID NO: 111673 - DNA, 50 bp, homo sapien
ctttactcaattacctcaggtatgakatctaaccaaagaccctcagcaat

SEQ ID NO: 111674 - DNA, 50 bp, homo sapien
gttgcttgcttctgtggactttcaaratccgagtccccacacaagaagtc

SEQ ID NO: 111675 - DNA, 50 bp, homo sapien
gaggatacaggtgcaagccaccgcaygtgtagaaatatataatctgactt

SEQ ID NO: 111676 - DNA, 50 bp, homo sapien
caaggggagtagtaagattggcttasaaaggtagtctgggaatgatctac

SEQ ID NO: 111677 - DNA, 50 bp, homo sapien
tggtgactgaggaattatagtgagcragaatatttctgaggggaactgga

SEQ ID NO: 111678 - DNA, 50 bp, homo sapien
agtagttgcatgtggtaaggaaaggkcaatgataaagagttactgctaat

SEQ ID NO: 111679 - DNA, 50 bp, homo sapien
aaaatatctgaaagcttaaaaggcargtctggacaaggggagtagtaaga

SEQ ID NO: 111680 - DNA, 50 bp, homo sapien
gtactgttacaatctttcaattaacratttgtagcagaagtaattctgtg

SEQ ID NO: 111681 - DNA, 50 bp, homo sapien
aaggcaaagagtgcaaataaggatayatgtgtggccaacatttaagccac

SEQ ID NO: 111682 - DNA, 50 bp, homo sapien
tacggcagtaatagaaatgaatagakagtgcgttgagttgtggctaacgg

SEQ ID NO: 111683 - DNA, 50 bp, homo sapien
tctgccattttttatctcaaacccargtattccagttagtgccacactca

SEQ ID NO: 111684 - DNA, 50 bp, homo sapien
cctgtcctctggatttccagtcacaygaaccacctagcaatgttttgtct

SEQ ID NO: 111685 - DNA, 50 bp, homo sapien
gggatttgatcaatcattttctcacyatattgctcaaacaaacactttct

SEQ ID NO: 111686 - DNA, 50 bp, homo sapien
cacctagtctaggatgattgttacaygcttctagcaacaagtgcacataa

SEQ ID NO: 111687 - DNA, 50 bp, homo sapien
agacagaaggatgaaagggcataacrggaacattaatcagaaagtgcaaa

SEQ ID NO: 111688 - DNA, 50 bp, homo sapien
tgaggtgagatataagacagtgatayaaaattgtaagaagataataagaa

SEQ ID NO: 111689 - DNA, 50 bp, homo sapien
gagcatttccagtttccactttgtaragctgatactcatgttttaactgc

SEQ ID NO: 111690 - DNA, 50 bp, homo sapien
ctcaacaaataaggacatttataaaycaaggtaatgcatatacttaaatt

SEQ ID NO: 111691 - DNA, 50 bp, homo sapien
tgatggatgtatcactttggaatgayccttaatgtcacatcatagttggt

SEQ ID NO: 111692 - DNA, 50 bp, homo sapien
ttttaaatagattaagaaatataccraaggccacccaaggaaaattcaca

SEQ ID NO: 111693 - DNA, 50 bp, homo sapien
aaatgagttggttaacaaattgttgsaatggttagaagagcagatgctag

SEQ ID NO: 111694 - DNA, 50 bp, homo sapien
actatgttgattcaagatgttaaaaygaatctgcctctaactagtaaaat

SEQ ID NO: 111695 - DNA, 50 bp, homo sapien
gagccacacgcaacagcaatatcctstttcagaactagcgctgtggcact

SEQ ID NO: 111696 - DNA, 50 bp, homo sapien
cttttagcaggcatatgtgtgcgtgraaataatgacataaaacattaaaa

SEQ ID NO: 111697 - DNA, 50 bp, homo sapien
aaaagtaactgcacaaattaaacaaytcagtatttcataaacttcaaaat

SEQ ID NO: 111698 - DNA, 50 bp, homo sapien
ttaaaaacatgaggagctgaaaatawgtgtaactgattgcatattgtcct

SEQ ID NO: 111699 - DNA, 50 bp, homo sapien
gtttttggggtttccaaacacaaagycacccaaactacatgtaaatccca

SEQ ID NO: 111700 - DNA, 50 bp, homo sapien
tctctagaagctgccacaagttggaytattttatcatttagcaaaaagag

SEQ ID NO: 111701 - DNA, 50 bp, homo sapien
taacagactgagaattcactgaaaayacgtctcttaaaagtttggaaggt

SEQ ID NO: 111702 - DNA, 50 bp, homo sapien
atccaaaggaagctggataccatcaygaataaaatgaaatgttctctaag

SEQ ID NO: 111703 - DNA, 50 bp, homo sapien
agtctcttggttgcatgtttcaaatktatgaatccctaaatcatctgaag

SEQ ID NO: 111704 - DNA, 50 bp, homo sapien
ttttggaggtaatggatatacttackgcttcagttgtggtggtttcatag

SEQ ID NO: 111705 - DNA, 50 bp, homo sapien
tattgacgtctcaaaattacatgcamtagagtatgaacagctggttctcc

SEQ ID NO: 111706 - DNA, 50 bp, homo sapien
ataacagcttatagagacgttactayggacaggtgttttctagacaaatg

SEQ ID NO: 111707 - DNA, 50 bp, homo sapien
tggtgatacctggttagttgaaagamgcaatggttcaatggcacctaaat

SEQ ID NO: 111708 - DNA, 50 bp, homo sapien
caataactgtattattatgattacasagttcataccctcgctctgttctt

SEQ ID NO: 111709 - DNA, 50 bp, homo sapien
gactgaaacaaggtaacactacctaratcacaaacagttatatcaagaga

SEQ ID NO: 111710 - DNA, 50 bp, homo sapien
aagaggggttgccatatctgtcagtyaatatgttgtctttcttcggtgtc

SEQ ID NO: 111711 - DNA, 50 bp, homo sapien
ccattattgataggtatattttaaaytgtaattgatgaattgctggctgt

SEQ ID NO: 111712 - DNA, 50 bp, homo sapien
aaggagctcactattcagtgagatasatgagatacacatgcctggcacag

SEQ ID NO: 111713 - DNA, 50 bp, homo sapien
atttcaacagactctcaaacctgcayggcaatattctgctaatctgtttg

SEQ ID NO: 111714 - DNA, 50 bp, homo sapien
tagactgttgctctattacacattaygataaacttaaaaatctttatctc

SEQ ID NO: 111715 - DNA, 50 bp, homo sapien
cacttcaggagacaggttcacattgytttccactcatcaaacccaaaggg

SEQ ID NO: 111716 - DNA, 50 bp, homo sapien
acaaatgatgccattagttttgatayatagagtgctaggtacaactactt

SEQ ID NO: 111717 - DNA, 50 bp, homo sapien
cctgactctgtaccttgaaagtcaamtgagagttctatgatttccctcta

SEQ ID NO: 111718 - DNA, 50 bp, homo sapien
tcaacctgaatagattagataacgcygatccatactgagaaggatcatct

SEQ ID NO: 111719 - DNA, 50 bp, homo sapien
tatttgtaagacggccatataataayagcagagtagagtagtgctattaa

SEQ ID NO: 111720 - DNA, 50 bp, homo sapien
ctttgtaacacagcagttatgagtgratgcctttacatttcttcagtata

SEQ ID NO: 111721 - DNA, 50 bp, homo sapien
gcaagttttttaaagaggtgctctaygtggaacattatatgaataacaat

SEQ ID NO: 111722 - DNA, 50 bp, homo sapien
ccaaccctaaagcccgctgagatccrgagccttatcattccaaccaaaac

SEQ ID NO: 111723 - DNA, 50 bp, homo sapien
atataaaaatatgataagtccacaaytgtaggcaataaatttatattggt

SEQ ID NO: 111724 - DNA, 50 bp, homo sapien
ctatgttaacgctgaggttttagatsactgccttaaaaaataataacatc

SEQ ID NO: 111725 - DNA, 50 bp, homo sapien
tctcaagaaatgtcagaggtaatacycatgttatcacagaggatgtgtga

SEQ ID NO: 111726 - DNA, 50 bp, homo sapien
ctgtgcataaaattgttgaaatctayaaaattcaagataatcgtgttttt

SEQ ID NO: 111727 - DNA, 50 bp, homo sapien
gaacctgagactgaaaccaacacaayggaaagcagaactgaaatatgaag

SEQ ID NO: 111728 - DNA, 50 bp, homo sapien
gcatttacatttaatcctccaactayccttgtaaaataggcatgaataac

SEQ ID NO: 111729 - DNA, 50 bp, homo sapien
atggatctaggttgaatgatgtcaaygggaatttgtttctcttcatattt

SEQ ID NO: 111730 - DNA, 50 bp, homo sapien
caacgacataatggaatgcaatagamcactggtttttctgattacattcc

SEQ ID NO: 111731 - DNA, 50 bp, homo sapien
gacaaaggatttagaaacactagaakaagaactctccttgaattcctaat

SEQ ID NO: 111732 - DNA, 50 bp, homo sapien
aattagggtttcagccatcattgaargagacatgattttactagacattt

SEQ ID NO: 111733 - DNA, 50 bp, homo sapien
gcctagctgcctatttaccctcaccyattagatatattgtatgcattaat

SEQ ID NO: 111734 - DNA, 50 bp, homo sapien
atttcaaatacagctgtacctgtccrattatcttaacaaggccacaatct

SEQ ID NO: 111735 - DNA, 50 bp, homo sapien
attatctaaataaattacccgtggaytcaaatgtgtacatatttcaaagg

SEQ ID NO: 111736 - DNA, 50 bp, homo sapien
ttgagctgaaatctttttcctgcaarcagatatacgccagtatctctaga

SEQ ID NO: 111737 - DNA, 50 bp, homo sapien
cactgccactcatatttcatcagtaytaaagctgatcgtttgatttcctt

SEQ ID NO: 111738 - DNA, 50 bp, homo sapien
atggagatttagtaccgaaagcatayggatggtaactggtattctttaag

SEQ ID NO: 111739 - DNA, 50 bp, homo sapien
gccaattatctcctttgctttgtaamtactttgtaatatcttgcttctga

SEQ ID NO: 111740 - DNA, 50 bp, homo sapien
atatacaaaataaataaaggttcagwctaatgctgaggttcttaaagcag

SEQ ID NO: 111741 - DNA, 50 bp, homo sapien
ttactgtgaagccttgctaccatgcraacaacttttatgttactgacatt

SEQ ID NO: 111742 - DNA, 50 bp, homo sapien
atatgataccatcagtcttcagatgycacactttccacattttacagttg

SEQ ID NO: 111743 - DNA, 50 bp, homo sapien
ttttttacaaaacacagtgtctttayattttcagaacctcaaactccagc

SEQ ID NO: 111744 - DNA, 50 bp, homo sapien
tctctggtcctgacatttaagctaaytttgtcatgggatgtccagggcct

SEQ ID NO: 111745 - DNA, 50 bp, homo sapien
agaacacccaacagatactgctcaartgaatgaaatgccacatttatacc

SEQ ID NO: 111746 - DNA, 50 bp, homo sapien
tttttcacaacttaaatgaacagaarttatgtgactaaattcaatgatgt

SEQ ID NO: 111747 - DNA, 50 bp, homo sapien
tgcaactgctgcttcatgtggcactkttatgctatgcagacagcttcttt

SEQ ID NO: 111748 - DNA, 50 bp, homo sapien
ttggtcatgatttcacgtttatagaytcccttagctgccacttgatcttt

SEQ ID NO: 111749 - DNA, 50 bp, homo sapien
aaatatttgatgagtgtacccatgaragaatataagaatgatatgcattg

SEQ ID NO: 111750 - DNA, 50 bp, homo sapien
tagaaataaccaccatattcagctaktcttgctatacgttatggtcaaaa

SEQ ID NO: 111751 - DNA, 50 bp, homo sapien
attttgctgcctctaagctaacagcrattaaagttcacagtttcatgcag

SEQ ID NO: 111752 - DNA, 50 bp, homo sapien
ggagcagaaaggtcataacacataamcacaaaatgttaagaacaaggttc

SEQ ID NO: 111753 - DNA, 50 bp, homo sapien
tttatgggaaattctttttcacttaygtatttccttccttagcttcttcc

SEQ ID NO: 111754 - DNA, 50 bp, homo sapien
ctactatttctatcagtgaccttccratacaaattcttattaacacatta

SEQ ID NO: 111755 - DNA, 50 bp, homo sapien
ttgaggaaaatattactcattggtayatataaactctgatatttgaaact

SEQ ID NO: 111756 - DNA, 50 bp, homo sapien
tgacgttaaatgcattaattttccayactgtgcaagtcatgtatgtagag

SEQ ID NO: 111757 - DNA, 50 bp, homo sapien
catggacaattcgctctttgaatgayatttcttgccactgcttttatacc

SEQ ID NO: 111758 - DNA, 50 bp, homo sapien
gcatccatggtgtaatttagctcaaragaagaaggaagagtttatatgga

SEQ ID NO: 111759 - DNA, 50 bp, homo sapien
tgattgctctccgacgataatcccaytacagatatgtttctcttcttggg

SEQ ID NO: 111760 - DNA, 50 bp, homo sapien
gaggggaaaatttgtactttgttaaratgctaccttagtatgcatcccaa

SEQ ID NO: 111761 - DNA, 50 bp, homo sapien
agttatatataaaggtacaatttgaygataaatatttcaaaaagttatat

SEQ ID NO: 111762 - DNA, 50 bp, homo sapien
ctcattttaaatatatgactgggaaycaactacagccctaggtacctgtt

SEQ ID NO: 111763 - DNA, 50 bp, homo sapien
ggaaggaatataaaatggtaagatgsaagaatttatggtgctttttggtg

SEQ ID NO: 111764 - DNA, 50 bp, homo sapien
atttcaaaatttctttgacattctamctacaatttcaaaatcagttgatc

SEQ ID NO: 111765 - DNA, 50 bp, homo sapien
tgccactgattaaaaataacagtaargcaactgttctgatcaaataatga

SEQ ID NO: 111766 - DNA, 50 bp, homo sapien
gtaaaagttgaaaatgaagttctcaraaagaaattagtgccatgatattc

SEQ ID NO: 111767 - DNA, 50 bp, homo sapien
gggatagcaggcacagccttaagcckccttattcaagcagaactgggcca

SEQ ID NO: 111768 - DNA, 50 bp, homo sapien
agagatcatgagaacaacttcagaaytgtcaatgaataatggagtaatag

SEQ ID NO: 111769 - DNA, 50 bp, homo sapien
ttagttattgaaatattgtttatcgwccttggaggcttaaagtatgaaag

SEQ ID NO: 111770 - DNA, 50 bp, homo sapien
gcactcacacactgtaaaggagatargcacttaataaatattcacaaaat

SEQ ID NO: 111771 - DNA, 50 bp, homo sapien
ggtcaaaacatctaaattaaaagaasactacacttgagcatatgatagta

SEQ ID NO: 111772 - DNA, 50 bp, homo sapien
tacattaagtactcaataactgataygtaaattgaaaatattattatgcc

SEQ ID NO: 111773 - DNA, 50 bp, homo sapien
ctgagacaagaatagactgagatgayagaaaaattgaattatatacaatt

SEQ ID NO: 111774 - DNA, 50 bp, homo sapien
attttctctgtattgctaagtagtaytccattttatgaatataccacaat

SEQ ID NO: 111775 - DNA, 50 bp, homo sapien
tactacctggatgatctgcaggcacygaaaatcgacatcatcaaaatgaa

SEQ ID NO: 111776 - DNA, 50 bp, homo sapien
gcagagaacaaggaagccgtcaagaraggagcctttatttagggaatgat

SEQ ID NO: 111777 - DNA, 50 bp, homo sapien
tgttatgaccataaagcctttactcraaactagtagactaccaattaaca

SEQ ID NO: 111778 - DNA, 50 bp, homo sapien
ggggaattaggaaagttgatgcataraagtggagagatgggcagggatgg

SEQ ID NO: 111779 - DNA, 50 bp, homo sapien
atgcttctttttatttccagtactgmattctgtgacaggtacataaaaag

SEQ ID NO: 111780 - DNA, 50 bp, homo sapien
ttaatcacctccttctcttaccacarctctcagctaacttgttactctat

SEQ ID NO: 111781 - DNA, 50 bp, homo sapien
gttttccctagatactataattacasagttttgattgtttggttgtttgt

SEQ ID NO: 111782 - DNA, 50 bp, homo sapien
aactgacaacaccgaatgttgacaasgatgctgaacaataggaattccca

SEQ ID NO: 111783 - DNA, 50 bp, homo sapien
gtgaattatcaggattcatgttcttwtaatggagtggaaagggtttgagg

SEQ ID NO: 111784 - DNA, 50 bp, homo sapien
ttacagtcgataataatcaaaggtawctaacacagatgcaacaacaataa

SEQ ID NO: 111785 - DNA, 50 bp, homo sapien
ctaaaaattaaccattattaatattsaatatccagatcaacctagcaatc

SEQ ID NO: 111786 - DNA, 50 bp, homo sapien
caccaccatcacctttcattctccayacagagcaatccaatagaaatctc

SEQ ID NO: 111787 - DNA, 50 bp, homo sapien
ggagactgcccctcacacactagatsagatgaagtctatgttcctggctg

SEQ ID NO: 111788 - DNA, 50 bp, homo sapien
tggctagaatttccagtacaatatcraatagacgtggcaaaagtagacat

SEQ ID NO: 111789 - DNA, 50 bp, homo sapien
ctaatccaactattatctctaattcracactgtattatctctcttgatgt

SEQ ID NO: 111790 - DNA, 50 bp, homo sapien
ggcaaaatgactcaggcttctttaartagtgaattgatctgcatataaat

SEQ ID NO: 111791 - DNA, 50 bp, homo sapien
aatgaaaatgctttttatatattcaytattttgtcactgagatcaagaaa

SEQ ID NO: 111792 - DNA, 50 bp, homo sapien
ctgtgcatgcagaaagattgttgcaycgaagaagaggaactccaaattaa

SEQ ID NO: 111793 - DNA, 50 bp, homo sapien
ttacaaccacagttgcctttgggaamccagcacagaagatgggggatagt

SEQ ID NO: 111794 - DNA, 50 bp, homo sapien
aatttcttcttatatcaaattggcaycacatgtttatagcaacgctattt

SEQ ID NO: 111795 - DNA, 50 bp, homo sapien
aggaatgcagcttgaccttagaatgratttgatccaggaactagaaggtg

SEQ ID NO: 111796 - DNA, 50 bp, homo sapien
taaagtgttatattgaaactcaataygcaaaacaaaagcaatgcccctct

SEQ ID NO: 111797 - DNA, 50 bp, homo sapien
tcatgacaaatttatctttcaactartaaactagggcctcctcagcaaaa

SEQ ID NO: 111798 - DNA, 50 bp, homo sapien
aggaagaaggaaatgaagataatctraagttccatgatgcattatggtat

SEQ ID NO: 111799 - DNA, 50 bp, homo sapien
gaaaatggatatagctctgactaccwaattgaaaaatattatttggagat

SEQ ID NO: 111800 - DNA, 32 bp, homo sapien
taatctttgcaatacckccaaaaatgcattat

SEQ ID NO: 111801 - DNA, 50 bp, homo sapien
ggaggtgctgactgtgtcaccatcartgcagtcgaggtgtgcctggttta

SEQ ID NO: 111802 - DNA, 50 bp, homo sapien
caccatatgggcatcctcaaataaasaagttcatcagttaatttctagaa

SEQ ID NO: 111803 - DNA, 50 bp, homo sapien
gatggcctggttcaatcagccgaaarccttaggagcagaactggggcttc

SEQ ID NO: 111804 - DNA, 50 bp, homo sapien
ttttaatccccttgactgagatgaawtactgaagacaaaaaaggcttcct

SEQ ID NO: 111805 - DNA, 50 bp, homo sapien
ttccctttccttaatgtcaattggcyatggactccaatcacttctaaaaa

SEQ ID NO: 111806 - DNA, 50 bp, homo sapien
cagcacgtcttgctaggaaactacamgtggttaactgttgcttaagctta

SEQ ID NO: 111807 - DNA, 50 bp, homo sapien
gatctattgttttacaaatcaattcracatacacattaaaatatcttact

SEQ ID NO: 111808 - DNA, 50 bp, homo sapien
aatatgtcattatgagagtaaaacaraaacctacagagaggggaatgaat

SEQ ID NO: 111809 - DNA, 50 bp, homo sapien
catttttataatcgcttaacaggtcyatccatttaaaacatattttatgt

SEQ ID NO: 111810 - DNA, 50 bp, homo sapien
tgttccagatggacagtgacctttayggaatttagtgtctagtggcaaaa

SEQ ID NO: 111811 - DNA, 50 bp, homo sapien
ggaaggagaaaaagggaagaatttakactcataggggtcttataagggat

SEQ ID NO: 111812 - DNA, 50 bp, homo sapien
agagaagcgtgaaagagttaatttgrtggcttgagcagggaaaggcaaaa

SEQ ID NO: 111813 - DNA, 50 bp, homo sapien
ccatctagagtcaaattaacatagaycttaactacatagtcagtcagcaa

SEQ ID NO: 111814 - DNA, 50 bp, homo sapien
tagaaagttgataaaagtataacaayttaagtcactgtcaataatgatga

SEQ ID NO: 111815 - DNA, 50 bp, homo sapien
aatcaagtaaaagtcatatgaataayagtagttctcattaatatgttctg

SEQ ID NO: 111816 - DNA, 50 bp, homo sapien
aatgtctaagaagatctttacaagasctgagccatagaatattacagtat

SEQ ID NO: 111817 - DNA, 50 bp, homo sapien
acaaggtgcagcgaatatgtacctayccaatttcaatagaactaaatgca

SEQ ID NO: 111818 - DNA, 50 bp, homo sapien
ccttattaactctgttatgttcatayacaaaatggaggtaagaaaataca

SEQ ID NO: 111819 - DNA, 50 bp, homo sapien
aattttggttcctactggtaatggaytcatcagatgttcaccagcagata

SEQ ID NO: 111820 - DNA, 50 bp, homo sapien
atcaaagtccaaacgtataaaaatarggcagtctctaaaccttatctaat

SEQ ID NO: 111821 - DNA, 50 bp, homo sapien
aatatattaaatgttcaaatataaaktcactgccatccaaagaagaataa

SEQ ID NO: 111822 - DNA, 50 bp, homo sapien
attcttttccacatacccttgtcaartatattaaatgttcaaatataaat

SEQ ID NO: 111823 - DNA, 50 bp, homo sapien
ctgaagctattaaaaggtttctctaygatttctaaaaaccatgcctaaat

SEQ ID NO: 111824 - DNA, 50 bp, homo sapien
tggtgggaagtttaataaacactctsaagctattaaaaggtttctctacg

SEQ ID NO: 111825 - DNA, 50 bp, homo sapien
atttctagagctcactcagtgatacracccttttataagatccatctgtg

SEQ ID NO: 111826 - DNA, 50 bp, homo sapien
catactatacactcttccaaataaarcatacctgccagtattcctaacca

SEQ ID NO: 111827 - DNA, 50 bp, homo sapien
tttcacaggctagtggaggagtccartacattagcaaatacttaccaccc

SEQ ID NO: 111828 - DNA, 50 bp, homo sapien
tctgttcttttatcagactgaaaacractgtcactgatcttgcaattgct

SEQ ID NO: 111829 - DNA, 50 bp, homo sapien
ttttgttctagaaattttcatttcaycagcgtataaaatttcacaagcag

SEQ ID NO: 111830 - DNA, 50 bp, homo sapien
cattatcttttatttttaatagaaayctatggctgcagagtaaattccct

SEQ ID NO: 111831 - DNA, 50 bp, homo sapien
tccagtctttgcttctgagccataayatcctttctcataatgcgtattgg

SEQ ID NO: 111832 - DNA, 50 bp, homo sapien
gggtcttatcagaactgggatataasacattgtgaaaggacaagtggagc

SEQ ID NO: 111833 - DNA, 50 bp, homo sapien
ttcatttttaaaaaactaatgaaaastcagtagcagaatggacaaaatac

SEQ ID NO: 111834 - DNA, 50 bp, homo sapien
ttccgcacctgaataatgatgacaaygcagtacacaaatttgagccaaat

SEQ ID NO: 111835 - DNA, 50 bp, homo sapien
aggtaaaaaatatgtacacagaagargttttattttaattagctttgttt

SEQ ID NO: 111836 - DNA, 50 bp, homo sapien
ctggaagcctctctgaggtgaagttygaaggatcactcgtgccatgaaat

SEQ ID NO: 111837 - DNA, 50 bp, homo sapien
acaatagaatgttgcctaatttgagraagttttacttacaaaggattatt

SEQ ID NO: 111838 - DNA, 50 bp, homo sapien
gtgcaaaggtaatctcaagcagaaaytaaatatattgcaactactggatt

SEQ ID NO: 111839 - DNA, 50 bp, homo sapien
actagtaaataaaatgttgctagaarattattgtattgaccttaattgtt

SEQ ID NO: 111840 - DNA, 50 bp, homo sapien
tcaaggtagagggaacatttgtgaamgtcaaaggcggaatgcaaggatta

SEQ ID NO: 111841 - DNA, 50 bp, homo sapien
gtctccccttaaccattacaactaaytggaacctaagtcctatctgttct

SEQ ID NO: 111842 - DNA, 50 bp, homo sapien
ttccaattgcttcaattgctatttayaggcagatcttatagaaattatat

SEQ ID NO: 111843 - DNA, 50 bp, homo sapien
aacaagctaatgttcttcttggccawaattacagaaacatattaagatga

SEQ ID NO: 111844 - DNA, 50 bp, homo sapien
ccactctgaccatgaataaatctaaycagtgagagtcagcatgttgctta

SEQ ID NO: 111845 - DNA, 50 bp, homo sapien
taagagcacttttcatcaaggtacaycaggataaattaataaatctggga

SEQ ID NO: 111846 - DNA, 50 bp, homo sapien
ctgatataatatgaatgaaaagaccrctgcctaaagtcctacctattttc

SEQ ID NO: 111847 - DNA, 50 bp, homo sapien
atcactgaaaaatgagaaaatcttgrtatgctaaatgagtacaaatcacc

SEQ ID NO: 111848 - DNA, 50 bp, homo sapien
ccaatcactttcattctggttcatayagttgacccaatggcaaggaagaa

SEQ ID NO: 111849 - DNA, 50 bp, homo sapien
gaataattggagatttgagcagtaakaagaactgtgttttagaaagttta

SEQ ID NO: 111850 - DNA, 50 bp, homo sapien
tgcaatggaaaacactggttaaagcmctactggagaagttcactcacgta

SEQ ID NO: 111851 - DNA, 50 bp, homo sapien
aactgacccaaatcttgtgtactgcygcagggaaggtaaaatggtgcagc

SEQ ID NO: 111852 - DNA, 50 bp, homo sapien
cttaacatttatgataaaaattaaayccagatagttgactcaagttcaat

SEQ ID NO: 111853 - DNA, 50 bp, homo sapien
catgttggatgctctacctgtaaaargcataactaggcacacaatggtaa

SEQ ID NO: 111854 - DNA, 50 bp, homo sapien
gtagtcttggaataaatgaggttcastacatgttaagagctcttgttaac

SEQ ID NO: 111855 - DNA, 50 bp, homo sapien
gaatttctgagcctttatttttgtasagaaaattggataatactctcagg

SEQ ID NO: 111856 - DNA, 50 bp, homo sapien
gaataaggcaagcctggtctacaggraaccatctgtcctgactccgggag

SEQ ID NO: 111857 - DNA, 50 bp, homo sapien
atttctagatacaaaagaatgactcrgaggcccaaaagtgtaaaaggagt

SEQ ID NO: 111858 - DNA, 50 bp, homo sapien
agcacctgtgtacattttcaaaatgycctttgcaatgatctctcacactg

SEQ ID NO: 111859 - DNA, 50 bp, homo sapien
tagcgtcctcagttttctggttttasatatcactttctctaagaaatctg

SEQ ID NO: 111860 - DNA, 50 bp, homo sapien
gccataaaaccccaaaatcattgacwcttacacttccacatttctgcctt

SEQ ID NO: 111861 - DNA, 50 bp, homo sapien
aattattagtaataactgtgtgggaratttaagaagcaatatccaaaaac

SEQ ID NO: 111862 - DNA, 50 bp, homo sapien
ctacagaagttgtaaaatagacaatraaaatctgtgagctgcttgagctg

SEQ ID NO: 111863 - DNA, 50 bp, homo sapien
ccaaagccttatttggaataaccaaygttagatctggaatacaggttgtc

SEQ ID NO: 111864 - DNA, 50 bp, homo sapien
gtagattgggcatttttatagtactyactttgggatagagaaaataattt

SEQ ID NO: 111865 - DNA, 50 bp, homo sapien
tagaaggaaactggtattatcaagawcaaacaggtgttggtagcgatcat

SEQ ID NO: 111866 - DNA, 50 bp, homo sapien
gacagaaaccttttccacaacacacwattaggattaagtccactcttttt

SEQ ID NO: 111867 - DNA, 50 bp, homo sapien
taaccctgctcatagacttcctttgractccatttttatggaatgtcaac

SEQ ID NO: 111868 - DNA, 50 bp, homo sapien
atggtcttgtttccagtcttacttgsagtatgttcgagagagattgggtg

SEQ ID NO: 111869 - DNA, 50 bp, homo sapien
catcccattattatgcagaggtatcsaacgaaaggaagcatctgaatttc

SEQ ID NO: 111870 - DNA, 50 bp, homo sapien
ttctctttgtaatcttatcctgtaayggttggtacgatctcaccataggc

SEQ ID NO: 111871 - DNA, 50 bp, homo sapien
gtaaagagggttggatgcaatgtcaratatgctctttaaggaaaagataa

SEQ ID NO: 111872 - DNA, 50 bp, homo sapien
taaggaagtgggccaggaaattataraatgtaatgcccagaagaagtaaa

SEQ ID NO: 111873 - DNA, 50 bp, homo sapien
gtatgagctcaactttttcttttagytcccacacgtgagtaagaatgctt

SEQ ID NO: 111874 - DNA, 50 bp, homo sapien
taaattcttaatggatgtgataacaktcagaaagtaacaaatgttataca

SEQ ID NO: 111875 - DNA, 50 bp, homo sapien
tgcttgcggatggacctacctccaayaagtatgcatgtacttatttgtta

SEQ ID NO: 111876 - DNA, 50 bp, homo sapien
attcatacagaaactgatagatctaygtagttggaagtgcttaattttct

SEQ ID NO: 111877 - DNA, 50 bp, homo sapien
gttaaaagaccttcatcattggacamaaaaatggctaagggcacaactag

SEQ ID NO: 111878 - DNA, 50 bp, homo sapien
tagattcttcactctcaccttacttkcataggcactttatatttcttaga

SEQ ID NO: 111879 - DNA, 50 bp, homo sapien
agtttctgtatgaatattgaagctamcttttcagagagttaagaagagta

SEQ ID NO: 111880 - DNA, 50 bp, homo sapien
tgaggtcttgcatgtgtactcctaasagatgcaggaagttcctcctttag

SEQ ID NO: 111881 - DNA, 50 bp, homo sapien
tggcgggatgactataatctgtgaaragtgtgttcagctatagctataat

SEQ ID NO: 111882 - DNA, 50 bp, homo sapien
cagttccaaactagagtaaactgacyaaggtctgcctggttggaacttgt

SEQ ID NO: 111883 - DNA, 50 bp, homo sapien
cactggtatttatttccaaacttcaygatcgggtagtattacaggaaggc

SEQ ID NO: 111884 - DNA, 50 bp, homo sapien
aagtaatgacttcactgattgacacygattatgataaagaaaatgggaca

SEQ ID NO: 111885 - DNA, 50 bp, homo sapien
tactataaaaatgcccaatctaccartgcagactttgaaacactgatgca

SEQ ID NO: 111886 - DNA, 50 bp, homo sapien
ttcactaatcttatctggatcaacaygtgagattagctacctcgcataga

SEQ ID NO: 111887 - DNA, 50 bp, homo sapien
cagatgtagacactcaatttatgacrgaagggctgctgcagagtaatggg

SEQ ID NO: 111888 - DNA, 50 bp, homo sapien
aattctcccttgcaataacatgactragactgaaagctgattagaggcag

SEQ ID NO: 111889 - DNA, 50 bp, homo sapien
tttcattgaaaatattaacatgcaarcctcataattcccctttttcatat

SEQ ID NO: 111890 - DNA, 50 bp, homo sapien
tctctatttctgggtctccaggatakaacacaatactcagcgtgtagtaa

SEQ ID NO: 111891 - DNA, 50 bp, homo sapien
cctgttttttatggtccaagggctartaatgattgtcatatttttaaaca

SEQ ID NO: 111892 - DNA, 50 bp, homo sapien
tctaaataaacctgttagaattccaraagaacataaagagcatggatgga

SEQ ID NO: 111893 - DNA, 50 bp, homo sapien
gtaagcactaattcaatgtcagaacycattatcggtctattcagggattc

SEQ ID NO: 111894 - DNA, 50 bp, homo sapien
ccaggcatagaagtactctaaatgarcataaggaagaaaacacaactaca

SEQ ID NO: 111895 - DNA, 50 bp, homo sapien
aaagctgcaatactggtaccacacaytgataactttacagcaagtatcct

SEQ ID NO: 111896 - DNA, 50 bp, homo sapien
tttcattccatttgaagaaatccaaygtaggcattaggaacctaaaggac

SEQ ID NO: 111897 - DNA, 50 bp, homo sapien
agctctaggcatttaaccagtctgawatttccgaattagaaatgcaattt

SEQ ID NO: 111898 - DNA, 50 bp, homo sapien
gcagaagctaggagaatattactaaraggaccagagagtagagggatccc

SEQ ID NO: 111899 - DNA, 50 bp, homo sapien
tctagagagcaacagttcatctttcyatactcagcagctaaaacgtctat

SEQ ID NO: 111900 - DNA, 50 bp, homo sapien
gtggatactactgacctcacattgtyctccttggttacatcatcgtgcaa

SEQ ID NO: 111901 - DNA, 50 bp, homo sapien
tcaatactaagtacctaccctgtcaygtaacaccttactgaactgatgaa

SEQ ID NO: 111902 - DNA, 50 bp, homo sapien
agcctcatgaggacctcttggtaaaygactgaaataaggggctaaaactg

SEQ ID NO: 111903 - DNA, 50 bp, homo sapien
tccaaaggtgactaaatttcaatacrattcctgctcattttgttaaaaca

SEQ ID NO: 111904 - DNA, 50 bp, homo sapien
acatgcactcactctcctgcctttawcacagacagtgaacccagatctat

SEQ ID NO: 111905 - DNA, 50 bp, homo sapien
gtctgatttcaggtcagcataaccasctctttggacaacacagcagtttt

SEQ ID NO: 111906 - DNA, 50 bp, homo sapien
tcacttcataatgtcaagcaaataaktaaaagaatgcacaaaatgtttta

SEQ ID NO: 111907 - DNA, 50 bp, homo sapien
acacaaatgtgcattcctagcatcartcttctaacactgaaatgttcact

SEQ ID NO: 111908 - DNA, 50 bp, homo sapien
ggcctaaaagattactatttctaaamttcacttccatatgatttggttgc

SEQ ID NO: 111909 - DNA, 50 bp, homo sapien
cagggaatagcatctacccatacacyaagctcaaagggatacgggtgggg

SEQ ID NO: 111910 - DNA, 50 bp, homo sapien
ttacctggatcatcagctttgtgagsacagggttcacctttgtcttactc

SEQ ID NO: 111911 - DNA, 50 bp, homo sapien
agaacatggagtgaataaaacctgaygaaaaagagtaaacactgcacaat

SEQ ID NO: 111912 - DNA, 50 bp, homo sapien
cgtctcactctggatcttagcggacrccattctttatgtttgtaaccctc

SEQ ID NO: 111913 - DNA, 50 bp, homo sapien
tgcagggaatagtgtttctccacgayactacaattgcctctcaagaaccc

SEQ ID NO: 111914 - DNA, 50 bp, homo sapien
cacgatactacaattgcctctcaagraccctctgttgcatttctacagcc

SEQ ID NO: 111915 - DNA, 50 bp, homo sapien
aatccaggtagtgaaaatgagtgaaygctacatggtcagtgctgagagtc

SEQ ID NO: 111916 - DNA, 50 bp, homo sapien
tgaaaagtttgcaatattctatgaaygtgtaggcactgtttccagacaat

SEQ ID NO: 111917 - DNA, 50 bp, homo sapien
tagttttatattttccttctagtcayctttctatgtgtatttgcacagcc

SEQ ID NO: 111918 - DNA, 50 bp, homo sapien
gtttataaatgcaagtgtgacttaakctttagtggaactcctcccagcag

SEQ ID NO: 111919 - DNA, 50 bp, homo sapien
cattaccactcttcaactgatatgasaaggaagaaacaaagaacacatgt

SEQ ID NO: 111920 - DNA, 50 bp, homo sapien
ggccaatgcctgtaagtaggttagamattaaactagagtaatatttgcag

SEQ ID NO: 111921 - DNA, 50 bp, homo sapien
gaatcattttcctttcagtctaaaastttccatagttaatctcaggcaat

SEQ ID NO: 111922 - DNA, 50 bp, homo sapien
atggtcagagaagtgattctggaagsaagcgaggtctatgctgagacaga

SEQ ID NO: 111923 - DNA, 50 bp, homo sapien
gtgaatgaatgaaaggtaaagagtargataagcacaaaagggaattgaga

SEQ ID NO: 111924 - DNA, 50 bp, homo sapien
ctttcagcacatttcgagttgacgckgaaatgttaaagattctttctagc

SEQ ID NO: 111925 - DNA, 50 bp, homo sapien
catcataacaaactctacagaagatkttggaagcttagaggtagtgtagg

SEQ ID NO: 111926 - DNA, 50 bp, homo sapien
attcaaaaatcacagcactttaaagsagcatgatggaataaggtcaaagt

SEQ ID NO: 111927 - DNA, 50 bp, homo sapien
agtcctggcagagtttctgataaaasgaggagactgctgggaaatagggg

SEQ ID NO: 111928 - DNA, 50 bp, homo sapien
ggtatttccattatgatgatgattayaaatgaccatctggatcagaggct

SEQ ID NO: 111929 - DNA, 50 bp, homo sapien
cataaatgtggtcacaatctaatgcrcaatatctatttacaaaatgaata

SEQ ID NO: 111930 - DNA, 50 bp, homo sapien
ggctaaaggaaagtgataaaaattcwaaagagattctgtgtgaaatggta

SEQ ID NO: 111931 - DNA, 50 bp, homo sapien
tgggatactctttttcctggctgaartgaatggttctctctctgagtccc

SEQ ID NO: 111932 - DNA, 50 bp, homo sapien
atttcattttctaaaacaccaactaytaaaagctgcttatgaaacttttt

SEQ ID NO: 111933 - DNA, 50 bp, homo sapien
atagtccatgttaaacgctttctcayggcattgtatggtaagaagactct

SEQ ID NO: 111934 - DNA, 50 bp, homo sapien
ccattacctacatccctttagatacyggggccatcagagaagatacataa

SEQ ID NO: 111935 - DNA, 50 bp, homo sapien
tgacctctccttctctgtgaaaaccrgggtatccttgctggtgtccagct

SEQ ID NO: 111936 - DNA, 50 bp, homo sapien
ttctgctatggatcaggtgcacttamactgaggccacatccttgtttgct

SEQ ID NO: 111937 - DNA, 50 bp, homo sapien
tattacttaaagctgtaagatactgyaagttatgtactcatacatgtaat

SEQ ID NO: 111938 - DNA, 50 bp, homo sapien
agagaacagtgactgctacattaggrcaaatatttgattaaaaaagaaga

SEQ ID NO: 111939 - DNA, 50 bp, homo sapien
tgccaagcaatttggagaggagcacmgtcactcaaagtgcactgaactta

SEQ ID NO: 111940 - DNA, 50 bp, homo sapien
ttcctaaatgaaatggttacaagacraaaagctaaacggctcccccatat

SEQ ID NO: 111941 - DNA, 50 bp, homo sapien
tagaaatagaccatgctctacgttaygcggagttaatgcaaagcattaaa

SEQ ID NO: 111942 - DNA, 50 bp, homo sapien
aatgcagacaagacagtagaataatmaagaacagaccttcacactgaaaa

SEQ ID NO: 111943 - DNA, 50 bp, homo sapien
tatatatatttgaaacattggattakacaaacatttcttagataggacac

SEQ ID NO: 111944 - DNA, 50 bp, homo sapien
agttcaatggagccattgataagtayacgagttgctaaagactccttaaa

SEQ ID NO: 111945 - DNA, 50 bp, homo sapien
gggcaaataatttgatcttcctcaargtcctaggtcatgaacactttgga

SEQ ID NO: 111946 - DNA, 50 bp, homo sapien
caatatgtgtacaatcacacaaaaaktaaataggctaaaaacatcattaa

SEQ ID NO: 111947 - DNA, 50 bp, homo sapien
agaggcaacaaactggtagctggtaygagaggccatgtatacacacttca

SEQ ID NO: 111948 - DNA, 50 bp, homo sapien
agagaaaaagtgaacattacttacaytcaatacataggttggctctgcac

SEQ ID NO: 111949 - DNA, 50 bp, homo sapien
attcctgaaatttgccattctattgyagtatgttcctgggagaattcttt

SEQ ID NO: 111950 - DNA, 50 bp, homo sapien
ccccatttttactcacaatctgttasgtctccttatcagcttctggcagc

SEQ ID NO: 111951 - DNA, 50 bp, homo sapien
tgctgagacccagaacatagagatayattgtctcagcactgatggtttat

SEQ ID NO: 111952 - DNA, 50 bp, homo sapien
cccacatatctaactctaagtacacmctggaaaattacagcatgatattt

SEQ ID NO: 111953 - DNA, 50 bp, homo sapien
ggagttactgctgggctatactcgcyatttcatgcttggcgttagtctct

SEQ ID NO: 111954 - DNA, 50 bp, homo sapien
taccgggccaattaatttcagtcacrtcccaattaatttaccaggccagt

SEQ ID NO: 111955 - DNA, 50 bp, homo sapien
aactgatagcttaaactgtcaactaygtaaatgattcattttgcttgttt

SEQ ID NO: 111956 - DNA, 50 bp, homo sapien
gtctagcacatttagatgttcaaaayttttcacttagttaataaattatc

SEQ ID NO: 111957 - DNA, 50 bp, homo sapien
cttttctctgtattataaggcatagraaatatgttatataacacactttc

SEQ ID NO: 111958 - DNA, 50 bp, homo sapien
ggcttagattgcactccaaatatcartatatgaatctggtacatttttgt

SEQ ID NO: 111959 - DNA, 50 bp, homo sapien
cctgggtctgccccctcctttctgcrcctctctttagctagtttctgttt

SEQ ID NO: 111960 - DNA, 50 bp, homo sapien
ttccaaacacaaaacttctattaacygtgactctgcccagtgtgcagccc

SEQ ID NO: 111961 - DNA, 50 bp, homo sapien
ggtacttggcaagataatactgatcmagaaagtgctggccatttaagccg

SEQ ID NO: 111962 - DNA, 50 bp, homo sapien
ctaggcagtgactggtatagtttgarctttgtcttttttatttcagactt

SEQ ID NO: 111963 - DNA, 50 bp, homo sapien
aggatgggatgccctttgattagatraggaagccacagagctgaattttg

SEQ ID NO: 111964 - DNA, 50 bp, homo sapien
agcaaaatgataacacatcaatgtawcctgaacaatagaagaaggtaatt

SEQ ID NO: 111965 - DNA, 50 bp, homo sapien
gatgaccctttctcagcctcatttayggtgcttgttaaagctacattttc

SEQ ID NO: 111966 - DNA, 50 bp, homo sapien
tgactgcattttcaggcaaacaatcraggtgctttgaaatcaggactgtc

SEQ ID NO: 111967 - DNA, 50 bp, homo sapien
gcccatgaccgctgttagccgaatgycctcaagagcttcagatttctgta

SEQ ID NO: 111968 - DNA, 50 bp, homo sapien
ttttcagagtttctttgcatccttayatgtttggtttgggctttttatta

SEQ ID NO: 111969 - DNA, 50 bp, homo sapien
ccaacatttgacaattatctttaaawggttggcaaattaaaactagaata

SEQ ID NO: 111970 - DNA, 50 bp, homo sapien
catccccattgaagagatgagtaaaytaagactcagattgtgctttccta

SEQ ID NO: 111971 - DNA, 50 bp, homo sapien
ccaggtcttggtcataagaagcatayaataagtgtttgtttttcaataaa

SEQ ID NO: 111972 - DNA, 50 bp, homo sapien
aaggaacatttgagtttctgactacsgcacagggttcattgtgctcctca

SEQ ID NO: 111973 - DNA, 50 bp, homo sapien
ctctattgatacagtttagctgaggmtcattctgctttattaagattttt

SEQ ID NO: 111974 - DNA, 50 bp, homo sapien
aaaatctagctataatattttagtcyctgcatcacagttagggtacttaa

SEQ ID NO: 111975 - DNA, 50 bp, homo sapien
ccctttaatgtagagactgacaaaayagctcacatagatgggtctataaa

SEQ ID NO: 111976 - DNA, 50 bp, homo sapien
tttctagtacatcttcccttctgacygaatgcccctttaggatatcactt

SEQ ID NO: 111977 - DNA, 50 bp, homo sapien
tataaattgtacattttgtaaaataytatgtttgatttctctacttgtca

SEQ ID NO: 111978 - DNA, 50 bp, homo sapien
tgcagcctaccttgtagcctgacaarccagatacatgtatgtatacacat

SEQ ID NO: 111979 - DNA, 50 bp, homo sapien
taagcgcttgcctgcattacacagcygaaattacctgccgtccagtaact

SEQ ID NO: 111980 - DNA, 50 bp, homo sapien
cagaaaagtaatagtcatctctggaygtcatgttgaagagctgcatgttt

SEQ ID NO: 111981 - DNA, 50 bp, homo sapien
ggtactctgcttaatttttcatacartatctccttgagtttcactataac

SEQ ID NO: 111982 - DNA, 50 bp, homo sapien
ggagccaatagagaatcttcccaatraacctcaatatatggttgtaatac

SEQ ID NO: 111983 - DNA, 50 bp, homo sapien
aaacagaggtattctaatactgccaraaagaactacagagaaatctcaac

SEQ ID NO: 111984 - DNA, 50 bp, homo sapien
aataaggcttgatgttaaccttgccrgaatttgtaatcaggaaacaaaaa

SEQ ID NO: 111985 - DNA, 50 bp, homo sapien
cagaaaagctagggtactcaatgaartcaattaggacttagatttaaatt

SEQ ID NO: 111986 - DNA, 50 bp, homo sapien
tatttgggagggaactgtaattatgmaattgggtaagatggtgggaggct

SEQ ID NO: 111987 - DNA, 50 bp, homo sapien
atagcatattcttagtcttgcaacaytgagaaattgaaatagctaggcaa

SEQ ID NO: 111988 - DNA, 50 bp, homo sapien
tgtgatgaaagtgctgataagaaacygtgaataacctgctaattctacta

SEQ ID NO: 111989 - DNA, 50 bp, homo sapien
cttcacataatatattatcccgacayattcaaagcagagggaaatttata

SEQ ID NO: 111990 - DNA, 50 bp, homo sapien
aattacaggtctgtctttgccatcargtttttaattttgttcaggattaa

SEQ ID NO: 111991 - DNA, 50 bp, homo sapien
aatgcagcagagggcaagaaatgcamgtaatgagctaaataaacatattt

SEQ ID NO: 111992 - DNA, 50 bp, homo sapien
gtacacaccaagatggttaatgcaayacagactgctcaaggttagactaa

SEQ ID NO: 111993 - DNA, 50 bp, homo sapien
atattggattggccatcacaggtaarttcttacaatgttggacacagatt

SEQ ID NO: 111994 - DNA, 50 bp, homo sapien
aacaaattcctgtatgcaattccaasggctcagagcaaaacaaaaatggg

SEQ ID NO: 111995 - DNA, 50 bp, homo sapien
attaggatggtgttgaaattatatcyatcttgtcatctccctggcaggac

SEQ ID NO: 111996 - DNA, 50 bp, homo sapien
tagtttttctccccaaaatattttaygtcctttgcatatgggaagggttt

SEQ ID NO: 111997 - DNA, 50 bp, homo sapien
tctaccaccactttggcatttgatgrtctagtcactctgtaattgggaga

SEQ ID NO: 111998 - DNA, 50 bp, homo sapien
agacttattaccatcagatagactaygcattctcttatttatatgtttat

SEQ ID NO: 111999 - DNA, 50 bp, homo sapien
agtctatcctaatttccttgagcacrgtaaggagagtaaggagtgtctag

SEQ ID NO: 112000 - DNA, 50 bp, homo sapien
tctcaagaaaaagttacagattcaaytgttttacatagccactcaggttt

SEQ ID NO: 112001 - DNA, 50 bp, homo sapien
ttctaggaacaatggaataggagcayggaggccaagttagctcgcatgga

SEQ ID NO: 112002 - DNA, 50 bp, homo sapien
ttacattgagtcagccttttcccaarttatccagccttccagggatgtct

SEQ ID NO: 112003 - DNA, 50 bp, homo sapien
ttctaagatatgacacttacaataaytatgatgttaaacattctgctaaa

SEQ ID NO: 112004 - DNA, 50 bp, homo sapien
ttgtcaggcaatcaaggatacttatyaaatttgtctatcttatttattag

SEQ ID NO: 112005 - DNA, 50 bp, homo sapien
tcagtctccttgactcgagacaatamgcttcgtggaggcttttttttttc

SEQ ID NO: 112006 - DNA, 50 bp, homo sapien
aaatgacttgattagagtaactaccragtgcttttttgacaggctgatgg

SEQ ID NO: 112007 - DNA, 50 bp, homo sapien
aacaaacatgacaatggttagaagaygaaagaaatgaattgtaagtaagg

SEQ ID NO: 112008 - DNA, 50 bp, homo sapien
ctaactataaaataatgagataaacratgtctcttacttgaatagattgg

SEQ ID NO: 112009 - DNA, 50 bp, homo sapien
tcttgtggaaaaatttcagaacagcyctactaaaaatactaattttcatg

SEQ ID NO: 112010 - DNA, 50 bp, homo sapien
tctgtccagctatggttagaagtccmataggttgtagctatgttttcctt

SEQ ID NO: 112011 - DNA, 50 bp, homo sapien
aagatgcacgaggacagagactgtamctcttatttttataatcagatcat

SEQ ID NO: 112012 - DNA, 50 bp, homo sapien
tatgtcttatgtggtttattaagaaygtaagcactttaaaagcaggactc

SEQ ID NO: 112013 - DNA, 50 bp, homo sapien
tctccactacatgtagccctcgatcrctctttaacattaatacaattggc

SEQ ID NO: 112014 - DNA, 50 bp, homo sapien
tccaccacagaccatccattgcagargcagcacttaactgggtggacaag

SEQ ID NO: 112015 - DNA, 50 bp, homo sapien
atgctcagtttgttcctgtccgtaawtatcctaaatataattgttaaaat

SEQ ID NO: 112016 - DNA, 50 bp, homo sapien
aatgcaaatattgaagtaaatacaayggcctcaagtaagaaactttggaa

SEQ ID NO: 112017 - DNA, 50 bp, homo sapien
gtttctcaggtcttttcaatagctawtttttactcactttaagattttct

SEQ ID NO: 112018 - DNA, 50 bp, homo sapien
ccagtttgcagtaggtcatcagaagscttcctgaaatagctgatatttaa

SEQ ID NO: 112019 - DNA, 50 bp, homo sapien
caaatccttctctcaccgggcatccrctttcaagaaatgattgctggggc

SEQ ID NO: 112020 - DNA, 50 bp, homo sapien
atcaccataagggatatagtgaagaygggatgtgttaaaaacatcttggg

SEQ ID NO: 112021 - DNA, 50 bp, homo sapien
taaagatacaaacatctgataaaaaygcctaaaacatggatcttattctt

SEQ ID NO: 112022 - DNA, 50 bp, homo sapien
atgaataagtggttaagtagaactcwctaaggtgtcagtgcttggtttga

SEQ ID NO: 112023 - DNA, 50 bp, homo sapien
ccccttccagagccaatcttgtcaaygaagctttccctgctgaatgatag

SEQ ID NO: 112024 - DNA, 50 bp, homo sapien
aatacagaggcattaggagatcttcsaatatccaggcattgttaatgaca

SEQ ID NO: 112025 - DNA, 50 bp, homo sapien
tcaatattattgccactattaccccrgactatgtcattcataaacaataa

SEQ ID NO: 112026 - DNA, 50 bp, homo sapien
ttttaatatgttaccataagggaaaytgttgagatgctaactgatcgttc

SEQ ID NO: 112027 - DNA, 50 bp, homo sapien
tagagttatatattcttatctttcamtagcacattatcaaaggtgggatt

SEQ ID NO: 112028 - DNA, 50 bp, homo sapien
atgcaaagaccttcaacatgacacargagaacatattttaaaaagagatc

SEQ ID NO: 112029 - DNA, 32 bp, homo sapien
tttgtgttgtaaattaygcaacatgtcttaga

SEQ ID NO: 112030 - DNA, 50 bp, homo sapien
tttccttccaaaacataaaactatcycgtcactctactgtcacacaactg

SEQ ID NO: 112031 - DNA, 50 bp, homo sapien
acaaggcctgttatggccatgttacmatgctctgggacttattttccaca

SEQ ID NO: 112032 - DNA, 50 bp, homo sapien
aaataggcagacaattaaatttggarctaaggtgagatatatggaggcaa

SEQ ID NO: 112033 - DNA, 50 bp, homo sapien
caagtgttccaagcatgaatagactsagatagaacaaggagaaattggca

SEQ ID NO: 112034 - DNA, 50 bp, homo sapien
accacgcaaattttgtggccccaackagagattctcactacatagctgga

SEQ ID NO: 112035 - DNA, 50 bp, homo sapien
tttccagccaacagaaaaataaagaygatcttgttgatgactaaatagtc

SEQ ID NO: 112036 - DNA, 50 bp, homo sapien
cctgagaaatagcagatggaccttasaggatagagcaagcaacatggata

SEQ ID NO: 112037 - DNA, 50 bp, homo sapien
cacatacacaacaacaacaattcaartaggttcattccacattttcttgg

SEQ ID NO: 112038 - DNA, 50 bp, homo sapien
taattcagacatcaaatgtagctgcrccaagttttcaaacctatctttga

SEQ ID NO: 112039 - DNA, 50 bp, homo sapien
cttcttatctctaaaatgtggataayagggtattgtgatgaataaatgag

SEQ ID NO: 112040 - DNA, 50 bp, homo sapien
cacttctgtattcttcttcctgaaaygctctacctccgctcatttaggtt

SEQ ID NO: 112041 - DNA, 50 bp, homo sapien
cagcattgtttaacccaggaacttgsaatttattcttaatccctttctcc

SEQ ID NO: 112042 - DNA, 50 bp, homo sapien
accaaagaaccagtcacccaagggasataaactgaggaccagatttgaga

SEQ ID NO: 112043 - DNA, 50 bp, homo sapien
cctggccctcgtagtaaaaagatgaycagagtcaaaatctgaaaccaatt

SEQ ID NO: 112044 - DNA, 50 bp, homo sapien
gaattgaaatcaaaaagcgaaaataygtccagcaaaaatatttcattgaa

SEQ ID NO: 112045 - DNA, 50 bp, homo sapien
tctaagagctcctctgtattccgaaytagtcacaagctctcaggaaaatg

SEQ ID NO: 112046 - DNA, 50 bp, homo sapien
tggagactctcatttctgacctggawctcaaataataaatgatgatttat

SEQ ID NO: 112047 - DNA, 50 bp, homo sapien
tcttgattgtatagtctttattagaygaacacaccagaactcatttggcc

SEQ ID NO: 112048 - DNA, 50 bp, homo sapien
ttttctctgataaggagaccacacaytataaagcaatcacccatgacact

SEQ ID NO: 112049 - DNA, 50 bp, homo sapien
atcagggtaattgcgatatctatcasctctaacactgaccttttctttat

SEQ ID NO: 112050 - DNA, 50 bp, homo sapien
gaaacaaaagatggagaaggatgtayggccgagagagggattgagattaa

SEQ ID NO: 112051 - DNA, 50 bp, homo sapien
atcacttcaaacaaagataacaaaartccattctttccatatttgtatga

SEQ ID NO: 112052 - DNA, 50 bp, homo sapien
ctttaaattatttggagttgaaagaygtatgtggaaaaccctctattgca

SEQ ID NO: 112053 - DNA, 50 bp, homo sapien
taagcaagattggaagtcaggataakcttgttccctttaatcatctcttt

SEQ ID NO: 112054 - DNA, 50 bp, homo sapien
atgaatggcttaattaatctttttayataggacgtggccatggcttagat

SEQ ID NO: 112055 - DNA, 50 bp, homo sapien
atgggcttccattttgcttggattayacctgacagaaccgaatccaaacc

SEQ ID NO: 112056 - DNA, 50 bp, homo sapien
taggattctggttgactttgaagagyaatcgctttcggggcttaagtacc

SEQ ID NO: 112057 - DNA, 50 bp, homo sapien
catggagctattcttccagtctgacratgactctttctaaatttggtaac

SEQ ID NO: 112058 - DNA, 50 bp, homo sapien
gaattctttgattttcttcctgttamaatgtgttttagaacaacttcacc

SEQ ID NO: 112059 - DNA, 50 bp, homo sapien
ttatttacaaaaagaggtggcagatktgaagtggcccttggtttgtagtt

SEQ ID NO: 112060 - DNA, 50 bp, homo sapien
aataaaatatcaaaatgtgtaaggargaaagatttgcagtaattcatcaa

SEQ ID NO: 112061 - DNA, 50 bp, homo sapien
ctcggttatgctccatgcacacgacrcaagttcctgctgcagttcttccc

SEQ ID NO: 112062 - DNA, 50 bp, homo sapien
tgtgtcgtgtgcatggagcataaccsaggcatgatttgtcttccatacca

SEQ ID NO: 112063 - DNA, 50 bp, homo sapien
aaggatcacggataagtatttttcayggtggctctaattataatgctgag

SEQ ID NO: 112064 - DNA, 50 bp, homo sapien
accagaatgtagagatagatggaaargaccttaattatatttcactagtt

SEQ ID NO: 112065 - DNA, 50 bp, homo sapien
gcagatacaaggcatttgaattgtaytaagtcaagggatcattttttaaa

SEQ ID NO: 112066 - DNA, 50 bp, homo sapien
tgtctgatttgaaaagtagtctctayaaacacagggtaggcttcaattta

SEQ ID NO: 112067 - DNA, 50 bp, homo sapien
gatcttggattagactcacctggaayatatgtctattataggtcatctgt

SEQ ID NO: 112068 - DNA, 50 bp, homo sapien
atgatctcctttgcctcatgtctcamaatcaggtcatgctgatgcaagag

SEQ ID NO: 112069 - DNA, 50 bp, homo sapien
catgcacagtgtttagaaatttcatyaattgcagttatgcagagctgtgg

SEQ ID NO: 112070 - DNA, 50 bp, homo sapien
ttttcacaataatttcactgtaggcrataccttcctgtctttccagaaat

SEQ ID NO: 112071 - DNA, 50 bp, homo sapien
atatagagtgggtgatggtccttaaytaggagaaaataacccagagattc

SEQ ID NO: 112072 - DNA, 50 bp, homo sapien
aaattacaaatcattttcaccaatcyacaaaatcgataaaaaatatacaa

SEQ ID NO: 112073 - DNA, 50 bp, homo sapien
ggaagtgagaaggacatttcaggcaragaaagtaggttaacctagggata

SEQ ID NO: 112074 - DNA, 50 bp, homo sapien
aaagatggacatgcatagagaacaaycattatggagacatagaaggcctc

SEQ ID NO: 112075 - DNA, 50 bp, homo sapien
cccattcttgggaaaataataattayaggtacaacaaggtatttaaagac

SEQ ID NO: 112076 - DNA, 50 bp, homo sapien
ctgacagcaggggcaagggaactgaygagtcttgggtgcaaatcttgaga

SEQ ID NO: 112077 - DNA, 50 bp, homo sapien
catatgtgccttggaagagttttatrcaggaaaggatttgtaaatcagaa

SEQ ID NO: 112078 - DNA, 50 bp, homo sapien
gggctagagtgctgtaaggagtagarttaacagaagacagagggaattgg

SEQ ID NO: 112079 - DNA, 50 bp, homo sapien
agttctcaaaacgtagtgtgcattaycttattccaagaagcttgtaacaa

SEQ ID NO: 112080 - DNA, 50 bp, homo sapien
cccattgcagatttagtaaattgaartatccaagaattagggcctaagaa

SEQ ID NO: 112081 - DNA, 50 bp, homo sapien
ctagcaaggaccatggtaattgccasgtaaatcccctccattatgtggcc

SEQ ID NO: 112082 - DNA, 50 bp, homo sapien
ccgagtgcttacaaagtgccaggaascatattatctctaatataagacac

SEQ ID NO: 112083 - DNA, 50 bp, homo sapien
atgtagatagttggataattagaaaygagaataaagaacagcttaatgaa

SEQ ID NO: 112084 - DNA, 50 bp, homo sapien
agtgcctcctctggtcattggtgagyagaagtaacagtgtcatttctgga

SEQ ID NO: 112085 - DNA, 50 bp, homo sapien
gacacggggctgagattggatcatayctaacatcttctagctttgcgttg

SEQ ID NO: 112086 - DNA, 50 bp, homo sapien
tgaacaccctccccagagataacaaygctaatgtccatgaaatctctcgg

SEQ ID NO: 112087 - DNA, 50 bp, homo sapien
ttttagttggttcattaaccaaaagrgttgttgtttgccagtctttggat

SEQ ID NO: 112088 - DNA, 50 bp, homo sapien
gtggcagcttctttcttcagatataraacttcagaacttctttcttgaca

SEQ ID NO: 112089 - DNA, 50 bp, homo sapien
taccattggactttggagaaattacytaatcagcctgcacatcagttgca

SEQ ID NO: 112090 - DNA, 50 bp, homo sapien
cagaactccctaaaattgctcatggyccatagatggaagctttttgttta

SEQ ID NO: 112091 - DNA, 50 bp, homo sapien
ataaaaagggagcagcagcagagccmgtagaaaagaacacaaagagcatg

SEQ ID NO: 112092 - DNA, 50 bp, homo sapien
tccagcatcatgtgattaaggccaawctcaacttcacaaaagagagcctc

SEQ ID NO: 112093 - DNA, 50 bp, homo sapien
ctgggcagcggaaagcaggacaatgragttgcaagacagagcaaagagga

SEQ ID NO: 112094 - DNA, 50 bp, homo sapien
ccaattctatgtgaaaatacaacagraacttatggcagagaattactgtg

SEQ ID NO: 112095 - DNA, 50 bp, homo sapien
ctgtctatattcatttggtacaagcrgcagattggttcttggatttgaaa

SEQ ID NO: 112096 - DNA, 50 bp, homo sapien
cagaaattgtcacttgtgagtattcyggagacatggcctcttcctgcccc

SEQ ID NO: 112097 - DNA, 50 bp, homo sapien
gtcccctgtaccagctgagcaatgcragtgggccactgtcctgctaccat

SEQ ID NO: 112098 - DNA, 50 bp, homo sapien
actaagaatattttcaaaaattgaaygattacatggaacttaacaaattc

SEQ ID NO: 112099 - DNA, 50 bp, homo sapien
agtctgagagtcagtcaaaagatggsaactcagcattgaatatgtaactt

SEQ ID NO: 112100 - DNA, 50 bp, homo sapien
ggatacagaagctgtagaaccatagrccaatagagtttaaaacttgaaag

SEQ ID NO: 112101 - DNA, 50 bp, homo sapien
ttgaccgtttaaaatatgtcaggcastaatgctcagtattgacaaggatt

SEQ ID NO: 112102 - DNA, 50 bp, homo sapien
gtacctgggggttcaccacttgcaamgttctccattccagccattctaag

SEQ ID NO: 112103 - DNA, 50 bp, homo sapien
gaacccccaggtacaaaattacaaargaatctacagtccatgctaaattg

SEQ ID NO: 112104 - DNA, 50 bp, homo sapien
taagatttttcagtcctaataaatayaaaactgcactgatttattcaata

SEQ ID NO: 112105 - DNA, 50 bp, homo sapien
ttgtgctgctcagcccaggagtcacratgcctggaaatcaatcaacttct

SEQ ID NO: 112106 - DNA, 50 bp, homo sapien
aggctctaaatgactataataaaccrgctctttgcttatacaaccatgta

SEQ ID NO: 112107 - DNA, 50 bp, homo sapien
caaaattcttgggaggaaacagaccrggtacaattgtcgtggtatccaag

SEQ ID NO: 112108 - DNA, 50 bp, homo sapien
gaagcattttagcatatattatttaygcggatggttgtaataagtactcc

SEQ ID NO: 112109 - DNA, 50 bp, homo sapien
aaacagctgttgccttcttctccacratggaatcaaaggatcttatcacc

SEQ ID NO: 112110 - DNA, 50 bp, homo sapien
agttccagtcttcatgaatatcagcmatcaaaggttaatattatgagatt

SEQ ID NO: 112111 - DNA, 50 bp, homo sapien
cagccaggccagcctcatctccacaratatccatccctcaagaaggttcc

SEQ ID NO: 112112 - DNA, 50 bp, homo sapien
gacatgacttaattttacagtaacarcatcacttcccatctgatttgagt

SEQ ID NO: 112113 - DNA, 50 bp, homo sapien
tggtgctgggataattgacaagacaygtgtagaagaatgaagctgaatcc

SEQ ID NO: 112114 - DNA, 50 bp, homo sapien
acatccataccatacaatgggaatgmaccagtacagactccatcgatgct

SEQ ID NO: 112115 - DNA, 50 bp, homo sapien
taggtttatctagaatatgcactaargggagaaattgttgtatattaaga

SEQ ID NO: 112116 - DNA, 50 bp, homo sapien
ttaggactgttgagaggattaaacargtttctataggtgaaagtgcctat

SEQ ID NO: 112117 - DNA, 50 bp, homo sapien
cctgcttagctttgctgaattcccayctcttctcacaagtaaaatggtaa

SEQ ID NO: 112118 - DNA, 50 bp, homo sapien
aagaaatgaaagaactgaattccagsctctttgtaattgaccaggaaaat

SEQ ID NO: 112119 - DNA, 50 bp, homo sapien
ccttctcaggtgttaattgtatgaawcacttacgctggcactcaatcatt

SEQ ID NO: 112120 - DNA, 50 bp, homo sapien
tattctgggaatgattctggaaaaamcattaggcatggactcgaagtctg

SEQ ID NO: 112121 - DNA, 50 bp, homo sapien
aatattatcttttaacatggtggtcragagtaaagtagcttacatatatg

SEQ ID NO: 112122 - DNA, 50 bp, homo sapien
aaattgtcatggtggaatatttcaamaacaagactggaagtaataagcag

SEQ ID NO: 112123 - DNA, 50 bp, homo sapien
atctgactctgtctagtaggtttcamaattatatataacatgataactca

SEQ ID NO: 112124 - DNA, 50 bp, homo sapien
tccttgaggaaattaagctagtataycattttttctctttctttctttct

SEQ ID NO: 112125 - DNA, 50 bp, homo sapien
tttaaatacattttgcctaacttcartcttttctctcttcagttcatctt

SEQ ID NO: 112126 - DNA, 50 bp, homo sapien
aaagagatgaattggcttacacaackactatcgacagcaaaggttacacg

SEQ ID NO: 112127 - DNA, 50 bp, homo sapien
aaagacatttatgaaaatgacaaacrctatttcagaggaggaaggcagtt

SEQ ID NO: 112128 - DNA, 50 bp, homo sapien
ctcacttattgccagggggatgatcygagtcattaatgaggaatccaccc

SEQ ID NO: 112129 - DNA, 50 bp, homo sapien
acagaaaccagaacattctgtagcargtgatcactaaatatttgttaaac

SEQ ID NO: 112130 - DNA, 50 bp, homo sapien
agaacatttccagtgaagagtgttcyaagccttcctatagtcctgactgt

SEQ ID NO: 112131 - DNA, 50 bp, homo sapien
ctgttgtggccgacactggaaaatamaatcaaccacagtgaagtggtgga

SEQ ID NO: 112132 - DNA, 50 bp, homo sapien
aataaaatatgttctggcaggaggayggtcgcaatacaagttcatgtaga

SEQ ID NO: 112133 - DNA, 50 bp, homo sapien
agcaagcagacaggatggtaatgttragacacaaattaacaaatgctgaa

SEQ ID NO: 112134 - DNA, 50 bp, homo sapien
tggcgtcacagaggctatttgctaartggtacgaagtattctagagaaca

SEQ ID NO: 112135 - DNA, 50 bp, homo sapien
ctaggcactttctcaaaaataccacwctctttctcactccaatatatggg

SEQ ID NO: 112136 - DNA, 50 bp, homo sapien
ctattgtctgaattgatatagtagaraaaatttgtatgcttgacaatgta

SEQ ID NO: 112137 - DNA, 50 bp, homo sapien
atttcctatcactgctatgacactaygaacttagtggtttcaaacaacac

SEQ ID NO: 112138 - DNA, 50 bp, homo sapien
acacaggtcacagattggggaaggaygactgtctttgaaagaagcaatgg

SEQ ID NO: 112139 - DNA, 50 bp, homo sapien
tggacatttctggtttgtctctacamcagtcgctttctgtgtgcaactgg

SEQ ID NO: 112140 - DNA, 50 bp, homo sapien
aacctctctgagggtttcacagatgrgaaaaattagatgaatagaaatga

SEQ ID NO: 112141 - DNA, 50 bp, homo sapien
aaggatcaggagaagctttccagagyaggtaatgtcagacctgggtctta

SEQ ID NO: 112142 - DNA, 50 bp, homo sapien
caggcctcctaggtcctcagtgataygactacagctgtctgtgtccctag

SEQ ID NO: 112143 - DNA, 50 bp, homo sapien
gatccaggggctcaactgatgctttstgtacgtgcttccttccctccttg

SEQ ID NO: 112144 - DNA, 50 bp, homo sapien
tgtgcacagactttcaagagtttccrattgcctcgttcaggcctcctagg

SEQ ID NO: 112145 - DNA, 50 bp, homo sapien
ttcagtccgttgcttatagcatcaaygtcataacgaggctgattctgctt

SEQ ID NO: 112146 - DNA, 50 bp, homo sapien
gaatggttgaaatggtagtattccaytcagaaaagcctaatctaatcctg

SEQ ID NO: 112147 - DNA, 50 bp, homo sapien
tttttctatagatcagaatgagagaygataggatcctgatttaggccact

SEQ ID NO: 112148 - DNA, 50 bp, homo sapien
caggatggagcaggcacatgcattargctcatttgaccatggggactctc

SEQ ID NO: 112149 - DNA, 50 bp, homo sapien
gctttgcaagacaaatagaactgaaycaggctgtaaagacagggaaacat

SEQ ID NO: 112150 - DNA, 50 bp, homo sapien
gcctcgtttcaaactaagatgcaaayggctgcagttttgttctaggatgc

SEQ ID NO: 112151 - DNA, 50 bp, homo sapien
ctaaacataaggctttttagactcaytaaaggaaatagcaaaattcttaa

SEQ ID NO: 112152 - DNA, 50 bp, homo sapien
tatttttaaatgatgcttaaacccawtagaagcctgaagtcaatcctact

SEQ ID NO: 112153 - DNA, 50 bp, homo sapien
gctactctatcagtgcacagtactayctctttgtgtttaaatttgtacat

SEQ ID NO: 112154 - DNA, 50 bp, homo sapien
acacatctattgatgctgatcataawatctcttgttaagcattcctatat

SEQ ID NO: 112155 - DNA, 50 bp, homo sapien
cgctgacactaaataatgcattgacrgaaatacaaaatacattagaaagc

SEQ ID NO: 112156 - DNA, 50 bp, homo sapien
cagcattatgccaagcactggtaaayaaagttgaataaaatgccaccacc

SEQ ID NO: 112157 - DNA, 50 bp, homo sapien
agtgacagaaaaaaaggcacagtaaytcacaattgagacacacgtaatgt

SEQ ID NO: 112158 - DNA, 50 bp, homo sapien
cccaccctcatgctctgtgttgctcrgaaattccaagaagtttcctgttg

SEQ ID NO: 112159 - DNA, 50 bp, homo sapien
caaatattggctaaatgaatgatagratgaatccataagtaaacagacta

SEQ ID NO: 112160 - DNA, 50 bp, homo sapien
taaaatgaagggagttccagaagaarttacttgaaagttagctaaagcaa

SEQ ID NO: 112161 - DNA, 50 bp, homo sapien
gagactctactatctgtccctatgcratgagaaagcaggaagaattataa

SEQ ID NO: 112162 - DNA, 50 bp, homo sapien
acttgtagcacataatatattgttasggggtgagtaaatgatcattaatt

SEQ ID NO: 112163 - DNA, 50 bp, homo sapien
cttttataaaacacagggttcatctrttcagtacttcagatattttcacc

SEQ ID NO: 112164 - DNA, 50 bp, homo sapien
agctgaaatgctactgcctttttgawatccttcttggtactcctgcagat

SEQ ID NO: 112165 - DNA, 50 bp, homo sapien
ggtgggaaaacagtggttgcctggawcaacggcaaacgctccggccagtg

SEQ ID NO: 112166 - DNA, 50 bp, homo sapien
aaatcaattactgtaattacaaggamaatgatggggttatgcagagaagt

SEQ ID NO: 112167 - DNA, 50 bp, homo sapien
cagtagttccaggcaattctttgagkatcaatctggttgaatcagcagag

SEQ ID NO: 112168 - DNA, 50 bp, homo sapien
gaactccctatagtagcttagcaagratggagcgcaatccctgttggtac

SEQ ID NO: 112169 - DNA, 50 bp, homo sapien
cgtatatttttattaaagtgcccacwcaagtatttttatttggttgcttt

SEQ ID NO: 112170 - DNA, 50 bp, homo sapien
tttaaagaacaaaaggaggatcgcartcttgatggatatccactgcatca

SEQ ID NO: 112171 - DNA, 50 bp, homo sapien
tgtccatctaaacctctttgtaaaasccttgagctagctcatctaatcct

SEQ ID NO: 112172 - DNA, 50 bp, homo sapien
attccttactcaaccacttcgaacamcattgcagcacctattccctgcag

SEQ ID NO: 112173 - DNA, 50 bp, homo sapien
tggcttccttgtccttgcatagggargaacacaggcagacgtggtaggag

SEQ ID NO: 112174 - DNA, 50 bp, homo sapien
ctttcctgtgtttgccagcctaaacmagaaatagtttctatgaggttttc

SEQ ID NO: 112175 - DNA, 50 bp, homo sapien
tctaccgtgtgcctatcacactgaaygtagagtgcttggtaaataattgc

SEQ ID NO: 112176 - DNA, 50 bp, homo sapien
ttagaaaaataactataatcatggcrgatgaaataaaaagagatttttga

SEQ ID NO: 112177 - DNA, 50 bp, homo sapien
ggaagcaattcaccaatataatagamtctaccgtgtgcctatcacactga

SEQ ID NO: 112178 - DNA, 50 bp, homo sapien
gtggattttatcaacatcaattcacygactgtaatattgtggtatcattt

SEQ ID NO: 112179 - DNA, 50 bp, homo sapien
ctatcagctagcctaggagatattaragctgcagagatttggctatcttg

SEQ ID NO: 112180 - DNA, 50 bp, homo sapien
gttactatcattaacatttcagaagrtctcgtttaaacttccagttaaaa

SEQ ID NO: 112181 - DNA, 50 bp, homo sapien
gtaagcactttataaatgtcagttaytatcattaacatttcagaaggtct

SEQ ID NO: 112182 - DNA, 50 bp, homo sapien
tcaaaggttggttcataagactaaayggcttctcacagggtcaactaaag

SEQ ID NO: 112183 - DNA, 50 bp, homo sapien
cacataggctcatggcttggcacacyaagtaagggctgcttttcaccccc

SEQ ID NO: 112184 - DNA, 50 bp, homo sapien
gtcaagctaatccagatatattacargttttcttttaaacagaatgcttt

SEQ ID NO: 112185 - DNA, 50 bp, homo sapien
tggaataagaatatggattacacaamgtttatactcaataaatacttgag

SEQ ID NO: 112186 - DNA, 50 bp, homo sapien
gttgggaatacaggcatgtgataccrcacgggactcattattttttaata

SEQ ID NO: 112187 - DNA, 50 bp, homo sapien
cttcagccagcatttctttcatgctyacaatgttagaaaaactttgctac

SEQ ID NO: 112188 - DNA, 50 bp, homo sapien
cctcacttcaatccagtatctgtcartccagttttcaaggaggaagcttt

SEQ ID NO: 112189 - DNA, 50 bp, homo sapien
tctattcttttcttgcatggctctayagcgtatttgcaccaaataaacaa

SEQ ID NO: 112190 - DNA, 50 bp, homo sapien
gaatcaagagaatgtctaaagaatckatctgatttccacaggaaggagac

SEQ ID NO: 112191 - DNA, 50 bp, homo sapien
ttcattctggatccctctgtttcaawccttcaggtgaccatggcttcctg

SEQ ID NO: 112192 - DNA, 50 bp, homo sapien
caacttttatccaggaatttcagtgrcacccactggcccatgagatctca

SEQ ID NO: 112193 - DNA, 50 bp, homo sapien
gatagacaggacaaaaaaatttggamgtatggatgtcttgtagtgacaaa

SEQ ID NO: 112194 - DNA, 50 bp, homo sapien
gatgtgaaagggaatattcaatgctracaaatattattaagttactgttt

SEQ ID NO: 112195 - DNA, 50 bp, homo sapien
tcctggcattattctcagccaggctrcaacaaggagtcttacttgatcag

SEQ ID NO: 112196 - DNA, 50 bp, homo sapien
cttctgtgtttctgttgatgggtccrctgtccttttagtcattcacggtt

SEQ ID NO: 112197 - DNA, 50 bp, homo sapien
atctaatccatcagcatactcttttygttcagccttcaaagtatattttt

SEQ ID NO: 112198 - DNA, 50 bp, homo sapien
gatttggtggcacatctgtgaagtartaagtgataaaatattattcctca

SEQ ID NO: 112199 - DNA, 50 bp, homo sapien
caaatttgaaatttactttcttgaaygttaacaatagaggaagaatcctc

SEQ ID NO: 112200 - DNA, 50 bp, homo sapien
taataaatgaaggttggttatcagasgcttagaaaataataaggtaacta

SEQ ID NO: 112201 - DNA, 50 bp, homo sapien
aagggtattctaaatatcaaaggtamctaagagtcttaaaactggaaggg

SEQ ID NO: 112202 - DNA, 50 bp, homo sapien
gagaatcaaggataatcccaatatcsttaatttcaacacatacgcaaatt

SEQ ID NO: 112203 - DNA, 50 bp, homo sapien
tgacctcctgcctccatcttttaagratgcttgtaattatgttggaccca

SEQ ID NO: 112204 - DNA, 50 bp, homo sapien
ttcaaaagcaaccataaactccactmtccttcagaccttctccctacagt

SEQ ID NO: 112205 - DNA, 50 bp, homo sapien
gtcctgatgatgtcattcttctaatragtgagtttacttggcttactttt

SEQ ID NO: 112206 - DNA, 50 bp, homo sapien
gtactcaaatcccaaggccagctaaytgtactgagaactacagtgctgtg

SEQ ID NO: 112207 - DNA, 50 bp, homo sapien
gccagtaccatactgttttggttaaygtactcttatattctagtttgaat

SEQ ID NO: 112208 - DNA, 50 bp, homo sapien
caacatttttctaactctgaggtttragcactctgcttttagctgtattc

SEQ ID NO: 112209 - DNA, 50 bp, homo sapien
agtgatggatcagggctgaagcagtscgcaaggttaactccaaagggtgt

SEQ ID NO: 112210 - DNA, 50 bp, homo sapien
caaaattgtcttctgaaatagacatraatttattcacatgtgacaaaagt

SEQ ID NO: 112211 - DNA, 50 bp, homo sapien
ctcaacattttgagctagagaaacarattaggtgttgttagaactagtcg

SEQ ID NO: 112212 - DNA, 50 bp, homo sapien
ttgttagaactagtcgttactgatakgatacccagagggaagattcctaa

SEQ ID NO: 112213 - DNA, 50 bp, homo sapien
gctaacccatggtctcataacatacmgacttcttttttacacaaatcttt

SEQ ID NO: 112214 - DNA, 50 bp, homo sapien
tcatttggatggatggataatgaaaytaatagacaattgctaaaaacaaa

SEQ ID NO: 112215 - DNA, 50 bp, homo sapien
actggtgtccctcttgaataatgacsctacaacttcgtgatcattcatct

SEQ ID NO: 112216 - DNA, 50 bp, homo sapien
atatttgttcatatttctgctttcaygtgaagttagacaagtgcacatgt

SEQ ID NO: 112217 - DNA, 50 bp, homo sapien
tactgcaattggctcagcaactgaaygaagagacttgataagttctcacc

SEQ ID NO: 112218 - DNA, 50 bp, homo sapien
cattatcatttgaaaatgtggacaaygccggaagtagttttgattacatt

SEQ ID NO: 112219 - DNA, 50 bp, homo sapien
agagcacagaagagaaaggaaacacratctgcaaaagaacaataaaaaac

SEQ ID NO: 112220 - DNA, 50 bp, homo sapien
aaaagtaatctaaaggtgaaggtaayagtaatagcagcatacagtataaa

SEQ ID NO: 112221 - DNA, 50 bp, homo sapien
catttcagtggtattcctaagagtcyattgttgctggagcttagagaggt

SEQ ID NO: 112222 - DNA, 50 bp, homo sapien
atcaaaattcccatgaaaacctgaaytgggctctgaccgggagatgctgg

SEQ ID NO: 112223 - DNA, 50 bp, homo sapien
aagaaaaaatatcttccagagttgawaagcagaagtgttaaggattgggt

SEQ ID NO: 112224 - DNA, 50 bp, homo sapien
agcccttgttctctttgagctagatkacctgacttttcatattcatgttc

SEQ ID NO: 112225 - DNA, 50 bp, homo sapien
agtacacatgaaaaggtgattatctraaaatgctcagtattgcaacttca

SEQ ID NO: 112226 - DNA, 50 bp, homo sapien
ctagggtcgctataactgagaaccayaaactgagtggctcaaataacaaa

SEQ ID NO: 112227 - DNA, 50 bp, homo sapien
aaaagtattctaggcagggaatagcrgctatgtgaagaccagaaattaag

SEQ ID NO: 112228 - DNA, 50 bp, homo sapien
gggggacccaggcctctctttaccayagtactgcatctccaaccactcac

SEQ ID NO: 112229 - DNA, 50 bp, homo sapien
acagaaagaaagcaccacatttaatyagagaagcaggactgaaaaaccac

SEQ ID NO: 112230 - DNA, 50 bp, homo sapien
ctcagcaaatgggggagccctactcraaatcttgcttaaaatcatcatct

SEQ ID NO: 112231 - DNA, 50 bp, homo sapien
cagatggtaaacaatcttaccagaakttatgtaccaaatcaatcttttga

SEQ ID NO: 112232 - DNA, 50 bp, homo sapien
acagaaattacctagttccatcaatragttaaggaaaataaggtagattg

SEQ ID NO: 112233 - DNA, 50 bp, homo sapien
tttgacatgtcaactcatattagaarccattgtagcattattatcaaatt

SEQ ID NO: 112234 - DNA, 50 bp, homo sapien
attgtatggcactaggtaccaagtaygcaataggaaacaagtattgctct

SEQ ID NO: 112235 - DNA, 50 bp, homo sapien
agacaggtaaaagggtcaactatcaragaacaggatgtggctgggttctg

SEQ ID NO: 112236 - DNA, 50 bp, homo sapien
tgttttccgtatctacagctgtgacyaatgaactgagaggaaatttttaa

SEQ ID NO: 112237 - DNA, 50 bp, homo sapien
tatttaagtactttaaacatgtatgmagtaaaatgtatgataatgggtca

SEQ ID NO: 112238 - DNA, 50 bp, homo sapien
tttccatgtttattctgattcaacartatagctagcacctgcctacctta

SEQ ID NO: 112239 - DNA, 50 bp, homo sapien
gggtagctgctgccagagaaattacrcgagctcttaaacttttccaattg

SEQ ID NO: 112240 - DNA, 50 bp, homo sapien
acttttgtttccacatctgtacatgycatgggaaaatttaaaaagatata

SEQ ID NO: 112241 - DNA, 50 bp, homo sapien
tacaaccacttatttgagattaagtmactgatatgattcccctcatccct

SEQ ID NO: 112242 - DNA, 50 bp, homo sapien
acctacagctgcaaaatcagtgagaygggaaagatgttttgcaattttca

SEQ ID NO: 112243 - DNA, 50 bp, homo sapien
accaaggaggcaaagaagtgggaacyatggccgggtgtgatggctcatgc

SEQ ID NO: 112244 - DNA, 50 bp, homo sapien
ttccaagactacagaaacctccttayaacattgacggattgttgttggat

SEQ ID NO: 112245 - DNA, 50 bp, homo sapien
cacatctgatttcaaatctctgaacygctatcttttactttatatttctt

SEQ ID NO: 112246 - DNA, 50 bp, homo sapien
ccctgttagaatgtgaacaaaataayagggatctgcagagaaaaacctta

SEQ ID NO: 112247 - DNA, 50 bp, homo sapien
cgactgttagtcctcatttgaaagaygaagagaaagacaaagagaaagga

SEQ ID NO: 112248 - DNA, 50 bp, homo sapien
agtacaaaataggttattgatattasaaaagatagttaaacttcataaaa

SEQ ID NO: 112249 - DNA, 50 bp, homo sapien
tcataaaaatggattgggaagttccrcattatctcatttaaccctcggtg

SEQ ID NO: 112250 - DNA, 50 bp, homo sapien
tactcaaggcatttaagatctggcascaactatttcttcgacctcattca

SEQ ID NO: 112251 - DNA, 50 bp, homo sapien
caaaactgcattggagagctagttcygaaacgtactaagcatgtgcatta

SEQ ID NO: 112252 - DNA, 50 bp, homo sapien
attaagattttacttaggagttactwaatttgcatttctttctttggtgt

SEQ ID NO: 112253 - DNA, 50 bp, homo sapien
cttggtctgggaagacgccatttaaygttaagtcaatttgcatgttataa

SEQ ID NO: 112254 - DNA, 50 bp, homo sapien
gaataactgtagaatgtgctgggaawttaaccacctgagataagtgggta

SEQ ID NO: 112255 - DNA, 50 bp, homo sapien
attaccaactaaaagagtttgaccartaactgatcagaaacaaacacaga

SEQ ID NO: 112256 - DNA, 50 bp, homo sapien
tttattaatatttgttttttatttayacatgatttcagacagtttactat

SEQ ID NO: 112257 - DNA, 50 bp, homo sapien
tgtctcaaaaagcctcaaaaataackgatgagtgaggcagcattccaatt

SEQ ID NO: 112258 - DNA, 50 bp, homo sapien
agtcatatcactcactggctgacacrcataatagagatattatctatttc

SEQ ID NO: 112259 - DNA, 50 bp, homo sapien
ccaggtcacatgtctgtgtaatatcygagctgaaatttgaacccagagac

SEQ ID NO: 112260 - DNA, 50 bp, homo sapien
agttactgtttttctctaagagatcraataatttcagtgctgagaccaaa

SEQ ID NO: 112261 - DNA, 50 bp, homo sapien
tgaaatgagcatagttattgagatamagtggccttaaagaagcatcaaat

SEQ ID NO: 112262 - DNA, 50 bp, homo sapien
taaaattaaacttcctaataagaaasgtcacgtaagtgaaattaaagtat

SEQ ID NO: 112263 - DNA, 50 bp, homo sapien
catttcagacaggtaaagtgcaattraaatatactggttgaaatagctgg

SEQ ID NO: 112264 - DNA, 50 bp, homo sapien
gctttcatgcagtgtttcaaaacatsatagctagaattccttcccacttt

SEQ ID NO: 112265 - DNA, 50 bp, homo sapien
atcactagacacctatatgccagaaytggtgccagatataaagaaaatgt

SEQ ID NO: 112266 - DNA, 50 bp, homo sapien
ttaaattataaaaactacctttatcmaatattctatcaaatccagtcttt

SEQ ID NO: 112267 - DNA, 50 bp, homo sapien
agagggtagaatatatgctaaaaatmaacctgagttcaaaaccatactat

SEQ ID NO: 112268 - DNA, 50 bp, homo sapien
gggtgtggacgtttgaatgccctcarcatagatagtcaaattattctctg

SEQ ID NO: 112269 - DNA, 50 bp, homo sapien
gaggataacagtgcatttgagtaaakaaaacttgagaatctcaaggcgga

SEQ ID NO: 112270 - DNA, 50 bp, homo sapien
ggatgaaggcttaggtagaatgacartctttaaaattactgggccaacta

SEQ ID NO: 112271 - DNA, 50 bp, homo sapien
caagccattagtagtgttgcttgaargaccaatgggttactatatgtaaa

SEQ ID NO: 112272 - DNA, 50 bp, homo sapien
agggaggtataatatattctctttcrataaactaaatcccagtcttccaa

SEQ ID NO: 112273 - DNA, 50 bp, homo sapien
gagtgacacatgttctgaggcattaygacggtccgttcagccagtaacct

SEQ ID NO: 112274 - DNA, 50 bp, homo sapien
tgggacccttgttgattggcggtaayacactgtttaattaagactctgga

SEQ ID NO: 112275 - DNA, 50 bp, homo sapien
atatcagtgccatgagtaaattcacsaagtcttccgttgacctttactgt

SEQ ID NO: 112276 - DNA, 50 bp, homo sapien
ctgttagttactagctgtgtactcawtcttggggcaagctgttacataac

SEQ ID NO: 112277 - DNA, 50 bp, homo sapien
aatgcaattacttctaccaggtcatrtaactcactgtgatttgtaattca

SEQ ID NO: 112278 - DNA, 50 bp, homo sapien
ggaataagattatcttgttgcaggarctaaaaagacaccatggtgcctgg

SEQ ID NO: 112279 - DNA, 50 bp, homo sapien
caagtggctgcacacgggaaggtcaragttctagcttcccaccaggtatg

SEQ ID NO: 112280 - DNA, 50 bp, homo sapien
atcacattcattgcttaagacttcasggcattgtctgcttatacctgtat

SEQ ID NO: 112281 - DNA, 50 bp, homo sapien
gtcatcgcttacctcagcaaaagcargttcccgttacagtgggtaaaatc

SEQ ID NO: 112282 - DNA, 50 bp, homo sapien
ctccctttgccatccctccaagtccracaaaccaccgctgacaccaccag

SEQ ID NO: 112283 - DNA, 50 bp, homo sapien
gttaattattccaggtacaggacacyataaatggaatgttaagttcttaa

SEQ ID NO: 112284 - DNA, 50 bp, homo sapien
tgatcctggataataaattggttatraattggtgagacatgtcagttctt

SEQ ID NO: 112285 - DNA, 50 bp, homo sapien
aaatcatttaaatagcaagttgggayggacaagtagaggagaaaatccag

SEQ ID NO: 112286 - DNA, 50 bp, homo sapien
aagacgctatagcttgagaggaaaaygggtacaggttcaaaaccagaaaa

SEQ ID NO: 112287 - DNA, 50 bp, homo sapien
catttggacagcatttctcattgccsaaagttttcactatctgctgcttc

SEQ ID NO: 112288 - DNA, 50 bp, homo sapien
actgccagaataagtctgtttatccrccttgagattctcaagttttcttt

SEQ ID NO: 112289 - DNA, 50 bp, homo sapien
tgagacaggaaataggacccttgacrcacaaaggaattttggctttgcct

SEQ ID NO: 112290 - DNA, 50 bp, homo sapien
gccaacggtcaccattacactatgasaacatggctaatgttgttgttgtt

SEQ ID NO: 112291 - DNA, 50 bp, homo sapien
aatgcttcgggcttctacgttcactyagctttacagtaaaatgatcacag

SEQ ID NO: 112292 - DNA, 50 bp, homo sapien
tgtttcatgttagttaaaataaatcygaaaattctgtggctatcaaagta

SEQ ID NO: 112293 - DNA, 50 bp, homo sapien
ctccctgggtttgtctctgtgctacragtaggctttcttcacattctggc

SEQ ID NO: 112294 - DNA, 50 bp, homo sapien
atgtggaggaatgttatttgcttcaraacaacttttatgagattgtatta

SEQ ID NO: 112295 - DNA, 50 bp, homo sapien
ttacaatttaatgtggtattggcctkaagatcatttcagttctgtgagaa

SEQ ID NO: 112296 - DNA, 50 bp, homo sapien
ggtaacaaagctttttgatctacagrattttgtcttatctgcacagccct

SEQ ID NO: 112297 - DNA, 50 bp, homo sapien
gaacccttgattatctcattcatcaygcttctcacagaactgaaatgatc

SEQ ID NO: 112298 - DNA, 50 bp, homo sapien
ataaacttaatcatatgccttagtargacacttttatgagaccttcagag

SEQ ID NO: 112299 - DNA, 50 bp, homo sapien
ttgctttgaacagaacttctaaactragcctgtctcatgcctctttgcac

SEQ ID NO: 112300 - DNA, 50 bp, homo sapien
aagaggcaggaaagtcaagtctcaaygttaatattttaaatcaacagaga

SEQ ID NO: 112301 - DNA, 50 bp, homo sapien
ataagaacaagaatgtaaaaatgcarctttgctttgaacagaacttctaa

SEQ ID NO: 112302 - DNA, 50 bp, homo sapien
tgtgtaggatattcttttccattgawtccaggaatatatctacataaata

SEQ ID NO: 112303 - DNA, 50 bp, homo sapien
cttacaggcaagtattgttattatcsttccaaaaatagacacggaaggac

SEQ ID NO: 112304 - DNA, 50 bp, homo sapien
ccatatttcagcttgcatagctctayaatggagattttagtatgaaatac

SEQ ID NO: 112305 - DNA, 50 bp, homo sapien
ttttcagtgcttttaggctgctagaracttccgatccctcactcacctct

SEQ ID NO: 112306 - DNA, 50 bp, homo sapien
gggataagaaaagcctggtctttttyggctgaatggcttcaggctgcatt

SEQ ID NO: 112307 - DNA, 50 bp, homo sapien
gggacttactgtcatttcttatctayggatattaattagtaacgtgagaa

SEQ ID NO: 112308 - DNA, 50 bp, homo sapien
gacaacatcactaatttacaaatgamctataaagatgttgtaaaatatca

SEQ ID NO: 112309 - DNA, 50 bp, homo sapien
cttcaagacaacgttatgtgttataygctatgattatatctgaagtatca

SEQ ID NO: 112310 - DNA, 50 bp, homo sapien
ggctcctttgaatgctttcaaggackgagtaaagtttgtaagaggcattt

SEQ ID NO: 112311 - DNA, 50 bp, homo sapien
acaagctttaggggcagatagtaaaraatcatgcaatggtacaggttgaa

SEQ ID NO: 112312 - DNA, 50 bp, homo sapien
aagctggattttgcggtcatggtcawagctacagatttaatcagactctc

SEQ ID NO: 112313 - DNA, 50 bp, homo sapien
gaatcagagttaaaaatgagtttgaraagtgtatataagaaaagtgttga

SEQ ID NO: 112314 - DNA, 50 bp, homo sapien
tttaacagacacttaaaactcaataygtccaaaactaaattctagattca

SEQ ID NO: 112315 - DNA, 50 bp, homo sapien
aaagacaggtgatgaatctaagccaraaagtggaacattgtgactgggcc

SEQ ID NO: 112316 - DNA, 50 bp, homo sapien
ctgaaacttaaagttcccatcaaaayttccagcatatttcagaccaaacc

SEQ ID NO: 112317 - DNA, 50 bp, homo sapien
attttggtgggaaattgattacaaayctaggtgctatgaagcttattgat

SEQ ID NO: 112318 - DNA, 50 bp, homo sapien
agggctctccagaattcagaattcaygctaaacaaaataaacacctgaaa

SEQ ID NO: 112319 - DNA, 50 bp, homo sapien
gggggtcaattgatttttgaattagscaatgtgcaaacccttagagcagc

SEQ ID NO: 112320 - DNA, 50 bp, homo sapien
ggcataagccaccacgcctgaccagraataagagttttaaaagacattct

SEQ ID NO: 112321 - DNA, 50 bp, homo sapien
atgataatttattttactgcatctgyatttagtatttattcgcttgcttc

SEQ ID NO: 112322 - DNA, 50 bp, homo sapien
attcctacagctgattattaccttcrattatatgactaatgctcatctcc

SEQ ID NO: 112323 - DNA, 50 bp, homo sapien
ggaatgatttttcttagtgctttgayctaattttggttaaatcttttaaa

SEQ ID NO: 112324 - DNA, 50 bp, homo sapien
ctgttatttacacgtctaagacctaygaatttggggagtataataggcat

SEQ ID NO: 112325 - DNA, 50 bp, homo sapien
aacccaagttctaactgttcacacayttgagaccaacccttaaccctcag

SEQ ID NO: 112326 - DNA, 50 bp, homo sapien
ggagagttatcaggtgcattccattwaattcctcagagggtcctcagagg

SEQ ID NO: 112327 - DNA, 50 bp, homo sapien
agtgtgccattgaaggagtcaaataytaagactgttgcttgctgcgattt

SEQ ID NO: 112328 - DNA, 50 bp, homo sapien
agagtcctctagagattaacgtatgratcaacaaaacattggatgaaaac

SEQ ID NO: 112329 - DNA, 50 bp, homo sapien
ccccagaatcaagagaactttgtggyaaatattctaaaaatgaaaatcgc

SEQ ID NO: 112330 - DNA, 50 bp, homo sapien
actctccctcattagtgcatattaaracacttctactgtaaaataatgag

SEQ ID NO: 112331 - DNA, 50 bp, homo sapien
gagaaaagtagtcatgtaagtaataygtcatttttcactagctgttttca

SEQ ID NO: 112332 - DNA, 50 bp, homo sapien
gtttcccacctcccacattaattccrccatcatcagaacatagttttaaa

SEQ ID NO: 112333 - DNA, 50 bp, homo sapien
ttatctaattaggacagatctgtaaygaagtctttattataaacaatgca

SEQ ID NO: 112334 - DNA, 50 bp, homo sapien
ccttggggagctgggtttggtcacaygagttatagctatttcttctgatc

SEQ ID NO: 112335 - DNA, 50 bp, homo sapien
gtattataaaaattattggctaagartaagggtaaatcataaagtcagga

SEQ ID NO: 112336 - DNA, 50 bp, homo sapien
taaggttggtcctgatctacactggratttatttcttctatatattttgt

SEQ ID NO: 112337 - DNA, 50 bp, homo sapien
aaaatcttatcatgatgtctctctayaatccttgtgaagagctttgaaag

SEQ ID NO: 112338 - DNA, 50 bp, homo sapien
ttgggtaagatttgtagccagtgttkcgtgtcttagcgttctcagatatt

SEQ ID NO: 112339 - DNA, 50 bp, homo sapien
ttgttctggttgaatcatgggcatasagagtcagcaacaacaattcggta

SEQ ID NO: 112340 - DNA, 50 bp, homo sapien
attaaaaaacaacaataaaatggcartaataacgttagtgctaataaccc

SEQ ID NO: 112341 - DNA, 50 bp, homo sapien
tatacattatttattgcattttagarggaaagaaactagtctattatttt

SEQ ID NO: 112342 - DNA, 50 bp, homo sapien
atcaagcttcatttgtctatttctayaacaagtaaatgcttgatcacctg

SEQ ID NO: 112343 - DNA, 50 bp, homo sapien
gttatttcatcattaattaacagaamaagtgtatggctccaggaggagag

SEQ ID NO: 112344 - DNA, 50 bp, homo sapien
ttaagtggagaaataggcatagatasaaatgcaactgtaggtttaggtgc

SEQ ID NO: 112345 - DNA, 50 bp, homo sapien
agtaggtgagatatggacgcatgtgwagataaagattcaggtggctgggc

SEQ ID NO: 112346 - DNA, 50 bp, homo sapien
tcagacaactataggaaggagtacaragcagagtcacctaacctagccag

SEQ ID NO: 112347 - DNA, 50 bp, homo sapien
ctcctcctcctaggaacacttggaargctctggaaccttgagtgcttctc

SEQ ID NO: 112348 - DNA, 50 bp, homo sapien
aatttgtaaacaacccttgctaatasctttctcttcattttacagattgg

SEQ ID NO: 112349 - DNA, 50 bp, homo sapien
tcttatggaggtcatttagcgtgtamagctttttatttacattaggtgat

SEQ ID NO: 112350 - DNA, 50 bp, homo sapien
atttttgcagaaaaaaaatgccagartatttcctagaatggaggtacaca

SEQ ID NO: 112351 - DNA, 50 bp, homo sapien
ccaaaaaagagatcataaagttactmagaagaggcaaatgtgtgattcta

SEQ ID NO: 112352 - DNA, 50 bp, homo sapien
ccttagtcagtcaacaaatatttcarcaattgcaaatgtgtatgtacacg

SEQ ID NO: 112353 - DNA, 50 bp, homo sapien
actcaggagtaaacgtaagtatgatyaaggatggaacaataaaagtaaag

SEQ ID NO: 112354 - DNA, 50 bp, homo sapien
agatgaattacagacacctttaggayatagaatcaatagttcttgataat

SEQ ID NO: 112355 - DNA, 50 bp, homo sapien
ttctggctatttccttgacattcaamcttgtgataacacagaaaatgact

SEQ ID NO: 112356 - DNA, 50 bp, homo sapien
gatctgactcctaaactagctctacrccatatggaaataaccccgggcca

SEQ ID NO: 112357 - DNA, 50 bp, homo sapien
atgaaagaatgaaagatggacggaasaaaattaggaccttaattctttgt

SEQ ID NO: 112358 - DNA, 50 bp, homo sapien
gacaggtgctcagtaagtagttgccraatgaataaacaggtgatgttacc

SEQ ID NO: 112359 - DNA, 50 bp, homo sapien
gagggtttcatagttggaaggaagamatggtcataaacacaaatcaaaat

SEQ ID NO: 112360 - DNA, 50 bp, homo sapien
gagggccaaggcaggcttaagaatasgagcatgtcacctgaccctcaggg

SEQ ID NO: 112361 - DNA, 50 bp, homo sapien
gtataggatgagatttatgctacccrccatagtgcagtctgagttttttc

SEQ ID NO: 112362 - DNA, 50 bp, homo sapien
cttcagcaccacaaattgggttgaamgtttcagagactaatcagaaatgt

SEQ ID NO: 112363 - DNA, 50 bp, homo sapien
agtttaatgcttaagaactgtaagawccttatttactctaatgagctgta

SEQ ID NO: 112364 - DNA, 50 bp, homo sapien
ggtggcagcaccacagaaccattctraaagacgaactgataatacgaaac

SEQ ID NO: 112365 - DNA, 50 bp, homo sapien
gtattaaaatgaattggatacaagaygactccttaatgcaggtctaaatc

SEQ ID NO: 112366 - DNA, 50 bp, homo sapien
gaacacttccctacacataactagamcttctaggctcaggcttaagaaac

SEQ ID NO: 112367 - DNA, 50 bp, homo sapien
ggttctattatatacttgtctggcaygtaataaaacttattagactgttg

SEQ ID NO: 112368 - DNA, 50 bp, homo sapien
gattttagaatctgaacaaccaaagraagatttcatgtaatttaaaacac

SEQ ID NO: 112369 - DNA, 50 bp, homo sapien
cagagccaaaccatatcagattagaygtatagagatttatgggcaatggc

SEQ ID NO: 112370 - DNA, 50 bp, homo sapien
tttatttcatgacctattctatttamaactctgatttcatgaacagtgtg

SEQ ID NO: 112371 - DNA, 50 bp, homo sapien
tccctgcttttattcagaatttccayacactagacctgtttccgatttct

SEQ ID NO: 112372 - DNA, 50 bp, homo sapien
acctgggacaggcccttcacctttcratggcctccgagatgatggtatgt

SEQ ID NO: 112373 - DNA, 50 bp, homo sapien
tcagagaaggaagccaataaggtgtsaagggaagcacaaaatcttcagga

SEQ ID NO: 112374 - DNA, 50 bp, homo sapien
aaacgcacagaaaacctacatgaacrgcaaatctttgtttctagctacaa

SEQ ID NO: 112375 - DNA, 50 bp, homo sapien
aaagatatctaaatgtgttatgataraatctacagtcaactctattatct

SEQ ID NO: 112376 - DNA, 50 bp, homo sapien
tgcttctcctatctttgctgcttcawcttgttctctgcaggtcagctgtc

SEQ ID NO: 112377 - DNA, 50 bp, homo sapien
tagtttggttttagcctttcttggastcagctttgccatctgtgaaatat

SEQ ID NO: 112378 - DNA, 50 bp, homo sapien
ttttcagtagcagaccctgtgtttcraagggagtctttagcaaaacccca

SEQ ID NO: 112379 - DNA, 50 bp, homo sapien
gagtgagcagcttaatgactgccacygaaacttacctcatcaaatctcca

SEQ ID NO: 112380 - DNA, 50 bp, homo sapien
gttattagtcaaaactgtgatattargaaaagcttcaggaaacttgggct

SEQ ID NO: 112381 - DNA, 50 bp, homo sapien
taagctttctgtccttgaattgtttsaaaacactggacagaggtcttcct

SEQ ID NO: 112382 - DNA, 50 bp, homo sapien
tcggcttttagatcttctgagggtarccaccttgcatgactggctcagcc

SEQ ID NO: 112383 - DNA, 50 bp, homo sapien
cttcataatagtttctccatgtcacstttcaccaagtataaaatgaagct

SEQ ID NO: 112384 - DNA, 50 bp, homo sapien
ccacatgtatttcctgaacacccaarattgtctcgtacagaactctcact

SEQ ID NO: 112385 - DNA, 50 bp, homo sapien
agtttgactttggaaaagcttcatartagtttctccatgtcacctttcac

SEQ ID NO: 112386 - DNA, 50 bp, homo sapien
tactataatactacaagtattgggayaatgatattctatttcctgctgga

SEQ ID NO: 112387 - DNA, 50 bp, homo sapien
taatcattttgtaataatcagatcayctagcacttatggagtgcctactg

SEQ ID NO: 112388 - DNA, 50 bp, homo sapien
gttctaaggattccagtaggctgccygaaataaataaaaaatgttgtttt

SEQ ID NO: 112389 - DNA, 50 bp, homo sapien
acatgtctaagagcttgcccattcasggttacatgccagtgcatctctca

SEQ ID NO: 112390 - DNA, 50 bp, homo sapien
cctagtattgtctctgccacactatrtttattccccttgcaccatcctgt

SEQ ID NO: 112391 - DNA, 50 bp, homo sapien
gtaccttataataacaaagtaatccyaattatttcctcccgtccatggac

SEQ ID NO: 112392 - DNA, 50 bp, homo sapien
catttctcattggccatggttacaakagaatcaaattaaatttgagagga

SEQ ID NO: 112393 - DNA, 50 bp, homo sapien
tattattttcatgttgtcacatttcyatgctaataaagacggcaacattg

SEQ ID NO: 112394 - DNA, 50 bp, homo sapien
aagaagagtctgtgagttttattaaygaatactgtagtctgagaactagc

SEQ ID NO: 112395 - DNA, 50 bp, homo sapien
aacatttcttctacctagtgccaaaygtctaccatgtaaaacaagtgatc

SEQ ID NO: 112396 - DNA, 50 bp, homo sapien
caagagcacacagctaattacaaggraagccaggttttgaagtctagtag

SEQ ID NO: 112397 - DNA, 50 bp, homo sapien
ttatgtgaggcagtatccactgaaaygagtgagagtaagaacccagatgt

SEQ ID NO: 112398 - DNA, 50 bp, homo sapien
taacagacctatgtcattaggttacygggaagaataaatgagataatgta

SEQ ID NO: 112399 - DNA, 50 bp, homo sapien
ctccttccccatgaagaagtctgacygacagagttttatctcatcattac

SEQ ID NO: 112400 - DNA, 50 bp, homo sapien
ctttttcccccactttgagtttatayggtttctaggctatttttagattt

SEQ ID NO: 112401 - DNA, 50 bp, homo sapien
tccaagtttcagtaagacacaacaaygaaggaaaaatggaaaatcccagc

SEQ ID NO: 112402 - DNA, 50 bp, homo sapien
ataaggtaaaccttcttaaaataaaygctgtagatgaagaggtaatttgt

SEQ ID NO: 112403 - DNA, 50 bp, homo sapien
taactgctgattttctacgcacttcratttccccatgtttcattgctatg

SEQ ID NO: 112404 - DNA, 50 bp, homo sapien
aggaaatctacattgtctccatgtcyaagtgagaggtccttctctctaca

SEQ ID NO: 112405 - DNA, 50 bp, homo sapien
tacacaaaggaaatgagaatagaacraggctgccgaacgcttcttgaatg

SEQ ID NO: 112406 - DNA, 50 bp, homo sapien
gacatttattggatgtcaagcttatyaaatcatactcacctgtgctttca

SEQ ID NO: 112407 - DNA, 50 bp, homo sapien
acaagcacagactgtctgatttgcamaagacatattagataaaaagctgt

SEQ ID NO: 112408 - DNA, 50 bp, homo sapien
gagtggagaacagccgagacacctcygaaaccacccaggaatcaacagga

SEQ ID NO: 112409 - DNA, 50 bp, homo sapien
tgttctccactcctggtcgcctatarcaactcctggcaggaacgctgtac

SEQ ID NO: 112410 - DNA, 50 bp, homo sapien
catctctgatagtggagtaccacctsaacatcagatctgcctagggtcca

SEQ ID NO: 112411 - DNA, 50 bp, homo sapien
tgggtgctttttgaatgttatttgcracaaacaacttgtttgctctgttt

SEQ ID NO: 112412 - DNA, 50 bp, homo sapien
gtttctgctcgagctggttacattayccagatatttttgaccttggtcct

SEQ ID NO: 112413 - DNA, 50 bp, homo sapien
tgattcctgttctgccactgataaaycctatggtctttgtcatttactcc

SEQ ID NO: 112414 - DNA, 50 bp, homo sapien
acttagtcactacattttaggcaaarcatcccatattggacaccattcag

SEQ ID NO: 112415 - DNA, 50 bp, homo sapien
tcatttgtagcttgaagattttttcrccaatttaagaaatgacaactaca

SEQ ID NO: 112416 - DNA, 50 bp, homo sapien
cctgtcataggttatgcattctataytaattccatattatattagagcca

SEQ ID NO: 112417 - DNA, 50 bp, homo sapien
gagtgaattagtttctgagaagtcartctattgtgaaaagtttcagatga

SEQ ID NO: 112418 - DNA, 50 bp, homo sapien
gtcatcattgagataacaacgatctwaacaacggtaatcgtaatcaacag

SEQ ID NO: 112419 - DNA, 50 bp, homo sapien
tgcattgcattctgctctacactacrggcctaattggcacagagcctggc

SEQ ID NO: 112420 - DNA, 50 bp, homo sapien
tttttcaatttattggcatattgtcrcttatagtagcctgtaatgatcct

SEQ ID NO: 112421 - DNA, 50 bp, homo sapien
cttagaactgcagcattcgttatctwagaataaaagcagccctgtttctt

SEQ ID NO: 112422 - DNA, 50 bp, homo sapien
caaaggcaatagtggactcttaaccmgcacattagtcattgttttaatag

SEQ ID NO: 112423 - DNA, 50 bp, homo sapien
atatgttaagtgctaactacatcaaygttttgcaggaatcagctcactaa

SEQ ID NO: 112424 - DNA, 50 bp, homo sapien
gataatggcaacaatttctcctaaaycatgtgctaatcttccagtgatat

SEQ ID NO: 112425 - DNA, 50 bp, homo sapien
tgagttatagttgtgataaataccamaaacggtcatcttgggattgtgat

SEQ ID NO: 112426 - DNA, 50 bp, homo sapien
gcttttcccaacactcaagcacaaastcaaaggcctatctgggagaaata

SEQ ID NO: 112427 - DNA, 50 bp, homo sapien
aaggttgtactcactatgtgccaatyctctaagtcctccgcatgggtgaa

SEQ ID NO: 112428 - DNA, 50 bp, homo sapien
ctgatgtgccagactagctgacggawtcacctgtgctgtgttaccagact

SEQ ID NO: 112429 - DNA, 50 bp, homo sapien
atttactatcactagagaggaaaccrgagatgtattttaatattatgttc

SEQ ID NO: 112430 - DNA, 50 bp, homo sapien
cttttaacactaaatgtgcacagtamctataccttatttgatttttagac

SEQ ID NO: 112431 - DNA, 50 bp, homo sapien
tccactggtgttctctgatgttcaasacaatttgcttttatattcttcat

SEQ ID NO: 112432 - DNA, 50 bp, homo sapien
aggaaatttagacacatttcaacaasggctaaaaacatataatgttgaaa

SEQ ID NO: 112433 - DNA, 50 bp, homo sapien
gagagtaaaagacatgagctagagaracccatttttgcttcttgtgagct

SEQ ID NO: 112434 - DNA, 50 bp, homo sapien
aaaaatgcatactaccttgtaatcaycaccagaatcaagatataaagata

SEQ ID NO: 112435 - DNA, 50 bp, homo sapien
cgaattcaaggttgtctcatactcaractagaatttctccaagtgcatta

SEQ ID NO: 112436 - DNA, 50 bp, homo sapien
tcatgcaaaatgtgacatagtatgakcgagggcggacagccttgggaacc

SEQ ID NO: 112437 - DNA, 50 bp, homo sapien
gtctgtggctctgttgtagcagaaakaatccaaggctatgggtcagagga

SEQ ID NO: 112438 - DNA, 50 bp, homo sapien
cacatccaaatgctttcgaactacartaaatatcacaaaatcatgcaaaa

SEQ ID NO: 112439 - DNA, 50 bp, homo sapien
cactctattttgatttatacggttarcatatcacgttttagtcaaaatct

SEQ ID NO: 112440 - DNA, 50 bp, homo sapien
gcacatatgcatctacaggtgtctcractttcacacagacgttatttgtt

SEQ ID NO: 112441 - DNA, 50 bp, homo sapien
tttactatacgagaattagaatagaygatatagatacagatatataataa

SEQ ID NO: 112442 - DNA, 50 bp, homo sapien
ttgcccacactgttgtgaaatatackattaaaatctataatcccagcagt

SEQ ID NO: 112443 - DNA, 50 bp, homo sapien
agcacaaagacaggaatcaggaatcractcaccttaatgtgtctcttcat

SEQ ID NO: 112444 - DNA, 50 bp, homo sapien
tttttctgtttcttaaactgaaatartaactcaattatgtctcttacctt

SEQ ID NO: 112445 - DNA, 50 bp, homo sapien
tttccctgtgttcccaaacttaacaygaaacagtgcaagatccttaaatg

SEQ ID NO: 112446 - DNA, 50 bp, homo sapien
gagagcagatcttcctcactcagtcraccagctcactagtcacagcttaa

SEQ ID NO: 112447 - DNA, 50 bp, homo sapien
tggcgaatatttatggagtaccacartgtgctgcatgcaggcagtagggg

SEQ ID NO: 112448 - DNA, 50 bp, homo sapien
agtgctgctcctatcatatcttagcraacctgcaggagatacttgattcc

SEQ ID NO: 112449 - DNA, 50 bp, homo sapien
gggccataggtactctttgacagaaygaataaatttctctagttgtctgg

SEQ ID NO: 112450 - DNA, 50 bp, homo sapien
gtctatgatttagtttgcctagatarcatttaatctttggagttgatatt

SEQ ID NO: 112451 - DNA, 50 bp, homo sapien
gcctcactgccagccattttttagckcactcttttatcctcattccaatg

SEQ ID NO: 112452 - DNA, 50 bp, homo sapien
agaagagatagagaatatgagaaacrataaaacctgaaataatccattgt

SEQ ID NO: 112453 - DNA, 50 bp, homo sapien
tggtcacttcctcttcatcccaggakattgcattctcagcacattctaca

SEQ ID NO: 112454 - DNA, 50 bp, homo sapien
ctggtctgatttgaactgagatctcygaaagctgggaaagactggactag

SEQ ID NO: 112455 - DNA, 50 bp, homo sapien
cctataacctttttgctaaagatggyattgactttattcccacctattcc

SEQ ID NO: 112456 - DNA, 50 bp, homo sapien
aggaagagaggactacagcatggtamcaattctctctaatgaaataccat

SEQ ID NO: 112457 - DNA, 50 bp, homo sapien
tggattctacctccagctgtcttacsatttctagttctacctatggagca

SEQ ID NO: 112458 - DNA, 50 bp, homo sapien
aggctacacagaagtgataatcaacsagacacctgttattccttttgcac

SEQ ID NO: 112459 - DNA, 50 bp, homo sapien
atgtgtcagttggataatacagaaarttagctacagggcttattgtggct

SEQ ID NO: 112460 - DNA, 50 bp, homo sapien
taatggttatctttatcctagcagtyaagaatggactggaaggggcaaga

SEQ ID NO: 112461 - DNA, 50 bp, homo sapien
aacacagggcttctgtggaaacgcasggaagaagcatttacactcaatca

SEQ ID NO: 112462 - DNA, 50 bp, homo sapien
aggggtctcagtaatgtgaataagtraagtgagctttcatgacctttcaa

SEQ ID NO: 112463 - DNA, 50 bp, homo sapien
acatcttttcatcttgcaggtatcasgttcaactttagaggcgcttccct

SEQ ID NO: 112464 - DNA, 50 bp, homo sapien
atccaatagacccttgttgagttgtwaaaaagcttgaaaaatgaggataa

SEQ ID NO: 112465 - DNA, 50 bp, homo sapien
aagggcatttctataaagaaagctargttctaccagtttttattagttca

SEQ ID NO: 112466 - DNA, 50 bp, homo sapien
attttgtttcctcatatgcttcttayattctcagcagaagggaacctcca

SEQ ID NO: 112467 - DNA, 50 bp, homo sapien
gacctcacacccaaggataagaaacsaatgggtctactgcctatttgaaa

SEQ ID NO: 112468 - DNA, 50 bp, homo sapien
gcttccccgactaggcgccttgaaaygtgacttaggcaggaggtaaagga

SEQ ID NO: 112469 - DNA, 50 bp, homo sapien
tgccatgtagaggcaaagtcatggtkaaatgggacctttaggagcaactg

SEQ ID NO: 112470 - DNA, 50 bp, homo sapien
aagatttgatcagttgaacatgaccmaaagacattccagaaggagggcac

SEQ ID NO: 112471 - DNA, 50 bp, homo sapien
cagttaataaacatttgagttgtttycatattttagctattgtggatagt

SEQ ID NO: 112472 - DNA, 50 bp, homo sapien
attttacatcaataccagtgatataygagggctgaaaatttctccatatt

SEQ ID NO: 112473 - DNA, 50 bp, homo sapien
gccggggttttctgtagtttcccgcyagcttctaattccagctctgtctt

SEQ ID NO: 112474 - DNA, 50 bp, homo sapien
cctgtcctataaattagggcaatacrgagatttaccaaagagaaagatgt

SEQ ID NO: 112475 - DNA, 50 bp, homo sapien
aaatgcagttgctaaaagacaaaaamctcaatggaaaggttaaaggttaa

SEQ ID NO: 112476 - DNA, 50 bp, homo sapien
ctcgtggcctcttttctttcctacascacctttgacatctagacattcca

SEQ ID NO: 112477 - DNA, 50 bp, homo sapien
tgcaaagttaagttgggccagtttcygattccttttcctcataattcatt

SEQ ID NO: 112478 - DNA, 50 bp, homo sapien
aaaagaggaaagtcagtgatgttttmtatactgtcagcagcaatctcaca

SEQ ID NO: 112479 - DNA, 50 bp, homo sapien
taactttgcattgaagcattcagcaytacaggaggccatctggtgtaaca

SEQ ID NO: 112480 - DNA, 50 bp, homo sapien
atctggtgtaacatctcctgtcccaragagtctacaattttaatggtgct

SEQ ID NO: 112481 - DNA, 50 bp, homo sapien
caaagtaatacagggagacaggacaygttgattagtatgcaccaatcagg

SEQ ID NO: 112482 - DNA, 50 bp, homo sapien
gccaaacccctggcacttgctactaygccaagtttactgtttcctctaga

SEQ ID NO: 112483 - DNA, 50 bp, homo sapien
gatgtagaccacattggcttttatgsaggattgagcaaacttaccaatga

SEQ ID NO: 112484 - DNA, 50 bp, homo sapien
atttatatttatgaccagattaagaygctcttgagtgaagttaccaaagg

SEQ ID NO: 112485 - DNA, 50 bp, homo sapien
tattgcacaaactaacaccataacartatgacactagagagaaacattgg

SEQ ID NO: 112486 - DNA, 50 bp, homo sapien
taatggtgctgacctttggaaagtgrtgtcttgactggaaactggaagat

SEQ ID NO: 112487 - DNA, 50 bp, homo sapien
cacacatagcacctataatgagaaasgaattaagctttattgaaaaattt

SEQ ID NO: 112488 - DNA, 50 bp, homo sapien
aagaaagagataccttttagccatgwaaattcaatcttatctgtgaagct

SEQ ID NO: 112489 - DNA, 50 bp, homo sapien
ggaagaaatctttattgtaagtgaartcatatgttaacaatagccctttg

SEQ ID NO: 112490 - DNA, 50 bp, homo sapien
agtgcatgaattttgcatcctggttraaagactgaaatttggagtcaaat

SEQ ID NO: 112491 - DNA, 50 bp, homo sapien
gtcttttattgtttaagtgaagaaaytgagttaaataaattttctgagaa

SEQ ID NO: 112492 - DNA, 50 bp, homo sapien
tcctctctgaacaaatctgtgtttawaataagcgtaccaaatctgcccca

SEQ ID NO: 112493 - DNA, 50 bp, homo sapien
atgaagcacgctcttcctctactaarcgggcatgacagtaaaaactacca

SEQ ID NO: 112494 - DNA, 50 bp, homo sapien
ggcctctttgttttgggcaatgccartcctgattctgggcaggctaacca

SEQ ID NO: 112495 - DNA, 50 bp, homo sapien
attaaataattatcacaaagtcacgraagtgggagaaacaagtggtcaag

SEQ ID NO: 112496 - DNA, 50 bp, homo sapien
ctcttgcagtatgctttccaaacacyggtgagtgctctgcccatcgcaag

SEQ ID NO: 112497 - DNA, 50 bp, homo sapien
agtgctctgcccatcgcaagggtccraagaacagggtcacatctcactgt

SEQ ID NO: 112498 - DNA, 50 bp, homo sapien
catcaaagtgggtacatatttaccargaaggtgactttactgctatttgc

SEQ ID NO: 112499 - DNA, 50 bp, homo sapien
gaaacactcaatatgatgtatgtcawcctacagaggcacttatgtaaaag

SEQ ID NO: 112500 - DNA, 50 bp, homo sapien
ccataaaagaccctcactaattatcrattttcgcctggtcctggaaaaaa

SEQ ID NO: 112501 - DNA, 50 bp, homo sapien
ttaaactgtgcttgcgaccaagagcscttcaggtgattttaaagggcctt

SEQ ID NO: 112502 - DNA, 50 bp, homo sapien
tcaagctgatctgttgaccagaatasctaatagatagtgctgagaaagaa

SEQ ID NO: 112503 - DNA, 50 bp, homo sapien
gatagtgctgagaaagaaatcttaaycatagctgaaataaattgtttata

SEQ ID NO: 112504 - DNA, 50 bp, homo sapien
ttaatatggattatatatgtggttarcgtttctatttttatagtaaagat

SEQ ID NO: 112505 - DNA, 50 bp, homo sapien
tagctgtatggaatataaaacaatawgtctgtggttcagaagctcttcat

SEQ ID NO: 112506 - DNA, 50 bp, homo sapien
ctctgactagattaataaggacaaaraaaaggcacaagtaaccgcattac

SEQ ID NO: 112507 - DNA, 50 bp, homo sapien
acaagctgcttgccattatacaaatwagattaggcccagaaatggagaat

SEQ ID NO: 112508 - DNA, 50 bp, homo sapien
tataatcttaataccaaaatctgacraagcaacatgagaaaggaaatttc

SEQ ID NO: 112509 - DNA, 50 bp, homo sapien
ctggttatcactattgctgaaaatasaaagggaaaaacaagaacaaaacc

SEQ ID NO: 112510 - DNA, 50 bp, homo sapien
gatttattggaaggagttggcttacrtgattgtgaggtctaggcaagtat

SEQ ID NO: 112511 - DNA, 50 bp, homo sapien
aactcatacctgcaaaaccaagataygagctggaatgacatgatgctttc

SEQ ID NO: 112512 - DNA, 50 bp, homo sapien
atagtaggttccaggcatgttctaartatctctttaatcctcacaatgaa

SEQ ID NO: 112513 - DNA, 50 bp, homo sapien
aaatgcaaaggtccaacaacagctarcatactcttgaagaataaatcaaa

SEQ ID NO: 112514 - DNA, 50 bp, homo sapien
cctgtcttctatctggtttaacacaytgtaaagctgtcttctggagtcta

SEQ ID NO: 112515 - DNA, 50 bp, homo sapien
acttaatttgcaaataaggatatgayattagggtgttcaaatagctttag

SEQ ID NO: 112516 - DNA, 50 bp, homo sapien
ctgtcaagagcaatgtttgctgtaaycagtttttgctttaggtgttgact

SEQ ID NO: 112517 - DNA, 50 bp, homo sapien
aacccaatgtactaattcttgcgtayattaaaatttgagagctacttagc

SEQ ID NO: 112518 - DNA, 50 bp, homo sapien
ccccagttttcagtggtgatgagaaygtaacctctgctgcagtgaatatc

SEQ ID NO: 112519 - DNA, 50 bp, homo sapien
agcagtggttcagggaagaattagargaaatcacaacttcagtcataaaa

SEQ ID NO: 112520 - DNA, 50 bp, homo sapien
gttccatttaactactttggagcagmatcaagcagaataataactatgaa

SEQ ID NO: 112521 - DNA, 50 bp, homo sapien
atagtcattccagcatatttatccarctgaaactgccttgttgaggacac

SEQ ID NO: 112522 - DNA, 50 bp, homo sapien
atgactatttagggttttaaaattaygtatgccatattgcacaactcttt

SEQ ID NO: 112523 - DNA, 50 bp, homo sapien
atttacttagcagacggttttgagcrgaccacggagttttgaagtaagaa

SEQ ID NO: 112524 - DNA, 50 bp, homo sapien
ccatgctgttaagtctttcttactaycattcctctctgaaatagctttac

SEQ ID NO: 112525 - DNA, 50 bp, homo sapien
tttgggatgtactgcttctcataacygtgtgcatgaggtgatattggctt

SEQ ID NO: 112526 - DNA, 50 bp, homo sapien
cctcatttctttattacatacagatragttgagcttaataatctagtaaa

SEQ ID NO: 112527 - DNA, 50 bp, homo sapien
aatatttcagggaccaattccaagaraaacagatcttcctaaaaacattc

SEQ ID NO: 112528 - DNA, 50 bp, homo sapien
caatgactttctccaaagatgcaaartatccaagaatgcagggacctggg

SEQ ID NO: 112529 - DNA, 50 bp, homo sapien
ggattttactaactttgtaacatgcyctaaagcaggggtgctcaaccctg

SEQ ID NO: 112530 - DNA, 50 bp, homo sapien
gtccatctgggctgctataacaaaaygccataaactaggtggcttctaaa

SEQ ID NO: 112531 - DNA, 50 bp, homo sapien
aggtatcctgatatctttctgtctaygctcccatcttttgccagtgtcgc

SEQ ID NO: 112532 - DNA, 50 bp, homo sapien
acaaccttgggccatgggcttcaggsacgtttgcttgtagtccaaccctt

SEQ ID NO: 112533 - DNA, 50 bp, homo sapien
tcctcttcaatccactctgttcatascactaggagaattagttaatgcca

SEQ ID NO: 112534 - DNA, 50 bp, homo sapien
gacatccatctgcttcctgttagagscttgatcaactgctaggcctggag

SEQ ID NO: 112535 - DNA, 50 bp, homo sapien
cttgaaaccatactttttgaaggtasgatccattctgatttagccttcta

SEQ ID NO: 112536 - DNA, 50 bp, homo sapien
acccaacatgccactgtttctgtgayagttaatgcctataatgcctgcca

SEQ ID NO: 112537 - DNA, 50 bp, homo sapien
gaaaatagtgaagagttcagaattayagacatgggttacaatttgagctc

SEQ ID NO: 112538 - DNA, 50 bp, homo sapien
cacatattaatttagtgcaataccawtatagaaaatagtgaagagttcag

SEQ ID NO: 112539 - DNA, 50 bp, homo sapien
ccctctcactcctaatccaatgttcrcaggctaccaccctcacccttctg

SEQ ID NO: 112540 - DNA, 50 bp, homo sapien
ccggaaccttccacactcaattccawatttatcatagtactatcatttgg

SEQ ID NO: 112541 - DNA, 50 bp, homo sapien
gtgggtcaccttttgaggttaagaaygagtaataagaccttgaggattct

SEQ ID NO: 112542 - DNA, 50 bp, homo sapien
aactcaggtcttctaaaatatttacraagcaggtgagctagagagaactt

SEQ ID NO: 112543 - DNA, 50 bp, homo sapien
atctcgagaaaagtctggtcaggatsagggagaaagatcttattgggtat

SEQ ID NO: 112544 - DNA, 50 bp, homo sapien
ggggtcgctgtcaggagagaaagaamctcatcgaagtggcccggagatga

SEQ ID NO: 112545 - DNA, 50 bp, homo sapien
aaaaaaaaaagactcaaaaattggcygaataaatatattccataatttgg

SEQ ID NO: 112546 - DNA, 50 bp, homo sapien
acttgagacctactcatagctaaaaytgaactgaggaatagaagttaaaa

SEQ ID NO: 112547 - DNA, 50 bp, homo sapien
ccaaaaagcacgtttgcacatgttargctcgagctgtttattaaatattc

SEQ ID NO: 112548 - DNA, 50 bp, homo sapien
acctcacagaatatattttgagataygctgacagataaatcatataatga

SEQ ID NO: 112549 - DNA, 50 bp, homo sapien
gggttgcattcccctgtggttccaargttctcccttcattctgcatcttc

SEQ ID NO: 112550 - DNA, 50 bp, homo sapien
agatgtgatagatatttatccttgcsaaatgaagtacacaaatttttcct

SEQ ID NO: 112551 - DNA, 50 bp, homo sapien
cttataaatatgtcaaaactctgaakggctgaagcaatttattctgaaag

SEQ ID NO: 112552 - DNA, 50 bp, homo sapien
tagttgtaaataggcagctgctacaytacagcgccacacaggtttgacct

SEQ ID NO: 112553 - DNA, 50 bp, homo sapien
gactattgaaggtctaaagggttctrgtccaattcactaatgagtctgag

SEQ ID NO: 112554 - DNA, 50 bp, homo sapien
cacacctcatcatggagcaccaagcrcctctatgaatggaggtgctcttt

SEQ ID NO: 112555 - DNA, 50 bp, homo sapien
gaggtaacgtatggagtttctgcaawgccattaaaaatgagctgtgggca

SEQ ID NO: 112556 - DNA, 50 bp, homo sapien
ggcatcctatgtcacgcttagacaasgatgctcgcctagaaactcaggtt

SEQ ID NO: 112557 - DNA, 50 bp, homo sapien
ttgtggatttgtcaaaaaagtgtaakgaatgtgtgtcccaggttggataa

SEQ ID NO: 112558 - DNA, 50 bp, homo sapien
atcaactctttgaaatcactttacaraatcccatacactatcacatttcc

SEQ ID NO: 112559 - DNA, 50 bp, homo sapien
ttatttatccattgaagaagcaggamactgactacttattatactccttt

SEQ ID NO: 112560 - DNA, 50 bp, homo sapien
ccctgggatgagatgtagagttagayggtaaagagtagagtctgtggagc

SEQ ID NO: 112561 - DNA, 50 bp, homo sapien
ataggaaagtagatattaaattatcrgacagaagatatcatggttctcaa

SEQ ID NO: 112562 - DNA, 50 bp, homo sapien
aggaatcctaggtagctttcatagayggagactccctgcacaccccaaat

SEQ ID NO: 112563 - DNA, 50 bp, homo sapien
taacttttccacttcctgttggtagrccattcttcagtccaaatgaaaat

SEQ ID NO: 112564 - DNA, 50 bp, homo sapien
atctatctaacaagggacttattcaygctaatcttgaaaagggtcaacag

SEQ ID NO: 112565 - DNA, 50 bp, homo sapien
tgtcaatgtagggcatggaagactaycaaatggctttagaatctgagaag

SEQ ID NO: 112566 - DNA, 50 bp, homo sapien
aagacagtattacttctgtcttcttraaaaatccagcattgctttgcttt

SEQ ID NO: 112567 - DNA, 50 bp, homo sapien
cggagtcgataaagagggttaaggcrgaatacaatagtacgaaactgaat

SEQ ID NO: 112568 - DNA, 50 bp, homo sapien
gatgtttttaaatttgttcaaaataratgacctcagaattttatatagaa

SEQ ID NO: 112569 - DNA, 50 bp, homo sapien
atgctgagaaagaatgttagcgcccyagctttcacaataaaggcagtgga

SEQ ID NO: 112570 - DNA, 50 bp, homo sapien
aggtgtaatttccaattccattaackgaacgagacatgaatgtttcctta

SEQ ID NO: 112571 - DNA, 50 bp, homo sapien
cattctgtgtttcttgattaatttcraaaccatgaaatggctcagccact

SEQ ID NO: 112572 - DNA, 50 bp, homo sapien
tatgccctttccttctgtttgacaargtgactgtgcttgattctatacat

SEQ ID NO: 112573 - DNA, 50 bp, homo sapien
ctatgtaaattgtgatcaaacttacrcagctagaacaggacaggcccagg

SEQ ID NO: 112574 - DNA, 50 bp, homo sapien
actgtgtatgtgtttatgtgctgtakgtatatctgtactttatacataaa

SEQ ID NO: 112575 - DNA, 50 bp, homo sapien
caatacctctcaggtaagaatcctgragtaaggcgtgggagtggtaagac

SEQ ID NO: 112576 - DNA, 50 bp, homo sapien
gatggtgggcaagtaaacactcccartaggcagaattgaggcagtgtatc

SEQ ID NO: 112577 - DNA, 50 bp, homo sapien
aacacttcggcctagataacagatgracctttccactatgccagcacagg

SEQ ID NO: 112578 - DNA, 50 bp, homo sapien
atgcatcccagaactcacttctatayctaatactacccgtttcttgatac

SEQ ID NO: 112579 - DNA, 50 bp, homo sapien
taggacttagggatagcatgagaaayggtacaatgaaaaagtctcctaag

SEQ ID NO: 112580 - DNA, 50 bp, homo sapien
agtagttgtggtagcacctacaatgkatcatgtatgtgaagaatcagaat

SEQ ID NO: 112581 - DNA, 50 bp, homo sapien
ggaggacctgcgttcacttctccggscattaattttcttttcttttcttt

SEQ ID NO: 112582 - DNA, 50 bp, homo sapien
gtggatactgattcaacattagtaasagggaaacatctgagatgttaaaa

SEQ ID NO: 112583 - DNA, 50 bp, homo sapien
attaggaattttcatctttcgatcakctaccctggctttgagtagccaca

SEQ ID NO: 112584 - DNA, 50 bp, homo sapien
ccaaggcatcagtgggtgttttttcmactcaaagaaggaatctatactta

SEQ ID NO: 112585 - DNA, 50 bp, homo sapien
cgtagtaccatacagcaatggctcgyaaactttagtgcatgtctgagtca

SEQ ID NO: 112586 - DNA, 50 bp, homo sapien
gtgctacagtatgcattaaaccgatyaaaataacgtagcatctttgagga

SEQ ID NO: 112587 - DNA, 50 bp, homo sapien
agtagagcttaggggtgatctgtgaygactgtataaatgaactcatccag

SEQ ID NO: 112588 - DNA, 50 bp, homo sapien
tgaggacttttcctagggagttttayagtcaggaaatactacatcctagg

SEQ ID NO: 112589 - DNA, 50 bp, homo sapien
acctatacgacctactcatgctctawcttctcatctgagaaatgagaata

SEQ ID NO: 112590 - DNA, 50 bp, homo sapien
agatatattgcagtgaattcccgcaraagttttagcctcttttctggaat

SEQ ID NO: 112591 - DNA, 50 bp, homo sapien
aaaactagccaatagcagcactccasaagaagcacagctgacaagtctgc

SEQ ID NO: 112592 - DNA, 50 bp, homo sapien
gtttctggctcattgtgttaaaaaaktactggacaaatggatcatacaga

SEQ ID NO: 112593 - DNA, 50 bp, homo sapien
ccacagacaagagtaccttcgtgaayatccctgaatgtgtgagagaggct

SEQ ID NO: 112594 - DNA, 50 bp, homo sapien
tgaacacatgaatgtcctttactgarattaaacctgtttgactaagtgaa

SEQ ID NO: 112595 - DNA, 50 bp, homo sapien
gacacataaaattaaccgtcacaaakagttggattttatcaagcacatgt

SEQ ID NO: 112596 - DNA, 50 bp, homo sapien
acacacattaacgtgaattcctgtakattaagagataactgtttttgcat

SEQ ID NO: 112597 - DNA, 50 bp, homo sapien
acaccaacctttttgccatttctcargtattccaaatggagtctcttctt

SEQ ID NO: 112598 - DNA, 50 bp, homo sapien
aaaattacattatttggtgtaatcartcttttaattttacccttttcagt

SEQ ID NO: 112599 - DNA, 50 bp, homo sapien
gtgccctgcacccagatgatcaagcygaaaatcctctacttgactcttca

SEQ ID NO: 112600 - DNA, 50 bp, homo sapien
gtacattcataatattgtgtagctgycacctctctctagttccaaaacat

SEQ ID NO: 112601 - DNA, 50 bp, homo sapien
gcatgcctagagaagtggatgaatasaggggatttatcagtaagacttta

SEQ ID NO: 112602 - DNA, 50 bp, homo sapien
tccaagacagggaatgtgctaccttycaaggctgccagagccatttcctc

SEQ ID NO: 112603 - DNA, 50 bp, homo sapien
tttaaacagatgtgaaaactgagacragagaagtcaatagaatttccaag

SEQ ID NO: 112604 - DNA, 50 bp, homo sapien
cttcactgtttcttcccctggtcccrgaattaaggctgggctccatttga

SEQ ID NO: 112605 - DNA, 50 bp, homo sapien
aatatcatgaaactgtgcacccccayggttttatgtaaagcattctattt

SEQ ID NO: 112606 - DNA, 50 bp, homo sapien
cctttaataaaatgtgaagtcacaamgcaattaaatagtagtgtagtttt

SEQ ID NO: 112607 - DNA, 50 bp, homo sapien
ctccttgggtagtcctttgtgcaaarcgtaaatgcagaaactgctcattg

SEQ ID NO: 112608 - DNA, 50 bp, homo sapien
taaaattaatttctttcccaaatgartagccacctgcaatttttgtagtt

SEQ ID NO: 112609 - DNA, 50 bp, homo sapien
ccccgacccttcatccctacataccrcttctatagaaagaagctttgatt

SEQ ID NO: 112610 - DNA, 50 bp, homo sapien
atcatcagcacctatcgtagtagcayatattacagagaatgtctttgaca

SEQ ID NO: 112611 - DNA, 50 bp, homo sapien
ccagtgatatagatggttgaaaaackgatgattccactgttttaaaattg

SEQ ID NO: 112612 - DNA, 50 bp, homo sapien
ctcatgttcagtttgttttgacaccrattgaagttgccattgaagacatg

SEQ ID NO: 112613 - DNA, 50 bp, homo sapien
tcccaggccaacagatgcaaggcaawtgattcagtcgcttactccagccc

SEQ ID NO: 112614 - DNA, 50 bp, homo sapien
atcttattatcttactgtgaagatcmaatgaattcttgtttgtcaacatc

SEQ ID NO: 112615 - DNA, 50 bp, homo sapien
tctagaaatacatagaatgtgacgargtaaggcatatctcagtaaggtaa

SEQ ID NO: 112616 - DNA, 50 bp, homo sapien
gttgtgcttaattaaatgtcagccayattttcaatgcatcttagttatac

SEQ ID NO: 112617 - DNA, 50 bp, homo sapien
ataataatttgtaaaactaacaaaastatagaaatcaaagacaaaaggct

SEQ ID NO: 112618 - DNA, 50 bp, homo sapien
aaattaattttaattcctatctcaartcacatttcaaactaagtttcata

SEQ ID NO: 112619 - DNA, 50 bp, homo sapien
tctatgacacatacatgtaattaaastcatagaaacagaaagtagaaagg

SEQ ID NO: 112620 - DNA, 50 bp, homo sapien
ctcctacctgcctcaaccatgattcyaggaaaattcggcacattctgtgg

SEQ ID NO: 112621 - DNA, 50 bp, homo sapien
gcttcccgtgagtgccactgacgtgyagtttgagctccactggggctttt

SEQ ID NO: 112622 - DNA, 50 bp, homo sapien
gcatcccttaatgtagctaaagatcraaatcttctcattttggggagagt

SEQ ID NO: 112623 - DNA, 50 bp, homo sapien
atagtttgccttttccagagtgccawacggttggaatcatacagtatgta

SEQ ID NO: 112624 - DNA, 50 bp, homo sapien
gtaccttttgctaatcaactggattrattggatgctttacaaaggtttaa

SEQ ID NO: 112625 - DNA, 50 bp, homo sapien
gtgctgctgttcagataaaacatttkgaaagtgacagttcaaaatacatt

SEQ ID NO: 112626 - DNA, 50 bp, homo sapien
gagcagttttggaggataaagacagsagttggttagatcagatccttcat

SEQ ID NO: 112627 - DNA, 50 bp, homo sapien
caggtatccagagacattgctaaaaratgtcaataccaaatctaatcaca

SEQ ID NO: 112628 - DNA, 50 bp, homo sapien
acagtgtcatgaaaaatggcatttcmactgtgcttgattgttttgcttct

SEQ ID NO: 112629 - DNA, 50 bp, homo sapien
atgtctaatttaaactcttggaaaayagcgcctttctccatcacaaggcc

SEQ ID NO: 112630 - DNA, 50 bp, homo sapien
tgaattccaaagaatgtgtctaaggmaggttgaacctagtaggtttcttt

SEQ ID NO: 112631 - DNA, 50 bp, homo sapien
ttctttaaaagtgtggcactatcatytactacccattctagagttaaaaa

SEQ ID NO: 112632 - DNA, 50 bp, homo sapien
aagcaaatttggttgtgaagaaataycataattttggaattctcttagag

SEQ ID NO: 112633 - DNA, 50 bp, homo sapien
ttaatggggccattaaggtaggaaastatgggatattagcataaaaagaa

SEQ ID NO: 112634 - DNA, 50 bp, homo sapien
cccgagccagtcaaggtcagaacccraggctcaattttaatcccaagtca

SEQ ID NO: 112635 - DNA, 50 bp, homo sapien
gaaatctaattatgtgccaagcaccrgactaagtacttttcacgttattt

SEQ ID NO: 112636 - DNA, 50 bp, homo sapien
ttaactgggccttaactgcatctcasctcaggcaaatgtttcatccggga

SEQ ID NO: 112637 - DNA, 50 bp, homo sapien
ctggcaactggtgattcacacttggktctccttccaaagcccctcttact

SEQ ID NO: 112638 - DNA, 50 bp, homo sapien
ttatttaatcagtcatctattgaggkatatttacattgtttctaatcttc

SEQ ID NO: 112639 - DNA, 50 bp, homo sapien
taaactggataccacaatttgactakatttgcgtggcctaatcatctttc

SEQ ID NO: 112640 - DNA, 50 bp, homo sapien
aacaaatccagaaggagtgcaattaycaacaccactctccttctgctatt

SEQ ID NO: 112641 - DNA, 50 bp, homo sapien
aatcctaatacgagactgtgttgaamgtaatgaaaaggcctggggtgggg

SEQ ID NO: 112642 - DNA, 50 bp, homo sapien
tgcccagagtttatcttggctttgtrtacttccacggtgttatggtttct

SEQ ID NO: 112643 - DNA, 50 bp, homo sapien
ccttactccatgactgctgtccttgyagaagtgtgtggttagtcaagatg

SEQ ID NO: 112644 - DNA, 50 bp, homo sapien
gatagttaattagaaaggatttgccrgagattagtagaggtgggagcatg

SEQ ID NO: 112645 - DNA, 50 bp, homo sapien
gaagagaatagggagctgcatctgakcacgtaactttgttacagtcatga

SEQ ID NO: 112646 - DNA, 50 bp, homo sapien
tgtttccaaccaagttaaaatgaaarttggatctgtttggaaagtctacc

SEQ ID NO: 112647 - DNA, 50 bp, homo sapien
ccactctcctgctagaggattaagcyaagagtaacatccaaagtaacatg

SEQ ID NO: 112648 - DNA, 50 bp, homo sapien
aaatgataaaaataactttgtatgaygctctaaaataggagttaagcaga

SEQ ID NO: 112649 - DNA, 50 bp, homo sapien
ttctcttctcttttctactatatcawcacttattattcccatctgtctct

SEQ ID NO: 112650 - DNA, 50 bp, homo sapien
tttgcttgttttctggactctttaayctaaggtaatcattaatctatgaa

SEQ ID NO: 112651 - DNA, 50 bp, homo sapien
ttgtgtgtcaactttactgggccatkagtttcccagatcatctgactttc

SEQ ID NO: 112652 - DNA, 50 bp, homo sapien
cgatgtctagtgtagtcatatagcawtgaagtcacaggaaacaatcatta

SEQ ID NO: 112653 - DNA, 50 bp, homo sapien
ccattctgtgtttctggcttggtagyattaaaaagacagcaagaactcct

SEQ ID NO: 112654 - DNA, 50 bp, homo sapien
attctgaaacaaggagttcacaaatmacatgttgagaggaactaaagatg

SEQ ID NO: 112655 - DNA, 50 bp, homo sapien
ttacctggaaatccatagactgaaayagactcacaagaaagagtatttgg

SEQ ID NO: 112656 - DNA, 32 bp, homo sapien
ccatcatgtcagttcartacctagttcttaag

SEQ ID NO: 112657 - DNA, 50 bp, homo sapien
tataaaaatataaaaagctattcatytgaaaacttgaacaaaactaatat

SEQ ID NO: 112658 - DNA, 50 bp, homo sapien
tgtggagcattacttagcagtgggaraagtatactgtataggagggatga

SEQ ID NO: 112659 - DNA, 50 bp, homo sapien
tgtttgtttgtttgtcagtatagaamcatcagtgtcacttacctctctgg

SEQ ID NO: 112660 - DNA, 50 bp, homo sapien
gttctgttgtagcctcctttctctcrtagtcagggttcttggcttctcag

SEQ ID NO: 112661 - DNA, 50 bp, homo sapien
accctggaataaacattgagaagtascagaaattttccatagatttaaag

SEQ ID NO: 112662 - DNA, 50 bp, homo sapien
tccagccattcaatggcctgtccaastctcattagaagtatgggcaaggc

SEQ ID NO: 112663 - DNA, 50 bp, homo sapien
ttctgagagtggttacagtatcccasagcaggcaattgttcttcttccac

SEQ ID NO: 112664 - DNA, 50 bp, homo sapien
atggctgtacagtgtacagccaccakgagcaaggtctgagaaatggcaat

SEQ ID NO: 112665 - DNA, 50 bp, homo sapien
actgaaaatccaaggggactaagaaracatcatcttgggcttaacatgag

SEQ ID NO: 112666 - DNA, 50 bp, homo sapien
aaactattttgctatttccaagtggktatagcaagctggcaaagcctgtc

SEQ ID NO: 112667 - DNA, 50 bp, homo sapien
atggacatgagagctactcctaaaarcaatgaccattggtacaactggac

SEQ ID NO: 112668 - DNA, 50 bp, homo sapien
ctgctatttgtccttggttttgcacmggagattgactgaaaattagtcag

SEQ ID NO: 112669 - DNA, 50 bp, homo sapien
aatgaattaaaatatagatgctagarcttcactcccagagaatccagttc

SEQ ID NO: 112670 - DNA, 50 bp, homo sapien
cacaggccacagctagtaaatggagratctaaactagcaaccgaggcctt

SEQ ID NO: 112671 - DNA, 50 bp, homo sapien
tgatcaaaaatagattaagtcacaasatgcaatgacctgaaggcaggcct

SEQ ID NO: 112672 - DNA, 50 bp, homo sapien
gtcagtattgtcctaaagttatgagmaaattcaaaagaccagaaaatgaa

SEQ ID NO: 112673 - DNA, 50 bp, homo sapien
ctggggattcactcatagttttctaytggaccccaccatgtaggcttctg

SEQ ID NO: 112674 - DNA, 50 bp, homo sapien
gatgtgtcccacatactttgttacaygcaagtagtatttaaaatatattt

SEQ ID NO: 112675 - DNA, 50 bp, homo sapien
ctgcacctccttcctatgtctttggyacagcagtgattgctccattcctt

SEQ ID NO: 112676 - DNA, 50 bp, homo sapien
ggtacgttagctgcctatgatgcaamattttacacttttaaatcgtttct

SEQ ID NO: 112677 - DNA, 50 bp, homo sapien
aagtgtgaaaacgtcagcacactaasaggatggtacagcaagagcctagg

SEQ ID NO: 112678 - DNA, 50 bp, homo sapien
aaaatacatttcctacatctgtccaytgagaaaaactagaacaatgacat

SEQ ID NO: 112679 - DNA, 50 bp, homo sapien
tttgttaaatcagatatgtagcaacyattattttgtcagtgaaatgattg

SEQ ID NO: 112680 - DNA, 50 bp, homo sapien
gcccagctaatctttacattgaccawaagtgctttgcctacatagcactg

SEQ ID NO: 112681 - DNA, 50 bp, homo sapien
ctccatagtctgctggcacttagaaracatttgaagccagaccaattttg

SEQ ID NO: 112682 - DNA, 50 bp, homo sapien
aataaaactttaaacttattattaartggagagcatacagaaaattgtca

SEQ ID NO: 112683 - DNA, 50 bp, homo sapien
agtattgagaggctgttgtggtggasattctattattactgacttgaaat

SEQ ID NO: 112684 - DNA, 50 bp, homo sapien
ttcatcaaaatgttcaatcactggckataaatagtggttctcattgtttt

SEQ ID NO: 112685 - DNA, 50 bp, homo sapien
atcagtgtagtgcaaacaaaggaacmgagacagtcaaagaaccagattct

SEQ ID NO: 112686 - DNA, 50 bp, homo sapien
tatattggaactttaatctgaacaaygatctaggagctcaggcctgagaa

SEQ ID NO: 112687 - DNA, 50 bp, homo sapien
agttaattgatttttttaactttaartcatataggccatgtataacctaa

SEQ ID NO: 112688 - DNA, 50 bp, homo sapien
ccaaaatgggtcattctttcacaackcaaattttgcatgatttatctata

SEQ ID NO: 112689 - DNA, 50 bp, homo sapien
cagagggaaaatggttattctgataytaagtttggataataaatcccttt

SEQ ID NO: 112690 - DNA, 50 bp, homo sapien
gccttattaacataaatagtggatartaaccagcatcttcctaagcaaaa

SEQ ID NO: 112691 - DNA, 50 bp, homo sapien
acggtcattgacttgtactgttaatsaagcatttcccagaaaagaaaatg

SEQ ID NO: 112692 - DNA, 50 bp, homo sapien
aaatgcagaaccaaaggtgagtaatragtgaaaggaccttctaactctaa

SEQ ID NO: 112693 - DNA, 50 bp, homo sapien
tttttatctttctcttaagataaaaygaaagatgctcagctctatgatct

SEQ ID NO: 112694 - DNA, 50 bp, homo sapien
aagactgttgattaatttaaaataaygctgtaggatcagtaataatatct

SEQ ID NO: 112695 - DNA, 50 bp, homo sapien
ccccccaaagtgatgcttcatatacyatatcttgctttaggcagagaaat

SEQ ID NO: 112696 - DNA, 50 bp, homo sapien
tggttgcttttttaacctcaagtcartaactgtgaaagactggacttact

SEQ ID NO: 112697 - DNA, 50 bp, homo sapien
cccaagataaggcaggttcttctggrcactagattaattatctgattttc

SEQ ID NO: 112698 - DNA, 50 bp, homo sapien
tatgcttatctctccttaaggcctakgtctaccttcatgactctaactaa

SEQ ID NO: 112699 - DNA, 50 bp, homo sapien
atatacttcctgataagcagaaagamaattttaagtaatagataaataac

SEQ ID NO: 112700 - DNA, 50 bp, homo sapien
gactttgccacaaaaagttacatcarcagaccatatattaattaggatac

SEQ ID NO: 112701 - DNA, 50 bp, homo sapien
tgactccacaaacttaactccacccsagactgcttttctgaattccagac

SEQ ID NO: 112702 - DNA, 50 bp, homo sapien
tccctgaatatgtaattgggaaagayatattcagcatctggaagaaccct

SEQ ID NO: 112703 - DNA, 50 bp, homo sapien
tttcattttaggatatgaaagaaaasttctctgtctgcctcacacaagct

SEQ ID NO: 112704 - DNA, 50 bp, homo sapien
cattgccccagttcaaacaatattcsacttttacctagactcatgcctgt

SEQ ID NO: 112705 - DNA, 50 bp, homo sapien
acaggatgaaatcattctgaccaccrctcaaactgaaagtcgcatttctg

SEQ ID NO: 112706 - DNA, 50 bp, homo sapien
cacttttacctagactcatgcctgtwaagtttctcattcaacctattcgt

SEQ ID NO: 112707 - DNA, 50 bp, homo sapien
atatctatccatacatctgtctctgwatccatcagtctaccttatcttta

SEQ ID NO: 112708 - DNA, 50 bp, homo sapien
agcattgaaggtgacgtgaaagagayaaaaagaaagagggaatggaccag

SEQ ID NO: 112709 - DNA, 50 bp, homo sapien
aatgactgccaaaaaaaccacaaggscattgcaaaatctccataatacac

SEQ ID NO: 112710 - DNA, 50 bp, homo sapien
attatagttctcaaaggtcaataaayggtgataaaggtatttagagtagc

SEQ ID NO: 112711 - DNA, 50 bp, homo sapien
ctctcctgcctatcagagattaacayggaaaaagattagggatggtagga

SEQ ID NO: 112712 - DNA, 50 bp, homo sapien
tccttaaatgtgatgttctgttcaaygttttaagaaagagctttgtacat

SEQ ID NO: 112713 - DNA, 50 bp, homo sapien
acaggcatgagccaccatgcctggcsatctttaatcttaataacttctct

SEQ ID NO: 112714 - DNA, 50 bp, homo sapien
cagagagggattattagaaatctaasaggagaactgagccagagcagcat

SEQ ID NO: 112715 - DNA, 50 bp, homo sapien
aaatattaggaagatatatccatagrcaagaggccaatactcctaatatt

SEQ ID NO: 112716 - DNA, 50 bp, homo sapien
catatttttcatccccaaatcactckataaggtttctacttaattcttct

SEQ ID NO: 112717 - DNA, 50 bp, homo sapien
gcaagaggacaaaaacacttcatcasagaggacaagctctcaggtaacct

SEQ ID NO: 112718 - DNA, 50 bp, homo sapien
taaagttatttacttccttctaggascaagctgtgatttcagtaactgcc

SEQ ID NO: 112719 - DNA, 50 bp, homo sapien
cttaacgtgaaacttgacttgtaaayctaaggaaggatcaagcaaaagat

SEQ ID NO: 112720 - DNA, 50 bp, homo sapien
ctcccaaggcagaccaaccatacagmccatactctttactactacagtga

SEQ ID NO: 112721 - DNA, 50 bp, homo sapien
ttaaaacttttatctctggctctctyaattttgaattaaaccagtcccat

SEQ ID NO: 112722 - DNA, 50 bp, homo sapien
tactttggggttcccagctttcctartaagtctcttcaactctgagttat

SEQ ID NO: 112723 - DNA, 50 bp, homo sapien
gagatttacatggaatacatttttcraagttctaatcccttagtagtata

SEQ ID NO: 112724 - DNA, 50 bp, homo sapien
aataaggcagactgacaaagatatayggaggtctaagttaggaaggaagt

SEQ ID NO: 112725 - DNA, 50 bp, homo sapien
atgggtcacccttcttgcgctgtgasaacaaaaattgtctctaggcattc

SEQ ID NO: 112726 - DNA, 50 bp, homo sapien
aaactttctaagagataagaaaatayaactagtcattggtccactgtgaa

SEQ ID NO: 112727 - DNA, 50 bp, homo sapien
aaaaaagaggtcatgctggaaataartatgtaaagaaacatctcctaaga

SEQ ID NO: 112728 - DNA, 50 bp, homo sapien
tgtttcagaggaatggtaactacatygtctgaaaggaagtagttatttct

SEQ ID NO: 112729 - DNA, 50 bp, homo sapien
ctccaggggcagggcaaacaggcttsaaaattaaagctggcactgttact

SEQ ID NO: 112730 - DNA, 50 bp, homo sapien
ctgttttttttttccatgcaatctgraacatcttaaataacatgtcatac

SEQ ID NO: 112731 - DNA, 50 bp, homo sapien
acaaagaaatctgttctctcactgcyactaatttagagctttcaatatcc

SEQ ID NO: 112732 - DNA, 50 bp, homo sapien
agaaacaacactaggtggaaactagsaaagatcatgaggcatctgaactg

SEQ ID NO: 112733 - DNA, 50 bp, homo sapien
cgactggagaaatcctacaatgttargtttggaaagaatgttagaggcaa

SEQ ID NO: 112734 - DNA, 50 bp, homo sapien
tccttttctctcatagcactctccaygaatctatcttgaccctcaaacca

SEQ ID NO: 112735 - DNA, 50 bp, homo sapien
tccactaataacttgtggataatgckatttagttgtctacaaagagtgtg

SEQ ID NO: 112736 - DNA, 50 bp, homo sapien
ggcagcaacctggaaggtcatccatkaattcttgctacctgtatcccaca

SEQ ID NO: 112737 - DNA, 50 bp, homo sapien
tcaatgattctttagcgatatctaawctaattccctcttttacatattag

SEQ ID NO: 112738 - DNA, 50 bp, homo sapien
tcattgtggcatttctttagctgaaytggttgaaattggacctctacagt

SEQ ID NO: 112739 - DNA, 50 bp, homo sapien
taataaattcatcaaagctgtagtayatgatcaacacagaaatcgtatat

SEQ ID NO: 112740 - DNA, 50 bp, homo sapien
agactgggagattaaaagtgctaaayatgcatgacttgactaataactaa

SEQ ID NO: 112741 - DNA, 50 bp, homo sapien
aaatattttataaatctctttcatcmagatatggaagtttcccatttctt

SEQ ID NO: 112742 - DNA, 50 bp, homo sapien
ggtgaagcttgtcgctttcctcacartgctgtgcttcatcttgatagtgc

SEQ ID NO: 112743 - DNA, 50 bp, homo sapien
ttctgtatgtgtgttgtgaattataratctggcttttcctacaaatgtgg

SEQ ID NO: 112744 - DNA, 50 bp, homo sapien
taaaggagttgtattagcttggaatsaaagggacagttgctatataaaag

SEQ ID NO: 112745 - DNA, 50 bp, homo sapien
cagaaccatatagtgtgatttgaaarcttccagagattaaggctattatg

SEQ ID NO: 112746 - DNA, 50 bp, homo sapien
tgactttacattgtgcttttttttcraggacaaataatgattctgaaaca

SEQ ID NO: 112747 - DNA, 50 bp, homo sapien
ataaatgctgaagctgatgccacackgaaattttattttatttatttatt

SEQ ID NO: 112748 - DNA, 50 bp, homo sapien
aaaaataaaagccctgaacctggcaygatgtttcaactaaagtacaaatg

SEQ ID NO: 112749 - DNA, 50 bp, homo sapien
aagggagattagtggtcacttctaarcaagaatgaagagtttaatttcaa

SEQ ID NO: 112750 - DNA, 50 bp, homo sapien
tgtttagtagattcactttgggaaayaaacactacaccaaaccatgtcac

SEQ ID NO: 112751 - DNA, 50 bp, homo sapien
tacaattgcttttggagacttagccrtaaattatttaccaaagctgatgt

SEQ ID NO: 112752 - DNA, 50 bp, homo sapien
ccttgccttattcatttatggcttarcaatgatgcatctgaaggcaccaa

SEQ ID NO: 112753 - DNA, 50 bp, homo sapien
acttcaatttctaataacagtgcaawgggaaataatcattttcccctgcc

SEQ ID NO: 112754 - DNA, 50 bp, homo sapien
gttgggccctgcttaccctatgagartaatgtagactttggcactagcca

SEQ ID NO: 112755 - DNA, 50 bp, homo sapien
tattatccaaacaacatacccaaacmataggatccaacaatagtggggag

SEQ ID NO: 112756 - DNA, 50 bp, homo sapien
catatggtattcctaataaagagatwagataggaagaacgagaggtattt

SEQ ID NO: 112757 - DNA, 50 bp, homo sapien
attccaaatataaaactatgttacaytgaaagacacccctcccaagagat

SEQ ID NO: 112758 - DNA, 50 bp, homo sapien
cattaatgaaaggaaatgtccataayatgaattaatactgcccaggtgtc

SEQ ID NO: 112759 - DNA, 50 bp, homo sapien
aatcattaaacatctttgggtagcastaggatggtactagagatgcaggc

SEQ ID NO: 112760 - DNA, 50 bp, homo sapien
cagtctctgttaaatttatccgatarcatactgaaatccttgtctgtgat

SEQ ID NO: 112761 - DNA, 50 bp, homo sapien
aaggagtaacaggcttatatgtcaartgattgcaaagaaagcagctttta

SEQ ID NO: 112762 - DNA, 50 bp, homo sapien
cataacaagccactccaaaacataayggctaaagccacaaaaatttacta

SEQ ID NO: 112763 - DNA, 50 bp, homo sapien
aaacatgcaatgcgacatccagctcratctttgtacagtactgcatcccc

SEQ ID NO: 112764 - DNA, 50 bp, homo sapien
gacctcaatggaggtttgcaaagacygagtgttcaaactactgtacattt

SEQ ID NO: 112765 - DNA, 50 bp, homo sapien
gaagaaaattttggtcaactggtacrcaatgggctcataaaaagctacaa

SEQ ID NO: 112766 - DNA, 50 bp, homo sapien
gatgatgtttaaaagagtcaagtaayataaagtaagctaagcgaagtcct

SEQ ID NO: 112767 - DNA, 50 bp, homo sapien
tttggaaggccagaattacatttcascatatacgcatttcactatattgt

SEQ ID NO: 112768 - DNA, 50 bp, homo sapien
actctaaagatgctttgggacaatcmaattgagaaataatagcaagatag

SEQ ID NO: 112769 - DNA, 50 bp, homo sapien
tatttgacactcattctgaagagtaytacgttcgacttttaaaaactatc

SEQ ID NO: 112770 - DNA, 50 bp, homo sapien
atgaaaagaacccaatgtagaagatsaattagatttttgaacaggacaat

SEQ ID NO: 112771 - DNA, 50 bp, homo sapien
tctcctggaaggcagtttagtagacrctctcaagcaactctaagttaccc

SEQ ID NO: 112772 - DNA, 50 bp, homo sapien
gaggaagaacttttatagagaaaacrctgtattggttaatttatgtgatt

SEQ ID NO: 112773 - DNA, 50 bp, homo sapien
gattatgttcaatgagatatatatamgatagcatcaataaacattagttc

SEQ ID NO: 112774 - DNA, 50 bp, homo sapien
ggagtaggagaaacaggctagtgctmaaagcaaagtgaaaggctgacaga

SEQ ID NO: 112775 - DNA, 50 bp, homo sapien
acgacattcaaaaccctttataagayaactgatcctatcatgccactcct

SEQ ID NO: 112776 - DNA, 50 bp, homo sapien
acctttgggtgtagtttttcatttaycagcgtgttctccagaggtaccct

SEQ ID NO: 112777 - DNA, 50 bp, homo sapien
gcctagactgaatagaagagtgttaygatgatgagaaagcaaaatcttta

SEQ ID NO: 112778 - DNA, 50 bp, homo sapien
catttggaacatagacattatagatsacaggcatgttttcttaatcacta

SEQ ID NO: 112779 - DNA, 50 bp, homo sapien
accagtaatcctctccggaaaaaccmatagctgtcagctcccttggaaaa

SEQ ID NO: 112780 - DNA, 50 bp, homo sapien
accccaaagggcataatttggttgamtatctatagctgatgatgcctggg

SEQ ID NO: 112781 - DNA, 50 bp, homo sapien
tacagctagatcattttggggtcagrctccattgattttttctttgtatt

SEQ ID NO: 112782 - DNA, 50 bp, homo sapien
tatgagcctttctgtgtaatatagargattccattgtctcatctagagat

SEQ ID NO: 112783 - DNA, 50 bp, homo sapien
ccctgatgaaaaaaacagtatggaaygattcttggcaaattctgaatacc

SEQ ID NO: 112784 - DNA, 50 bp, homo sapien
atgggatcctggagtatggcatctayattgaagagtgattccactcagag

SEQ ID NO: 112785 - DNA, 50 bp, homo sapien
caagcattactgctatcagtcttcakatttcagtggttaagttgatcttc

SEQ ID NO: 112786 - DNA, 50 bp, homo sapien
ctggttcccaacactagctgcatatrtaatcctgtgaaagccttaaaaat

SEQ ID NO: 112787 - DNA, 50 bp, homo sapien
aagttgtactgacatttttggactaygtaagacccaggattttggggata

SEQ ID NO: 112788 - DNA, 32 bp, homo sapien
ggggggtaccatgaatyaaagaataaaggatt

SEQ ID NO: 112789 - DNA, 50 bp, homo sapien
ctctgattcctgaactgtgcctacasaacctgttataatgttttgtagat

SEQ ID NO: 112790 - DNA, 50 bp, homo sapien
ctaatcttttcattatggaaataaartaatcttcaatattatatgtcttc

SEQ ID NO: 112791 - DNA, 50 bp, homo sapien
ccacagttcatttcctctttccataracagaaaactattagtttctcctc

SEQ ID NO: 112792 - DNA, 50 bp, homo sapien
gattacctgactcttagctgaaaagyaaggtaataggcacttataatata

SEQ ID NO: 112793 - DNA, 50 bp, homo sapien
aattcttagagactagtggttccaaragtgaaatcccaagaccagtagaa

SEQ ID NO: 112794 - DNA, 50 bp, homo sapien
gtggtaagttaaaaatacccagggarctttgaccatcccaaagagcagac

SEQ ID NO: 112795 - DNA, 50 bp, homo sapien
actctttgataagcatttcaacagcmgaccctgtcactttttcctctgtt

SEQ ID NO: 112796 - DNA, 50 bp, homo sapien
ttaagagaaaaatatagttaaatagyctatggtaaacaactggatcccaa

SEQ ID NO: 112797 - DNA, 50 bp, homo sapien
ctacttggcttaaaaggtgcttccgmaaggattcttacttgatcttcctt

SEQ ID NO: 112798 - DNA, 50 bp, homo sapien
cctgactatagattcctgaaaggaasagaggccattggaaaagctgaaga

SEQ ID NO: 112799 - DNA, 50 bp, homo sapien
ctgaaaaggaggtatcatcaggcaasttacgctttaggttggaaaagtga

SEQ ID NO: 112800 - DNA, 50 bp, homo sapien
aagaaaagaataaaagccaggaagasacgaaactctttagaaggcatcta

SEQ ID NO: 112801 - DNA, 50 bp, homo sapien
ccctgtggtaagggatctcaagggcraggcgatcttcatagtgtgtgatg

SEQ ID NO: 112802 - DNA, 50 bp, homo sapien
tttatatttccctcaacaatggatgkaagtatcattttctccacactatt

SEQ ID NO: 112803 - DNA, 50 bp, homo sapien
aactcctcttcaagaaaattatacastcagcatgtctccttaactatcca

SEQ ID NO: 112804 - DNA, 50 bp, homo sapien
cgacattcggtctctttaatgaataygtaaagagccacaataaatagaaa

SEQ ID NO: 112805 - DNA, 50 bp, homo sapien
atatcttaattatagtctcagttaarctttatttatagttactgtatcta

SEQ ID NO: 112806 - DNA, 50 bp, homo sapien
tataatcatataatatacttagcaarcttacatatttgtattatgatttg

SEQ ID NO: 112807 - DNA, 50 bp, homo sapien
gtgaggaggaaggagaagttagcaaytggagacacttaagaaattggaga

SEQ ID NO: 112808 - DNA, 50 bp, homo sapien
tttcaagcgatcacataaagtgacayctatccaactctttttcttcaact

SEQ ID NO: 112809 - DNA, 50 bp, homo sapien
caagtctacacatacactaaatccasaagccaggaagctggtataagcca

SEQ ID NO: 112810 - DNA, 50 bp, homo sapien
cagatttctgcaacatcttcattttmgccacatgagacccatttctgact

SEQ ID NO: 112811 - DNA, 50 bp, homo sapien
gcaccagatcagactctgcactggargcttattggcagacatgctgcacg

SEQ ID NO: 112812 - DNA, 32 bp, homo sapien
gaggactcagaaaatakcttgtgccagtggag

SEQ ID NO: 112813 - DNA, 50 bp, homo sapien
taagaagaagtagactgtgagcttaycctgaaggactagcaggcttcagc

SEQ ID NO: 112814 - DNA, 50 bp, homo sapien
ctatattcctgagtactgagaataartatatgttaagtgaatgaataaga

SEQ ID NO: 112815 - DNA, 50 bp, homo sapien
aggttcaataggcaaacagtataaaktggccaaccagtaaacctgtgtat

SEQ ID NO: 112816 - DNA, 50 bp, homo sapien
gacaacatgcagaggaactgagtcamaaaggaatgtataagaatggcata

SEQ ID NO: 112817 - DNA, 50 bp, homo sapien
caactctgtcttggtaggtcagtaargactttagagagacagaaagtctt

SEQ ID NO: 112818 - DNA, 50 bp, homo sapien
aaaaatccgcctatctaggcttatgmatgttatataataccacagatatg

SEQ ID NO: 112819 - DNA, 50 bp, homo sapien
ctcattgatgttctcagtcgtgtttstctaatgagatgatgttggacatc

SEQ ID NO: 112820 - DNA, 50 bp, homo sapien
gtttccccaataaattctcaactccrtaaaagtagtaaagtacatattta

SEQ ID NO: 112821 - DNA, 50 bp, homo sapien
taaccagacagaactaggaattttasacatggtcgaccattatggtggga

SEQ ID NO: 112822 - DNA, 50 bp, homo sapien
gacaccacaccaaagtatacagatartaaaaaagcatatgaaaagatgtc

SEQ ID NO: 112823 - DNA, 50 bp, homo sapien
gtaaaataactgggaatatgtgaacrcaaagaaatgctctgtcatttgag

SEQ ID NO: 112824 - DNA, 32 bp, homo sapien
gtgtgtgccatgaaaarttctgagaagccctc

SEQ ID NO: 112825 - DNA, 50 bp, homo sapien
gcagtgggagtgaagagggaaaccayaactgttgagactaaggatggaat

SEQ ID NO: 112826 - DNA, 50 bp, homo sapien
tggagtcatcacctggctgagattaygatatccattgacattcttcaaga

SEQ ID NO: 112827 - DNA, 50 bp, homo sapien
gagcatagttttatatactcgtaggycatttgtatatcttcttttgagaa

SEQ ID NO: 112828 - DNA, 50 bp, homo sapien
gcaggtaccgccaaattcatcatggmacccatctgcattgtttgtgtttt

SEQ ID NO: 112829 - DNA, 50 bp, homo sapien
acgcttatcaaaaagaactggggtamgttattcatcaaagttttatcatt

SEQ ID NO: 112830 - DNA, 50 bp, homo sapien
tggcaaatcctgggtaaagctaggakgactgatgtaaattaaagtgataa

SEQ ID NO: 112831 - DNA, 50 bp, homo sapien
gtggaactgtttgtaattcagtatakatgacttatttgaaattttactga

SEQ ID NO: 112832 - DNA, 50 bp, homo sapien
aaaaatgaaatgacagctggaaaaasgaattgaacatccgcactgcctct

SEQ ID NO: 112833 - DNA, 50 bp, homo sapien
ctctagacacactgcctgagatagamgtttgcatcttattggctgtgggc

SEQ ID NO: 112834 - DNA, 50 bp, homo sapien
tatttttttttaaataagctgggaamaggatcagctaactcaaggaatta

SEQ ID NO: 112835 - DNA, 50 bp, homo sapien
ccttcctgttaagtatcgagtaacaragatgtgatgataaggacagttct

SEQ ID NO: 112836 - DNA, 50 bp, homo sapien
aggaaaaaaaaaaacaatcatggaasagtagtggcttagaaaatgtaagg

SEQ ID NO: 112837 - DNA, 50 bp, homo sapien
taaagggatttcatttcaagcatcaytgagttgtgaaggtaaaaattatg

SEQ ID NO: 112838 - DNA, 50 bp, homo sapien
tggccaatactcaggaaaaattgcaygattaataattatattgaattatg

SEQ ID NO: 112839 - DNA, 50 bp, homo sapien
aggctgcagtcatattggatagtaargagcagaaatgggcacatttagaa

SEQ ID NO: 112840 - DNA, 50 bp, homo sapien
gagacaacaacaggtacttaggaackgtataccacgatgctgagaattcc

SEQ ID NO: 112841 - DNA, 50 bp, homo sapien
tcagcttcaaaaggaagatggagtasgtatgcaagttagagactgacaaa

SEQ ID NO: 112842 - DNA, 50 bp, homo sapien
tacacaggcagtgatggtagatatgrctcttttttggcttatacatagtg

SEQ ID NO: 112843 - DNA, 50 bp, homo sapien
ttgataaacatagatgtctaatggcrcttaacctttaaaatgtatgcaga

SEQ ID NO: 112844 - DNA, 50 bp, homo sapien
tattagaactattctctgtgatcaaytgtaccttcattgttgacaaatcc

SEQ ID NO: 112845 - DNA, 50 bp, homo sapien
aagtctgttgaaacaccaggaaatargtaattatatataaatgtgtttta

SEQ ID NO: 112846 - DNA, 50 bp, homo sapien
tgaaacaaatagcattccatcctaascttgtcaaacagaaaaatatattt

SEQ ID NO: 112847 - DNA, 50 bp, homo sapien
atgtacaattcagttggttttcgtaygttcataagattggacagccatca

SEQ ID NO: 112848 - DNA, 50 bp, homo sapien
tagatgtgtatcaaaactgcattgtyaagctgagtaatggactattctat

SEQ ID NO: 112849 - DNA, 50 bp, homo sapien
cagtttcctttagtttctaacttccraaattctcaaacttctccaaactc

SEQ ID NO: 112850 - DNA, 50 bp, homo sapien
tgccccccatgtctcagaggaatacmatttctagccatggcaggggacat

SEQ ID NO: 112851 - DNA, 50 bp, homo sapien
ttaaaacataagtcagaccctatcastcctctactcaaaagcatcctttc

SEQ ID NO: 112852 - DNA, 50 bp, homo sapien
cttgtcacatgaccaggaaggattargaatgaggaaacattgaagggtga

SEQ ID NO: 112853 - DNA, 50 bp, homo sapien
tgagttagggaagtctgatttaaaastatttatgcagcactttactgttt

SEQ ID NO: 112854 - DNA, 50 bp, homo sapien
gtttggaggggagtgtcccacagtamagagacacaatagcatatcagtga

SEQ ID NO: 112855 - DNA, 50 bp, homo sapien
tggatgatgttagtttcgaaacctayagcccataatctggactcagctaa

SEQ ID NO: 112856 - DNA, 50 bp, homo sapien
ccccatagacagcttttgaagagaamataggattcaaaagaagtaaatat

SEQ ID NO: 112857 - DNA, 50 bp, homo sapien
tttatgaaacatcttgctctatctawccactattgttatccacatttttc

SEQ ID NO: 112858 - DNA, 50 bp, homo sapien
catttccctttagtcacactgtttcraactctggaaattccttccatctc

SEQ ID NO: 112859 - DNA, 50 bp, homo sapien
ttgtgaacttaagtgtatcaccaccragttactcattctttttaccagtc

SEQ ID NO: 112860 - DNA, 50 bp, homo sapien
tctaaacacttctctttgaccataayatccaagattacactgttcatcca

SEQ ID NO: 112861 - DNA, 50 bp, homo sapien
gtttcctttgattgccacacaattaycttttgttttacttgtagcttgta

SEQ ID NO: 112862 - DNA, 50 bp, homo sapien
acctccaaaggtgcttaatgaaaaaygagaaggtgtgaatgttatgatct

SEQ ID NO: 112863 - DNA, 50 bp, homo sapien
tggaggtgtttgtgagagaagattaygatttgctttttaaatacaactat

SEQ ID NO: 112864 - DNA, 50 bp, homo sapien
gatttttttaccttcttatactgtaygcatagatttagtggaagctgcca

SEQ ID NO: 112865 - DNA, 50 bp, homo sapien
tgctctgggatatttttgtcaattaygtaaaatgagtaaaaattttaagg

SEQ ID NO: 112866 - DNA, 50 bp, homo sapien
cagtctattaacattagatcataccstgtttgtcctatcatatttctaca

SEQ ID NO: 112867 - DNA, 50 bp, homo sapien
ccattcgtcatcttttagtttcacayggttccattggttccagtcactga

SEQ ID NO: 112868 - DNA, 50 bp, homo sapien
taatttcttagagtctgggattcaargtaacattagatgtcagaagcaag

SEQ ID NO: 112869 - DNA, 50 bp, homo sapien
atccagagctttaagtattgaacctraagaagcctgtggtgccatttatc

SEQ ID NO: 112870 - DNA, 50 bp, homo sapien
tgcaatatctgatacttaatacacaratatatgcagttattgacctaaat

SEQ ID NO: 112871 - DNA, 50 bp, homo sapien
tgcaaagagaccacattgtaacaaawggttcaggtggaaaatggtggaat

SEQ ID NO: 112872 - DNA, 50 bp, homo sapien
agatctaaagtacaagaaatatctayggaaactctgcaagataaaatcaa

SEQ ID NO: 112873 - DNA, 50 bp, homo sapien
gtttgtattatattcaggactgaaaygttatgtaactttaagcaaacaac

SEQ ID NO: 112874 - DNA, 50 bp, homo sapien
agaacctcccatattacttagtctasgctttgcttttggattccttctag

SEQ ID NO: 112875 - DNA, 50 bp, homo sapien
agatttcagttttaatcagtgtctartctgatgttaaacttgtcttctga

SEQ ID NO: 112876 - DNA, 50 bp, homo sapien
taaaggagacaatttatttagtgtayagatagcatatggtgcacattttc

SEQ ID NO: 112877 - DNA, 50 bp, homo sapien
gatgtattaatcctgtgtaacaaagscaatatattaatacgtgatcaaag

SEQ ID NO: 112878 - DNA, 50 bp, homo sapien
tagttttgagtcctgcctctacttarccatgtaaattaacagtcttctcc

SEQ ID NO: 112879 - DNA, 50 bp, homo sapien
gaacttaataatggcaggagaggaartacaattaacaggtttaagtaaaa

SEQ ID NO: 112880 - DNA, 50 bp, homo sapien
tcccctattgcaatagccctaaatartatcttacttgcctgttcaacttt

SEQ ID NO: 112881 - DNA, 50 bp, homo sapien
aaaggtatttcttagttgagtcctcygaatgaaaaggccagaaaagtcac

SEQ ID NO: 112882 - DNA, 50 bp, homo sapien
ggaaaaccaagaagaactctaagtayataaattcaacaacataaatttgg

SEQ ID NO: 112883 - DNA, 50 bp, homo sapien
taagccttaaaaaactattcataaargttgtcatcataatggattaaaaa

SEQ ID NO: 112884 - DNA, 50 bp, homo sapien
cacattactttttttttacttttacrattatgtgaggtgaatccttttta

SEQ ID NO: 112885 - DNA, 50 bp, homo sapien
tcaaaaattgtggcttttggtcatgrattatcaagtacaacaaggtgttt

SEQ ID NO: 112886 - DNA, 50 bp, homo sapien
taattaaatggtgcttctctttagtsaacatgaggtttttttctggaatc

SEQ ID NO: 112887 - DNA, 50 bp, homo sapien
gtggttagagcacagtgtggctttakacattttaaggagacacgaggcat

SEQ ID NO: 112888 - DNA, 50 bp, homo sapien
agaacaacaaaaaaatgtgtggatayggagttttagggatacttggttag

SEQ ID NO: 112889 - DNA, 50 bp, homo sapien
ggcaaaagtacctaaggttcaggaamgacataatgtggaattacaggctt

SEQ ID NO: 112890 - DNA, 50 bp, homo sapien
tccacaaatttatcttctactatacyattttttctctttggttttatcca

SEQ ID NO: 112891 - DNA, 50 bp, homo sapien
cccttacccgatgttcaccataacaktgttgggcttcctgggctgggtgt

SEQ ID NO: 112892 - DNA, 50 bp, homo sapien
catgctaggcacaatgctaaagtaayacccttctattatctgagtcccat

SEQ ID NO: 112893 - DNA, 50 bp, homo sapien
ctatgaacaaaaacgtgtttagaggycattcaccagagccctgcaatcag

SEQ ID NO: 112894 - DNA, 50 bp, homo sapien
ttaactgatgcaagataaaatgtaakgatactgattataatcagcaaaga

SEQ ID NO: 112895 - DNA, 50 bp, homo sapien
taaatgtggccagttaatggtagacmagaacaagtccagggctccaaatg

SEQ ID NO: 112896 - DNA, 50 bp, homo sapien
ataagtcaattttttaaagctgcaartggtttaagacacctagaaatgcc

SEQ ID NO: 112897 - DNA, 50 bp, homo sapien
aatatgtatgcacttatgtactttarggagtattagatttctcacaccaa

SEQ ID NO: 112898 - DNA, 50 bp, homo sapien
gataatccaattatcctgttcactamgtgtttacatatctttcacacctg

SEQ ID NO: 112899 - DNA, 50 bp, homo sapien
cttctgctggtgtaatgtgggaagaktctcacttgttaattatattgtgt

SEQ ID NO: 112900 - DNA, 50 bp, homo sapien
ttttacaggtaatacattatttgaaytgatattgaataaaagtatgatgt

SEQ ID NO: 112901 - DNA, 50 bp, homo sapien
atgattccaggatcttgtatgctcartattaacgaagctaaagtccatag

SEQ ID NO: 112902 - DNA, 50 bp, homo sapien
agtttacatcatcaaaaactgctcasgttggcatattttctactccttaa

SEQ ID NO: 112903 - DNA, 50 bp, homo sapien
ctgtagccatctttggtagttagtcragagaattccaacggctcaggaag

SEQ ID NO: 112904 - DNA, 32 bp, homo sapien
gacaaaaactattagayatggagattaagaaa

SEQ ID NO: 112905 - DNA, 50 bp, homo sapien
aaactaccatctctgggggtaagaaycatgtctatgtatactttaaagct

SEQ ID NO: 112906 - DNA, 50 bp, homo sapien
ttatatagacaatttattcagctaarctattccaatgtgtaacagtaaca

SEQ ID NO: 112907 - DNA, 50 bp, homo sapien
caccgatttctttggcttgtttgtcmcactgtatagctgtctcatagcca

SEQ ID NO: 112908 - DNA, 50 bp, homo sapien
ttgggaaatagccttggctcttcttmgatgagacccaatgcaagtgcaac

SEQ ID NO: 112909 - DNA, 50 bp, homo sapien
acatttgcatgaattactggaaataygtgaaatctctgatacattttaca

SEQ ID NO: 112910 - DNA, 50 bp, homo sapien
acaaaaaaagctacaggtattgctakgttgataattcattcacataattg

SEQ ID NO: 112911 - DNA, 50 bp, homo sapien
gtagtgagtccaataaggtgaaaagraactttgtgaagaaagggagcttt

SEQ ID NO: 112912 - DNA, 50 bp, homo sapien
cagattttttttttctgattcattamaggtaggcaataacatgaacctaa

SEQ ID NO: 112913 - DNA, 50 bp, homo sapien
acaggcagctcaggtaagagaaaaasaatatcaagtagctggaaaatggc

SEQ ID NO: 112914 - DNA, 50 bp, homo sapien
tagataaggtttctcatctacaaaamtaggtaggtagttatatgctaact

SEQ ID NO: 112915 - DNA, 50 bp, homo sapien
gacatctttgaataaaacttctccaygatctttcattctcacaatctgaa

SEQ ID NO: 112916 - DNA, 50 bp, homo sapien
agtacctgtttttggaattaaagagmaaaatgaataactgtttggtccat

SEQ ID NO: 112917 - DNA, 50 bp, homo sapien
aagtttatgccctaaaagaagctaaygcatggtctttggaacaaacccag

SEQ ID NO: 112918 - DNA, 50 bp, homo sapien
ccttctttatttcctaattcctacaktgattctacagagaaaccctcatt

SEQ ID NO: 112919 - DNA, 50 bp, homo sapien
aaacccagagcatacaatggaaggaragtttatataatttctacaatgag

SEQ ID NO: 112920 - DNA, 50 bp, homo sapien
tttcagattattgacattgcttttaygacttagaaggaggtcataaaaga

SEQ ID NO: 112921 - DNA, 50 bp, homo sapien
tatggtcctataatgttaggtcctamaatggtgttaccgatgttgctgaa

SEQ ID NO: 112922 - DNA, 50 bp, homo sapien
ggtgatatattaattaattgacaacraatggtacaagcaatacatagcat

SEQ ID NO: 112923 - DNA, 50 bp, homo sapien
gctgcaagctatcttcttgaaccacrgtactcatcatcctatactgctca

SEQ ID NO: 112924 - DNA, 50 bp, homo sapien
acccacttaacccttctgcagtcacrcaatgatgattaatggctgtttca

SEQ ID NO: 112925 - DNA, 50 bp, homo sapien
gcaaaatggagttgataccaaaaaamgctagatgtcaaagtaaaatattt

SEQ ID NO: 112926 - DNA, 50 bp, homo sapien
ttcatcagactgacttacatgaccaraaggtttcatttgttatttttttt

SEQ ID NO: 112927 - DNA, 50 bp, homo sapien
ctctctgaagcttccgacatcttttsaaaacctccttaaaacacttccat

SEQ ID NO: 112928 - DNA, 50 bp, homo sapien
aataattaaaattataaccaaggcaraaattcttgattaaataagcaatt

SEQ ID NO: 112929 - DNA, 50 bp, homo sapien
gatagtttctcttttatttatcagasagcataaagtttttcattactata

SEQ ID NO: 112930 - DNA, 50 bp, homo sapien
agttaagcagtttaaaatcaaacacygaggctatgtaatcgttacatatg

SEQ ID NO: 112931 - DNA, 50 bp, homo sapien
aggtgatcacaagctttctataccastgacattgatttgatatttttaaa

SEQ ID NO: 112932 - DNA, 50 bp, homo sapien
gggtaaatcatgatactgcaaagaaractagcataaggaagatttaaaat

SEQ ID NO: 112933 - DNA, 50 bp, homo sapien
cttggacacctgaaagcatcccttaygttcttttagcaatttcagtatat

SEQ ID NO: 112934 - DNA, 50 bp, homo sapien
ctaacaatatgattgtaacaaggatkatgtaattttgtatagtggcccag

SEQ ID NO: 112935 - DNA, 50 bp, homo sapien
cagtacactaaggaattcctagagasaaatagcttatttctttaaagact

SEQ ID NO: 112936 - DNA, 50 bp, homo sapien
atttgtatgttactttctcacagtcragcagtattgatacatttattttt

SEQ ID NO: 112937 - DNA, 50 bp, homo sapien
atatattataactaaactgttgaatkacaaagatggagaaaataataaaa

SEQ ID NO: 112938 - DNA, 50 bp, homo sapien
aatgtgtttgatgtgtttctcatgaytagaatttggttatgagtattggg

SEQ ID NO: 112939 - DNA, 50 bp, homo sapien
aagttaggcatgaaagagaggacatygctactattattacagaaataaaa

SEQ ID NO: 112940 - DNA, 50 bp, homo sapien
taattttgggtactggagcgtgatayaacaattaaaatttaatttggtca

SEQ ID NO: 112941 - DNA, 50 bp, homo sapien
taggtttttctgtgagtaaaaatgaycctttagagacagagagattgaag

SEQ ID NO: 112942 - DNA, 50 bp, homo sapien
tcttattgtactaatatatggaaacrcaggtctcttaatcttgaatattt

SEQ ID NO: 112943 - DNA, 50 bp, homo sapien
atcatttgtctcatcataatcaaaayttccataactcaactaattattga

SEQ ID NO: 112944 - DNA, 50 bp, homo sapien
taatcaatggtatatgggaatttcartaagtcaataattagttgagttat

SEQ ID NO: 112945 - DNA, 32 bp, homo sapien
ataattacaaaactcamaataaatctatattt

SEQ ID NO: 112946 - DNA, 50 bp, homo sapien
atatcaagactcaggttggggattakctctctcaggacatttttgccagt

SEQ ID NO: 112947 - DNA, 50 bp, homo sapien
tttggagcacatttcatggagatttktgagtaacagggcataagagaatc

SEQ ID NO: 112948 - DNA, 50 bp, homo sapien
ttacaccaagttcggcttatctaatrcgttgggtggtacaagagttaatg

SEQ ID NO: 112949 - DNA, 50 bp, homo sapien
ttgctgttaaacgatgctaactaaaygaattctgctcttttcagaaaata

SEQ ID NO: 112950 - DNA, 50 bp, homo sapien
agtgacatctttctatgtaacaatarcgcaattttattatttaaatctat

SEQ ID NO: 112951 - DNA, 50 bp, homo sapien
cccaatttgatattgacaactgataygtatagtgggacatttatttctta

SEQ ID NO: 112952 - DNA, 50 bp, homo sapien
ttcaatattaaaatcctatttcaaasagaggttaatcaaagctgaagact

SEQ ID NO: 112953 - DNA, 50 bp, homo sapien
ggattgtaatgatcagcctaagtgastacaatttataccagtggttctaa

SEQ ID NO: 112954 - DNA, 50 bp, homo sapien
tttataaaatgtttatcctcctcatsatctaatttgtttcctgccgctga

SEQ ID NO: 112955 - DNA, 50 bp, homo sapien
aactttaaaatgctgaccgaagaatyataaactatgtctaccagtttcct

SEQ ID NO: 112956 - DNA, 50 bp, homo sapien
ctatgtacaaaagcgtgggtatgacsaaggaaactaacaaggggcttgca

SEQ ID NO: 112957 - DNA, 50 bp, homo sapien
ataatggtcatggatatagcctctamaaactagaaaaataatttaatttc

SEQ ID NO: 112958 - DNA, 50 bp, homo sapien
tgaaagtaaaggaggtaaatctcggwaagttgacttctgccaagcaagac

SEQ ID NO: 112959 - DNA, 50 bp, homo sapien
ctgggaggtggaagccagcatgtagwaattctaaatccaatccatgattt

SEQ ID NO: 112960 - DNA, 50 bp, homo sapien
aagtaggaatggagaataaagtatcmaagaaaaaatattaaagtggaaaa

SEQ ID NO: 112961 - DNA, 50 bp, homo sapien
aattcctaagtcttcaccgtggaccyttcatgttaatcccatagcaccct

SEQ ID NO: 112962 - DNA, 50 bp, homo sapien
agccacagcaggtgttatctcatcaycttagtctattacacatatgctta

SEQ ID NO: 112963 - DNA, 50 bp, homo sapien
agtttaataagctgtagaaatgtacsaggtaatcatcaatataacagctg

SEQ ID NO: 112964 - DNA, 50 bp, homo sapien
taaattcaagcaataaaacataccamtaaatgtgtctcatgctgtgttag

SEQ ID NO: 112965 - DNA, 50 bp, homo sapien
tttatttagatttgtatagttactaycattgcattttaagctgtttaatt

SEQ ID NO: 112966 - DNA, 50 bp, homo sapien
atcacaaaggataagttgggacttargaaaatgttgtgtgtttttattaa

SEQ ID NO: 112967 - DNA, 50 bp, homo sapien
gaagtttagagtcactttcctatcayctacttcctttaatttctaagact

SEQ ID NO: 112968 - DNA, 50 bp, homo sapien
ctcttttgatcaacaccattgaataraagcaataataagcagacacttac

SEQ ID NO: 112969 - DNA, 50 bp, homo sapien
ttcatcccatgtatcctggcagggcrattcctgtagtggaagcagctttt

SEQ ID NO: 112970 - DNA, 50 bp, homo sapien
ttcaaaattatgtttaaagaaagcasatatttatacatgtcccattgaat

SEQ ID NO: 112971 - DNA, 50 bp, homo sapien
gaacgattatatttatactttcctgrcactaaacatgcatgtgtattgca

SEQ ID NO: 112972 - DNA, 50 bp, homo sapien
ggttcatccacttaatgaatgaataytgaccatgtgctccgagccagaca

SEQ ID NO: 112973 - DNA, 50 bp, homo sapien
gaactgaagaacccttgggccatgaytgaacatcagcactagccaggcag

SEQ ID NO: 112974 - DNA, 50 bp, homo sapien
gtagttttcttcaggaatgggaatawtgtgatgaaaacaaggatcagata

SEQ ID NO: 112975 - DNA, 50 bp, homo sapien
cctctttgctctcagagcacattaaytgcaactcaaccatagcacatatt

SEQ ID NO: 112976 - DNA, 50 bp, homo sapien
ccagaataataaaatctcaaacccaygcttttcaaaaatagattaatgta

SEQ ID NO: 112977 - DNA, 50 bp, homo sapien
tgctctggattcaaatccaagttackataaatacctaagtctcatgctaa

SEQ ID NO: 112978 - DNA, 50 bp, homo sapien
attctttcaaatgatcaaatattccrtgagtgttccaattaatttatgta

SEQ ID NO: 112979 - DNA, 50 bp, homo sapien
tttcaggatgatcatatacacaccastctcaggaaagccagttttataat

SEQ ID NO: 112980 - DNA, 50 bp, homo sapien
ttccctcaccaattcttcatgcatgyaaagtcatctttataaagcacaga

SEQ ID NO: 112981 - DNA, 50 bp, homo sapien
ggtgtttaggtgggtgctccttaaasaatgcatggttttcataactttct

SEQ ID NO: 112982 - DNA, 50 bp, homo sapien
ttttgcttgctattatctacttataygctgaatccaggtaatgggatgac

SEQ ID NO: 112983 - DNA, 50 bp, homo sapien
aatcagagttgcaggtgaatggtcaygctttaaatggaaaactgagccag

SEQ ID NO: 112984 - DNA, 50 bp, homo sapien
gggaaaataagtgtgtgtaaatacartgctttaatgatgatgatgtaatt

SEQ ID NO: 112985 - DNA, 50 bp, homo sapien
aggaaatatttgcattgaggaacaarattgatttaaaatatggaattctt

SEQ ID NO: 112986 - DNA, 50 bp, homo sapien
tccttgagttgaacagcatctctccrattacaccttgcaatatctacttg

SEQ ID NO: 112987 - DNA, 50 bp, homo sapien
tgaattatagagagtcataatatggmatgtaaggtatagtgcattctggc

SEQ ID NO: 112988 - DNA, 50 bp, homo sapien
ttccacttagctagaaaaaccctgcrtctatgagctttacctattgtact

SEQ ID NO: 112989 - DNA, 50 bp, homo sapien
attaacactttcacgtaacgtctttygatgccacattgtcctattagctt

SEQ ID NO: 112990 - DNA, 50 bp, homo sapien
atacagcaactagagtgacaggatcyaggacaatgactactcaaggctgt

SEQ ID NO: 112991 - DNA, 50 bp, homo sapien
acttgctgaataccagacttgaaatyagcactattaggacaagataaagt

SEQ ID NO: 112992 - DNA, 50 bp, homo sapien
aaaagcccacccaatccacagtctcyataattatcattgtccccatacca

SEQ ID NO: 112993 - DNA, 50 bp, homo sapien
ggccagtttcaaatttaatgaaaagycttccaggatgggatgagtataag

SEQ ID NO: 112994 - DNA, 50 bp, homo sapien
ttataaaatgagttctactgcaacartattttaggataataccagagatg

SEQ ID NO: 112995 - DNA, 50 bp, homo sapien
tgtaaatcaaaagcctttaaagttayggatcctgatgattcacaaggtaa

SEQ ID NO: 112996 - DNA, 50 bp, homo sapien
ccaaaactacaggaatagaagattaytaaaagtctggaaaatgtcataaa

SEQ ID NO: 112997 - DNA, 50 bp, homo sapien
gagctcaaaaattccacactctaaargaaagaaatgtaaactgactcatc

SEQ ID NO: 112998 - DNA, 50 bp, homo sapien
ggaattattttttctccagattttcracctgtgcagtgaatatacttgga

SEQ ID NO: 112999 - DNA, 50 bp, homo sapien
atataaagatgcaatatgttcagtgycttgaaataaaactaatccttgaa

SEQ ID NO: 113000 - DNA, 50 bp, homo sapien
ttgactctcatgaggactgtttcaakagcctgatatataatgtcagtagt

SEQ ID NO: 113001 - DNA, 50 bp, homo sapien
aatctatttatcttgtgatctctacyactattttggagtaaaattttttg

SEQ ID NO: 113002 - DNA, 50 bp, homo sapien
atatcactgttggaatacagataaamgacaagctccagtatatctgcatt

SEQ ID NO: 113003 - DNA, 50 bp, homo sapien
atatgtgtttatcaaaaaatgagttraaccaatcaatgcacacgtatctc

SEQ ID NO: 113004 - DNA, 50 bp, homo sapien
tattgaggtaaaattcatataccatraaaataaccatgttaaagtgaaca

SEQ ID NO: 113005 - DNA, 50 bp, homo sapien
ttttcttaagatgggtagtaggatamaatcacaaaaataaacaatatatt

SEQ ID NO: 113006 - DNA, 50 bp, homo sapien
ttacaggaatttaatacctttacatsaatataaaactggcagcacctctc

SEQ ID NO: 113007 - DNA, 50 bp, homo sapien
accacttattggcatgtgaccataarctagtcattgaagctttctgaatg

SEQ ID NO: 113008 - DNA, 50 bp, homo sapien
tttgatcaactcattaaaactattamaaagcaacattccaaatatatctt

SEQ ID NO: 113009 - DNA, 50 bp, homo sapien
catcttttcactttcagcttcaggaygttttcaagactggtatctgtttg

SEQ ID NO: 113010 - DNA, 50 bp, homo sapien
ctcaagattagaacatatgcggaatsagctttccttttaaatgtaagtaa

SEQ ID NO: 113011 - DNA, 50 bp, homo sapien
ctccaagacattagaatattttcaartaactccatggtgttccagaacaa

SEQ ID NO: 113012 - DNA, 50 bp, homo sapien
ggtatggaaaatacgtataaggtccmaaatcacacttttgatcatagaat

SEQ ID NO: 113013 - DNA, 50 bp, homo sapien
ttgaattccgaaattaactttctatyataagaacaagggtgtgtaaacac

SEQ ID NO: 113014 - DNA, 50 bp, homo sapien
gtgaagaactaataaaatttctctcytaaacgctggtataattcactagt

SEQ ID NO: 113015 - DNA, 50 bp, homo sapien
attacatcaaaattgccaagacatayactgccaaagattatttaggggct

SEQ ID NO: 113016 - DNA, 50 bp, homo sapien
ctgctataacaaaatatcacactagycatttccacaactggctggcttat

SEQ ID NO: 113017 - DNA, 50 bp, homo sapien
ctccatctctcctgccatcctgccayggtagatagacactcatatataga

SEQ ID NO: 113018 - DNA, 50 bp, homo sapien
ggggctatatatttgggatttatcastaataggttattattcaagctatg

SEQ ID NO: 113019 - DNA, 50 bp, homo sapien
aattcaagtctgcatttggaattatmaatatgagggtcattggcaatttc

SEQ ID NO: 113020 - DNA, 50 bp, homo sapien
caaaaatgggacagtttgaccagcaytataacctatttctccaccagaaa

SEQ ID NO: 113021 - DNA, 50 bp, homo sapien
tcattttgctttttataattcattcraccagtttttatattttaagtggt

SEQ ID NO: 113022 - DNA, 50 bp, homo sapien
tgaaaaagagacccttgattcaatayacagatttgagtcattgagttcaa

SEQ ID NO: 113023 - DNA, 50 bp, homo sapien
tgaagattggattcataaactattayacatttgccaaggtatggaaagaa

SEQ ID NO: 113024 - DNA, 50 bp, homo sapien
agagttttagttagggttagctaatkagaagaacttggatgagatggaaa

SEQ ID NO: 113025 - DNA, 50 bp, homo sapien
ttcattctttctttgcctacagcaastcgccaaaattaccacctcagtgt

SEQ ID NO: 113026 - DNA, 50 bp, homo sapien
tagtcattttacttcagagtattacraaggattcaacaattttagtataa

SEQ ID NO: 113027 - DNA, 50 bp, homo sapien
tgttaatttttcccttgatgtaggasagctattagaatatctttcttggc

SEQ ID NO: 113028 - DNA, 50 bp, homo sapien
catgggcataaaaaaacctgatacayctcattactctcagggggcatcat

SEQ ID NO: 113029 - DNA, 50 bp, homo sapien
attgatgatatattgtaccaatcaastaatgcttaattttagggagactt

SEQ ID NO: 113030 - DNA, 50 bp, homo sapien
agccaatagctcctggtgacagtgcratcaaaaattataagttatattca

SEQ ID NO: 113031 - DNA, 50 bp, homo sapien
gaaacaaacacgtgcatttatgtaawccaagtcaataaaaaaagcatatg

SEQ ID NO: 113032 - DNA, 50 bp, homo sapien
tggatagaatttgggaagaacagaakataagggtgaaactgtggttggtt

SEQ ID NO: 113033 - DNA, 50 bp, homo sapien
agaaactagccatactctacttacckgatactacatcctaggatgacact

SEQ ID NO: 113034 - DNA, 50 bp, homo sapien
aacaaaagtaacattccattttagcmgattaaagataatttagctctttt

SEQ ID NO: 113035 - DNA, 50 bp, homo sapien
cccaaaactcgttggggctaaaacayggctatatgaaaaagttcatgatc

SEQ ID NO: 113036 - DNA, 50 bp, homo sapien
gcaggggcagagccctcataaagaamctttgctggggcagtgaggaaagg

SEQ ID NO: 113037 - DNA, 50 bp, homo sapien
gagtttacagatttgcttgggaaaaktagagtatcataaatgaagcaaaa

SEQ ID NO: 113038 - DNA, 50 bp, homo sapien
gctactcccatttcctttctaatccygactaaatccaagactaacaataa

SEQ ID NO: 113039 - DNA, 50 bp, homo sapien
agatgatgcctcatagaatctttaayctacacaaaagttccactgagaat

SEQ ID NO: 113040 - DNA, 50 bp, homo sapien
gtttctcaaagtaagataaggccaaygtgagataaattcctttgttaaga

SEQ ID NO: 113041 - DNA, 50 bp, homo sapien
cagaagaaaccaacttcaccatttgratcatgatattgaccaagcgttgg

SEQ ID NO: 113042 - DNA, 50 bp, homo sapien
tgaccaagcgttggccaaatataaayggtatatgaaacagatacaagcaa

SEQ ID NO: 113043 - DNA, 50 bp, homo sapien
aattataacttatgacctcagaatayctggcttctatgaagtaatacaca

SEQ ID NO: 113044 - DNA, 50 bp, homo sapien
catcacattattcattgtttcagatsagcatattctctttctagatctca

SEQ ID NO: 113045 - DNA, 50 bp, homo sapien
agtatcactctaataccctgaaccaytgagacacagaacaggcaaggttg

SEQ ID NO: 113046 - DNA, 50 bp, homo sapien
ccctttatttttctttgtatactcaytgacacagccaaacttgtctattg

SEQ ID NO: 113047 - DNA, 50 bp, homo sapien
agggatcaggtatagttcaatcaaayctttgggtccatttctttgtactg

SEQ ID NO: 113048 - DNA, 50 bp, homo sapien
cattctgtctttgtcttagtccgtgmacctttaatctgctttagaatttg

SEQ ID NO: 113049 - DNA, 50 bp, homo sapien
aaaattgaagcttaaatctattaggwaacttgtcaatgaatcaaataata

SEQ ID NO: 113050 - DNA, 50 bp, homo sapien
acattttatgaaagatagtttagaasaaaaaatggtatcacaactaaact

SEQ ID NO: 113051 - DNA, 50 bp, homo sapien
actcaaagtcacacagctaagaaagmaaagatttgagattttgagagagg

SEQ ID NO: 113052 - DNA, 50 bp, homo sapien
tgctgaatctgaatcactgccaaaastatggcctaaaaccatatttgaaa

SEQ ID NO: 113053 - DNA, 50 bp, homo sapien
tgcaaggttccttagtggcagacacragtaaaatccacgtctccagatta

SEQ ID NO: 113054 - DNA, 50 bp, homo sapien
tcacctgaacaccaaaatgccatgcraagtccctgatacttctttttcca

SEQ ID NO: 113055 - DNA, 50 bp, homo sapien
cagcaaagtgctgagttacacccaaygtgcaggtggtcattattcagtcc

SEQ ID NO: 113056 - DNA, 50 bp, homo sapien
tccctagtaaagggcaggggtgagcragtaacaggggcaccagaaatgtt

SEQ ID NO: 113057 - DNA, 50 bp, homo sapien
tttttttttcagttaagaagctgacraagtaattattttgcttgtaggga

SEQ ID NO: 113058 - DNA, 50 bp, homo sapien
gaggcaggagttgctggtagttgaaragaaacaagtagaggccagtgatg

SEQ ID NO: 113059 - DNA, 50 bp, homo sapien
tgctgaagttagaccctacatcccasaatgaatgagtccccattgaattt

SEQ ID NO: 113060 - DNA, 50 bp, homo sapien
tgtgtaatatatgcatgcattctaaraagattgagagggaaattgttata

SEQ ID NO: 113061 - DNA, 50 bp, homo sapien
tttgattctaatgaaaacttacacamagtatatcacacatcatggccaat

SEQ ID NO: 113062 - DNA, 50 bp, homo sapien
accctctatgtgggacagaacaaaaygtattcagaaaatagaagtcatct

SEQ ID NO: 113063 - DNA, 50 bp, homo sapien
gaaatagatgattctgatgattcagmctatttttatgttagttctgttta

SEQ ID NO: 113064 - DNA, 50 bp, homo sapien
ttagaaataacctcaaagtccgttaycagagagaggttggttaaataaat

SEQ ID NO: 113065 - DNA, 50 bp, homo sapien
actagctccttagtactgtgaaagartctaaaccctacctccttattcca

SEQ ID NO: 113066 - DNA, 50 bp, homo sapien
agattcatcttgttcaagaatttgcsaaggattacggagatagcgttcag

SEQ ID NO: 113067 - DNA, 50 bp, homo sapien
tctcttcagtcaaatgagactggccraaatctgatacagtggtttctaag

SEQ ID NO: 113068 - DNA, 50 bp, homo sapien
ctcagaaacatgtgctgaccagtcasatagatgaaccaccaacacaaaat

SEQ ID NO: 113069 - DNA, 50 bp, homo sapien
tttttggacttcatcatattctcaayaacaatcataacagcacattaata

SEQ ID NO: 113070 - DNA, 50 bp, homo sapien
gactccttgcccgatgacgagctcaytaagaagggtctggttcatctccc

SEQ ID NO: 113071 - DNA, 50 bp, homo sapien
cttgttcatttaaaaatagtcactgmatgtcttttgtatgtccggcactg

SEQ ID NO: 113072 - DNA, 50 bp, homo sapien
tccactgaggctttacttgcaaggayagtatacacagcactccctaataa

SEQ ID NO: 113073 - DNA, 50 bp, homo sapien
tggtttacaaaaggggaataaatgasgaatagtgacacatcagttaaaat

SEQ ID NO: 113074 - DNA, 50 bp, homo sapien
agggttttaaaatattctttacatcratgaagcagatttggtcatttcaa

SEQ ID NO: 113075 - DNA, 50 bp, homo sapien
ctaacactgagaatttgcctaccacsatagtttcttgttaactgctttac

SEQ ID NO: 113076 - DNA, 50 bp, homo sapien
ggcatggcatatagctattcaagtaygctatgctgtgtatttccacactt

SEQ ID NO: 113077 - DNA, 50 bp, homo sapien
ttcccctcaggattattagaatttcraagcttggaggagaggccacaagg

SEQ ID NO: 113078 - DNA, 50 bp, homo sapien
agtgttaggcactgaaactacctaartcatgagctggtcatttagtaaat

SEQ ID NO: 113079 - DNA, 50 bp, homo sapien
caggtaagacaggttgtcatcttggracacatgaacatggcagtggagac

SEQ ID NO: 113080 - DNA, 50 bp, homo sapien
aagtaggtggtagcccagggaaaccrgagcaagtggagaagaacagcaga

SEQ ID NO: 113081 - DNA, 50 bp, homo sapien
gggacttcaaagtgcttaaatggcaytctacctatcattaaggtgtttac

SEQ ID NO: 113082 - DNA, 50 bp, homo sapien
cattagtataaagactccagatgtgwaaactgacagtatagatataacct

SEQ ID NO: 113083 - DNA, 50 bp, homo sapien
tttttgagagaggctgaggatttgasaaaggacctcagagagcaccaaaa

SEQ ID NO: 113084 - DNA, 50 bp, homo sapien
tctccctgttctgactctgacaggtmcttaaaaccaagtgaagtatttta

SEQ ID NO: 113085 - DNA, 50 bp, homo sapien
ttgtccattttactacaccacattgmcaatccaaattaggaacctcagaa

SEQ ID NO: 113086 - DNA, 50 bp, homo sapien
agttctgtagcttttaaataacacgyatattttatgacccccaaatttac

SEQ ID NO: 113087 - DNA, 50 bp, homo sapien
cacttaagtcatagtttaaaaatgcraaaagaagccaggcatgtggtgga

SEQ ID NO: 113088 - DNA, 50 bp, homo sapien
ttctgtgttccatctctcactaaaarcgtagagatatactgacaaatgga

SEQ ID NO: 113089 - DNA, 50 bp, homo sapien
aaattctagaaaagtttgggcaatcyaataagagaacaggataacatact

SEQ ID NO: 113090 - DNA, 50 bp, homo sapien
tttgcttttgaaattacatgttaccyagtgactgatgattgaatcattcc

SEQ ID NO: 113091 - DNA, 50 bp, homo sapien
gatccataatgaactttggctgagaygacctgtttacttagcgagccagc

SEQ ID NO: 113092 - DNA, 50 bp, homo sapien
attggcttttccattagcataaaaayggtatgtcaggaatatcagatatt

SEQ ID NO: 113093 - DNA, 50 bp, homo sapien
acaacattggctgcaaagcgtaaagrcatatccctgtgtgaagggccaga

SEQ ID NO: 113094 - DNA, 50 bp, homo sapien
atacaagtttaaaggtgggtaaggastaagcacagagcccaaaagatagt

SEQ ID NO: 113095 - DNA, 50 bp, homo sapien
agggagatgcatcctagaccctgtaygtgcccctccttaggctttctaga

SEQ ID NO: 113096 - DNA, 50 bp, homo sapien
tgattggtaatgtttgtctggtgatsattatttgcctgatgatgctggac

SEQ ID NO: 113097 - DNA, 50 bp, homo sapien
tatgggggacaatatgagctaagtaratatcctgttcatcattaaccttt

SEQ ID NO: 113098 - DNA, 50 bp, homo sapien
gttaacttttgcttaaaacccacgawttgggcagtttgtacataatttag

SEQ ID NO: 113099 - DNA, 50 bp, homo sapien
atcatcatcatctgtctcctgatatraggtactaagaagaacatagcaca

SEQ ID NO: 113100 - DNA, 50 bp, homo sapien
ttttagcttgaagaccctgaatttayagttttgctactgggtaaatccta

SEQ ID NO: 113101 - DNA, 50 bp, homo sapien
tatttttttagtcagtgttgaaggaygtgaatagaagcagttcaatttca

SEQ ID NO: 113102 - DNA, 50 bp, homo sapien
tgcactctcaggaatgtaaactggtrcatctattccagaatgcaaacttg

SEQ ID NO: 113103 - DNA, 50 bp, homo sapien
acctcatcctgaatccttgaactctktgtctgaaagtcaacaggaacatt

SEQ ID NO: 113104 - DNA, 50 bp, homo sapien
atctgtcacaatgcttagcaatgaawgcttaaatgagaaactaagttgaa

SEQ ID NO: 113105 - DNA, 50 bp, homo sapien
ggtaaaccttttgatacagcaacatractcctgagtgttagctcttaaaa

SEQ ID NO: 113106 - DNA, 50 bp, homo sapien
ttagcaaagtaaatgctcagtactayagccaatggagtaggaatttatta

SEQ ID NO: 113107 - DNA, 50 bp, homo sapien
gccaaagatacatgtaaagtgttcawcgtgacactttataaataatgctg

SEQ ID NO: 113108 - DNA, 50 bp, homo sapien
gctgtctatcaaacagtaacttgcayggctcaggaaatagtagatacagc

SEQ ID NO: 113109 - DNA, 50 bp, homo sapien
tctaggaatcttttggaggtcttctytggaattatatcaaaaatacttct

SEQ ID NO: 113110 - DNA, 50 bp, homo sapien
atattcaacaatgaattaaatatgawccttgtccccgataataacacagt

SEQ ID NO: 113111 - DNA, 50 bp, homo sapien
agaacaagcacacagacaaacggaaygcagaaagtgaatatgccatctaa

SEQ ID NO: 113112 - DNA, 50 bp, homo sapien
ttttcatatgtttgttggacattgayattttaagccttttcaaacttaaa

SEQ ID NO: 113113 - DNA, 50 bp, homo sapien
gtaaggtggtcaatttttggaaacaytgtttaggcaacagataagagata

SEQ ID NO: 113114 - DNA, 50 bp, homo sapien
ctccaaatgaagagcagagtcaattraataccctgttctttatcttgctt

SEQ ID NO: 113115 - DNA, 50 bp, homo sapien
gaaagaaagggcaaaagcatagtatygtcattaataaaactaagagtgct

SEQ ID NO: 113116 - DNA, 50 bp, homo sapien
gtaagtcagtttctgtcttcacggakattacagtctattgtgagatttaa

SEQ ID NO: 113117 - DNA, 50 bp, homo sapien
ctgttgacttgctctccttctctctraagtgactatttcaaatcttctct

SEQ ID NO: 113118 - DNA, 50 bp, homo sapien
aggtctgagcatgtacttgttagaawtattctggaaagtgtgtgggggac

SEQ ID NO: 113119 - DNA, 50 bp, homo sapien
atgtggccgcattttctctcttacaygcattctcgttaagtgacgtgaag

SEQ ID NO: 113120 - DNA, 50 bp, homo sapien
aatttctgacctaggactctcctcamaagtatggtatgacccaagtatga

SEQ ID NO: 113121 - DNA, 50 bp, homo sapien
cttgtattcctatgataaccctatcyaattgctcagattttaagttgtca

SEQ ID NO: 113122 - DNA, 50 bp, homo sapien
caaatgcacttcaaatttctttaaamctgaatctcgtaatcaggttggat

SEQ ID NO: 113123 - DNA, 50 bp, homo sapien
aggagcatcttcttcaaagccttcaygcagacgattcctttaaagcctgc

SEQ ID NO: 113124 - DNA, 50 bp, homo sapien
aaagaattctttagtccattcccatmatgattgatatcctaacccttcag

SEQ ID NO: 113125 - DNA, 50 bp, homo sapien
ttgccacctgtccagtatttacagargcaacatgaaaactggggtctttg

SEQ ID NO: 113126 - DNA, 50 bp, homo sapien
ctttttaccttttcatgaaacaggargttcaataacaatagcttgaattc

SEQ ID NO: 113127 - DNA, 50 bp, homo sapien
tttgcccttgagattaattttttaayaagtgccgtgatttcccagttttt

SEQ ID NO: 113128 - DNA, 50 bp, homo sapien
cttaagggttggggcctggacattgyattgtttaaaagcttctccagtga

SEQ ID NO: 113129 - DNA, 50 bp, homo sapien
tagcagcctttctgcccggtgcataycacagagaaaacgacatggacagg

SEQ ID NO: 113130 - DNA, 50 bp, homo sapien
gctagtggggactaagtgcttcactsacaatatagcaggtggtgatgggc

SEQ ID NO: 113131 - DNA, 50 bp, homo sapien
cttgggaaagccatactgcatagtgraaaagaaaatgagtttgaagcaca

SEQ ID NO: 113132 - DNA, 50 bp, homo sapien
gtgaatgatccctgaagacattatgyagtgaaagaggatggtgacaaaag

SEQ ID NO: 113133 - DNA, 50 bp, homo sapien
aggaataaagtactgctacatgctawaatgtgaatgatccctgaagacat

SEQ ID NO: 113134 - DNA, 50 bp, homo sapien
agctggctactctactttcaggcatyaggattgtgtttttgcaagaagga

SEQ ID NO: 113135 - DNA, 50 bp, homo sapien
ggcacaaacatgaacacgttaaggayagcagagaagaaagaaccagtcta

SEQ ID NO: 113136 - DNA, 50 bp, homo sapien
ggaatgtgaacaggatgcaggagtgragaaggctaatagaagagtgactg

SEQ ID NO: 113137 - DNA, 50 bp, homo sapien
gactacactccactatgctacactayacaacttgatacattgttactctg

SEQ ID NO: 113138 - DNA, 50 bp, homo sapien
aaaattctgttgatatactgattgawaaaacaataaactttggatttttt

SEQ ID NO: 113139 - DNA, 50 bp, homo sapien
caatttacaaatagtcacttttgaamctttctcattttagaaaacatttc

SEQ ID NO: 113140 - DNA, 50 bp, homo sapien
tatgagttattattcttgtcaataargcatcataaaataattttattcta

SEQ ID NO: 113141 - DNA, 50 bp, homo sapien
ctctttttactcatactcccttcaakgtatcgggaaattctactgactct

SEQ ID NO: 113142 - DNA, 50 bp, homo sapien
gcttctgcctgctccacgctaaagaraatgatgtacagaactatacttac

SEQ ID NO: 113143 - DNA, 50 bp, homo sapien
tagcggtcattagcaaagtaactaartaaaatacagtgctggtagtcaaa

SEQ ID NO: 113144 - DNA, 50 bp, homo sapien
tacccttccccagcttgctggtatcrccttattcagtattcagttctagg

SEQ ID NO: 113145 - DNA, 50 bp, homo sapien
ctttaaaaaaacatcatttacttttsgtcatgctggatttggggcattcc

SEQ ID NO: 113146 - DNA, 50 bp, homo sapien
tcctgtagattaggcaggtggttagmaaattctgcaagaggtatggcatc

SEQ ID NO: 113147 - DNA, 50 bp, homo sapien
gcactgtcacctaactcccatttgamgtattcatgttcatccaaacaggt

SEQ ID NO: 113148 - DNA, 50 bp, homo sapien
tttgcccctttccatcatcattgaamcctggagagtttagagaagggact

SEQ ID NO: 113149 - DNA, 50 bp, homo sapien
cagatgttaggcctctggttattggycacttttacttgtagaacactgat

SEQ ID NO: 113150 - DNA, 50 bp, homo sapien
aggccacaggaagtatgaagagtacrgaaaaagtaattatattcccacta

SEQ ID NO: 113151 - DNA, 50 bp, homo sapien
tgttctacaggttattatttaaagaytctgtccaaaagatctgaaaacca

SEQ ID NO: 113152 - DNA, 50 bp, homo sapien
atctttcacatcttagttgaatcaaygtcctcagtaatagaaaactgtct

SEQ ID NO: 113153 - DNA, 50 bp, homo sapien
gagacatggaagctgattctgtaaargaaagactggagctagactgtgga

SEQ ID NO: 113154 - DNA, 50 bp, homo sapien
tatcatgggttttacaaggaactttsaaaaagcaggtgtcattatctatc

SEQ ID NO: 113155 - DNA, 50 bp, homo sapien
cctgcacctttcatcatggcagagascgtactctgaagatttacatggga

SEQ ID NO: 113156 - DNA, 50 bp, homo sapien
ttcttcactgcagactaacctcttcycggtcactcttccttgttttgttg

SEQ ID NO: 113157 - DNA, 50 bp, homo sapien
caaagccgcactttctacagtgaacrttgatcacaagattgaaaaccatc

SEQ ID NO: 113158 - DNA, 50 bp, homo sapien
ggagcaaaagtctagtctttcttatyagctcaaggttctcgttgattcga

SEQ ID NO: 113159 - DNA, 50 bp, homo sapien
taaagtttaaagtactgaaatgaaaktatacaaatacattacacatccca

SEQ ID NO: 113160 - DNA, 50 bp, homo sapien
gtaagtgtaatagatagtgttgtagyaatccagataagaaaaggactaat

SEQ ID NO: 113161 - DNA, 50 bp, homo sapien
taattcttggttaacgctttttggaygggctctctgttgctgaggaggag

SEQ ID NO: 113162 - DNA, 50 bp, homo sapien
ttgttcccacttcacttgttcagcamtttcctagctgaatagccttggta

SEQ ID NO: 113163 - DNA, 32 bp, homo sapien
aaattaatttgagaggkatcacaaacttagac

SEQ ID NO: 113164 - DNA, 50 bp, homo sapien
gaagaaatcaaacgaacaggaagcastataatttgctactaaaacaggta

SEQ ID NO: 113165 - DNA, 50 bp, homo sapien
gaaccaattttgagctctccagcgayagagatggtttttctagaaacaga

SEQ ID NO: 113166 - DNA, 50 bp, homo sapien
agccgctggacatggtgtgaggacgragatgaactgcacaaccctgatat

SEQ ID NO: 113167 - DNA, 50 bp, homo sapien
cttttttttaaagtgtaggaatgatwaagctcatcacaaaaactagcaag

SEQ ID NO: 113168 - DNA, 50 bp, homo sapien
tcatgtaaaattgcatgtgtgttgayataaacagaaactttgaaacaaat

SEQ ID NO: 113169 - DNA, 50 bp, homo sapien
gagagcaagaggtttatgcaagtggwagaacaaaatctatatcccagatc

SEQ ID NO: 113170 - DNA, 50 bp, homo sapien
cttacctgccaaatgaatttaggaawgcctatgcacaaagttaggatcac

SEQ ID NO: 113171 - DNA, 50 bp, homo sapien
tctcatatagacctgtagcctcacayctaagcttaagactgacgagttta

SEQ ID NO: 113172 - DNA, 50 bp, homo sapien
tatttttctgctttgttttgtttagsaagcagtatctctgtaataatccc

SEQ ID NO: 113173 - DNA, 50 bp, homo sapien
tgtgggaggtggaaacattggagccyatagttgaatctttggtttcagaa

SEQ ID NO: 113174 - DNA, 50 bp, homo sapien
tcttaaaagaaataatcttataccaygcaagagttaacccatcatgatga

SEQ ID NO: 113175 - DNA, 50 bp, homo sapien
atgcaaattgattaaatctaattaamtgattataaacaaaacagtgcaat

SEQ ID NO: 113176 - DNA, 50 bp, homo sapien
tagatggtgaaggtacaagggaacayataaactgaggataaataggatga

SEQ ID NO: 113177 - DNA, 50 bp, homo sapien
aatttggtaatttctctactttctayccaatctgtttctcttgctttgat

SEQ ID NO: 113178 - DNA, 50 bp, homo sapien
ggaggtgctgcctcccaaacacgatratatctggtctacagtggcaggtt

SEQ ID NO: 113179 - DNA, 50 bp, homo sapien
catacaaccttttatcaagggatacmatttttgacctggggtagaaaatc

SEQ ID NO: 113180 - DNA, 50 bp, homo sapien
acagatgggtcagcacgtgaattggsacgtaaatttgttgccaaaggaat

SEQ ID NO: 113181 - DNA, 50 bp, homo sapien
ggatagattctcagtgttgtgtggcmataatgaaacaaacagtgatggat

SEQ ID NO: 113182 - DNA, 50 bp, homo sapien
tggttgcaggagtcagaagtggttgyacatggttcttttttttcgaatat

SEQ ID NO: 113183 - DNA, 50 bp, homo sapien
tgaaatgatttcaataatatgaatayaggatagccattctgattggataa

SEQ ID NO: 113184 - DNA, 50 bp, homo sapien
cttgaccttatagagtagctaattayacaggaaaaagcgcaaagcatcat

SEQ ID NO: 113185 - DNA, 50 bp, homo sapien
attctttaacttttccacagcaatayagagttagaagaaacctagactgt

SEQ ID NO: 113186 - DNA, 50 bp, homo sapien
ttttaccttgagttcctctgacaaaygtctctcagcattgatattacatt

SEQ ID NO: 113187 - DNA, 50 bp, homo sapien
ggaaattaattaaatagaggcaacarattgggatagtaaacctatttgta

SEQ ID NO: 113188 - DNA, 50 bp, homo sapien
tccagaacctggatgtcctgtgaccrcaaggggcagagccaggtcttggt

SEQ ID NO: 113189 - DNA, 50 bp, homo sapien
tgttggggtatttctgaagggtgtakagggttatcaaacactcttaaaat

SEQ ID NO: 113190 - DNA, 50 bp, homo sapien
actcacacatattctttatgtaaaayggtaggatgctaggagtgagcctt

SEQ ID NO: 113191 - DNA, 50 bp, homo sapien
ttttagtggatgagaaaaaaacttcyattgtattatgtcattgagatttc

SEQ ID NO: 113192 - DNA, 50 bp, homo sapien
acacacctgatccagtcactttcaartaaagcatgtgacaagcccacggt

SEQ ID NO: 113193 - DNA, 50 bp, homo sapien
catatggtgcctttctacaaattagycaaaagaaagtaatggctatgaag

SEQ ID NO: 113194 - DNA, 50 bp, homo sapien
tgatggagtgattcttgagttcttaygagccatttatagtctatcaagta

SEQ ID NO: 113195 - DNA, 50 bp, homo sapien
tgggtttaaaaagtctatattctctwacactgtttttgcttaaagtagga

SEQ ID NO: 113196 - DNA, 50 bp, homo sapien
ttctctctctgtaatacctagtaccrcttttcaataacctcgtggattag

SEQ ID NO: 113197 - DNA, 50 bp, homo sapien
ttaaatgtggactgtgctttgatggrataaactaatgcaaagccttgtcc

SEQ ID NO: 113198 - DNA, 50 bp, homo sapien
aatacctttttatgaaaattgacaasagtgctcctgaaactttactgtac

SEQ ID NO: 113199 - DNA, 50 bp, homo sapien
atcttccaagtcatacttattaccarcaagaatcattggaacatcatcag

SEQ ID NO: 113200 - DNA, 50 bp, homo sapien
actcgaggagtttactccactaacartcttgctccgacatgtgatctttt

SEQ ID NO: 113201 - DNA, 50 bp, homo sapien
ccacaggggttttccatcaagaccartcgggatgtctgtagctccttcag

SEQ ID NO: 113202 - DNA, 50 bp, homo sapien
gttgtccaattcaatagtgccaacaytccaactttgttaaacctaccagc

SEQ ID NO: 113203 - DNA, 50 bp, homo sapien
cagatcctgaactagagataaaattsaaactaggtcagcctgactgtacc

SEQ ID NO: 113204 - DNA, 50 bp, homo sapien
atccaagcttgaactgcaatagcatraaccagtacacattcctaaaatgc

SEQ ID NO: 113205 - DNA, 50 bp, homo sapien
ggtgaaggtcaaagttgcacactagstacagcagagaccttcccactgac

SEQ ID NO: 113206 - DNA, 50 bp, homo sapien
cacatacttttgtacaagcctatcaratatcgagggacaatgatattgga

SEQ ID NO: 113207 - DNA, 50 bp, homo sapien
tttcatgtggtttctaaccacatctsctagaattgacacctgtgcacaag

SEQ ID NO: 113208 - DNA, 50 bp, homo sapien
aggaattcctggttaattaaaaggakaatcaaacattttgaacagtagtg

SEQ ID NO: 113209 - DNA, 50 bp, homo sapien
aagataataggtacaaaatgcctagsaaaatgtacgtacatagtaggttt

SEQ ID NO: 113210 - DNA, 50 bp, homo sapien
gataccaccccctcatccaccagcasgctcttaagtttattttaggctga

SEQ ID NO: 113211 - DNA, 50 bp, homo sapien
ggtaagcacaaggaaaacatttaaarcatcactgaagtctaaaaaaaaac

SEQ ID NO: 113212 - DNA, 50 bp, homo sapien
ttctcaatccctacttctccaacacygtgctctctagcttccctccttcc

SEQ ID NO: 113213 - DNA, 50 bp, homo sapien
tagcgtgttataagtaataactctcrattaaccaaaatagccagttaact

SEQ ID NO: 113214 - DNA, 50 bp, homo sapien
caggcaggatcagcttgtccttttayatgctctggcatctgtttacacat

SEQ ID NO: 113215 - DNA, 50 bp, homo sapien
atttacaagataagcattgatttctsgcactgagtctaacagcagctttc

SEQ ID NO: 113216 - DNA, 50 bp, homo sapien
gcttttttaggaaagaaagaaacaayctctgtgtgagaatcaatatcaga

SEQ ID NO: 113217 - DNA, 50 bp, homo sapien
agcattgcatctctctgctcatgtcrcctacgttgaaatgggcatgaagt

SEQ ID NO: 113218 - DNA, 50 bp, homo sapien
acctatgggtccaaagtggttgccgyagttctccccatctcacagctagg

SEQ ID NO: 113219 - DNA, 50 bp, homo sapien
tcaaggaaactggcagatgtatataraaagataatgactcatctaataat

SEQ ID NO: 113220 - DNA, 50 bp, homo sapien
aagacaggagagctcacactgccaasaaatacaaagtgttacaggaaaac

SEQ ID NO: 113221 - DNA, 50 bp, homo sapien
tcaacttaaattccagagaaaacacraacattcaaaccataccaaggggt

SEQ ID NO: 113222 - DNA, 50 bp, homo sapien
taatgttgtctaaagaacgaagaagrtggcaaagatttgtcaggaaggag

SEQ ID NO: 113223 - DNA, 50 bp, homo sapien
tctcctagaaaagccttccacactayatgactggtagacttgtatatgag

SEQ ID NO: 113224 - DNA, 50 bp, homo sapien
gctcctctttcccatgccaagtcaartaggaagccctaagcacttagaag

SEQ ID NO: 113225 - DNA, 50 bp, homo sapien
tgaaaagatgaaaacagttgtcccargtggtaggatgtgggaattgagga

SEQ ID NO: 113226 - DNA, 50 bp, homo sapien
tcgctgtctctgccctttgttacagratcatcatgccaataagcagtctt

SEQ ID NO: 113227 - DNA, 50 bp, homo sapien
tgggcctcagtctggtcatctgtaaraagaagtggctggactgaaaactc

SEQ ID NO: 113228 - DNA, 50 bp, homo sapien
tagtctcttacaaattagcagatgargagaatggagtagtggtaatgtct

SEQ ID NO: 113229 - DNA, 50 bp, homo sapien
agaattgaatttgtgactcaaagacyctgcatagatggttaattgtagtc

SEQ ID NO: 113230 - DNA, 50 bp, homo sapien
atagtattaaatgtcaaacgcattargccagagggcccaagggaacactg

SEQ ID NO: 113231 - DNA, 50 bp, homo sapien
agaaaagaactttaatagagcctacmtaaattagagttaatgataaattt

SEQ ID NO: 113232 - DNA, 50 bp, homo sapien
tatcaataattgaaacttaattgaargcaacaaactgttgatttctctaa

SEQ ID NO: 113233 - DNA, 50 bp, homo sapien
taaatgatttttttttgatggtacamataacctaagtaaccttcttggaa

SEQ ID NO: 113234 - DNA, 50 bp, homo sapien
ctgtcatcttctgtttgaatgaagawccttacagtgagaaatttcaaatg

SEQ ID NO: 113235 - DNA, 50 bp, homo sapien
tttctggaagccaatcaaaatggaargttatattttgtggaaattaaact

SEQ ID NO: 113236 - DNA, 50 bp, homo sapien
ctcgaacagcccatcttgttatttcratgctgtcagaactctttctttca

SEQ ID NO: 113237 - DNA, 50 bp, homo sapien
cctcatgtatcaatcatctgctaaaygaaggaaatatatatatatataat

SEQ ID NO: 113238 - DNA, 50 bp, homo sapien
gggaagtcactgtgggcctttgtggmatatattgagatagtaaatgtctg

SEQ ID NO: 113239 - DNA, 50 bp, homo sapien
tttggaagggtatatctaattgtgaygtggagaaaaaatgtcagtagtag

SEQ ID NO: 113240 - DNA, 50 bp, homo sapien
aaaaattatcatggaaagcagtaatkgaaataaagatcccagaatagtta

SEQ ID NO: 113241 - DNA, 50 bp, homo sapien
acatcaagaactgggtgtctgccacygtcaacaaatagagcttctccaga

SEQ ID NO: 113242 - DNA, 50 bp, homo sapien
tttcttacccataaaatacagtgatwacctactttatatagtttttgtga

SEQ ID NO: 113243 - DNA, 50 bp, homo sapien
taattcaaaacacatagctttaatgwcaccgtctcagagaccacttaatc

SEQ ID NO: 113244 - DNA, 50 bp, homo sapien
tcggggacaaactttcatcctagaaraccggagtgtcagcagtgagctag

SEQ ID NO: 113245 - DNA, 50 bp, homo sapien
atgaaaatgtacatcttagagtcaargaaatatggcaataaagctaattt

SEQ ID NO: 113246 - DNA, 50 bp, homo sapien
tttgactaaaatattgaacctaatcrgagcttcatatacttatctcatca

SEQ ID NO: 113247 - DNA, 50 bp, homo sapien
tttcttacccgcctattgggttgaayacaattgaaaagtacggtgaaaga

SEQ ID NO: 113248 - DNA, 50 bp, homo sapien
tgaattattcacacacagttgtcaaycaggtaaaaatacatgtaatagaa

SEQ ID NO: 113249 - DNA, 50 bp, homo sapien
tcaacttgcaatgcagattcaccaaygtcccatgccccctctttgatttc

SEQ ID NO: 113250 - DNA, 50 bp, homo sapien
ggttatgttaattgatgtatgataayaaaaactgtatgcaatctggtaaa

SEQ ID NO: 113251 - DNA, 50 bp, homo sapien
gaagacctttgggagagcatcttcartagatccatgaggtgaaaaagcaa

SEQ ID NO: 113252 - DNA, 50 bp, homo sapien
ggctaaatacgtatagaaatacacawgtacaattttaaatatgtttatat

SEQ ID NO: 113253 - DNA, 50 bp, homo sapien
cttggcaggtgtcaggcctcataaaygtagttgaatctgaataggcagga

SEQ ID NO: 113254 - DNA, 50 bp, homo sapien
gtaagataattatcacaataaactarctaaaaatcatgttaaaatatcag

SEQ ID NO: 113255 - DNA, 50 bp, homo sapien
acatgggtcaggaggaaaggaggtcrccactgagagccagggtcctccag

SEQ ID NO: 113256 - DNA, 50 bp, homo sapien
tgctaatatggtgaagtccaggcaarttaaaagatattgagatcttcaac

SEQ ID NO: 113257 - DNA, 50 bp, homo sapien
ttatcagagaagagaaaatcattgaraactggagacaagccaattgggct

SEQ ID NO: 113258 - DNA, 50 bp, homo sapien
gaatctttttcctcctggctaagaayataggtggactattagaacctgtt

SEQ ID NO: 113259 - DNA, 50 bp, homo sapien
atgataggatttaccaaattatgtgraaatatatactgtcacctcccact

SEQ ID NO: 113260 - DNA, 50 bp, homo sapien
gacccaaaggcacgagccagtcaacragagagtttggaggagactgacta

SEQ ID NO: 113261 - DNA, 50 bp, homo sapien
cttgctctatgtgtacatttcttaaytggcatccctactaagaataggga

SEQ ID NO: 113262 - DNA, 50 bp, homo sapien
gctacttctgactttttgtaagccaygagtaaatccttgaaatgcatacc

SEQ ID NO: 113263 - DNA, 50 bp, homo sapien
ggcacagtttgttatacctcaaaacmattacaatcgtaacttcaaagatc

SEQ ID NO: 113264 - DNA, 50 bp, homo sapien
gaaaagttgtgttatttgttgttaayctctcacttttctaatcttttaca

SEQ ID NO: 113265 - DNA, 50 bp, homo sapien
aatgcagcagctttggtgtcctgttktaactttagtgaaaatactaattc

SEQ ID NO: 113266 - DNA, 50 bp, homo sapien
tatcagagaagcaggtaagattacaygaagagttaaagaataatgttgct

SEQ ID NO: 113267 - DNA, 50 bp, homo sapien
acaattccttgtatttacctggacarttcttccaatgcaagtcagatcta

SEQ ID NO: 113268 - DNA, 50 bp, homo sapien
aatatagaaacagtcaagagaaatasagtgctcctgtacgaagttagtca

SEQ ID NO: 113269 - DNA, 50 bp, homo sapien
tctcttccacctttcagtcttaacartaatgataatgtaaagcaatacat

SEQ ID NO: 113270 - DNA, 50 bp, homo sapien
acagtagattctctctgctgtgttayaattctgggaacagtctgaagttc

SEQ ID NO: 113271 - DNA, 50 bp, homo sapien
gaggtagtaactgaaaggaatactawataagttagcagtagactgatctg

SEQ ID NO: 113272 - DNA, 50 bp, homo sapien
tgaaaaattaaagatggaccatgaasgctgtaatttctatttgttgtggt

SEQ ID NO: 113273 - DNA, 50 bp, homo sapien
gggtttagttcatattaccctgagaraaaaatgtagacacatcagctata

SEQ ID NO: 113274 - DNA, 50 bp, homo sapien
cttttcatagttagttttcaatgtascctaggatctacgctgggccccac

SEQ ID NO: 113275 - DNA, 32 bp, homo sapien
tatattttaagtaaaaytagactagccttgaa

SEQ ID NO: 113276 - DNA, 50 bp, homo sapien
ttgttgtcccatgtgtcagcaaatayagtatcaaatatgctagaaaggca

SEQ ID NO: 113277 - DNA, 50 bp, homo sapien
caccaaggacaaacaatgtagaagakccaggtaatagccatcatagcact

SEQ ID NO: 113278 - DNA, 50 bp, homo sapien
gagtcccaggaggactaaatgaaagrattataagagaatgacagacatta

SEQ ID NO: 113279 - DNA, 50 bp, homo sapien
ttgccaaggggtgctgttgtttgtcytctcagtacagaatgtgcagtgct

SEQ ID NO: 113280 - DNA, 50 bp, homo sapien
attatcttcagaaagatacataaaamctcatattaggtgcctctagaaaa

SEQ ID NO: 113281 - DNA, 50 bp, homo sapien
gggagatcatcctgtatcacataaasatgatccccatagctactgtatcc

SEQ ID NO: 113282 - DNA, 50 bp, homo sapien
aaattgccaacttacactcaactagraatgtatgagaacacactgtctaa

SEQ ID NO: 113283 - DNA, 50 bp, homo sapien
tttctgttatggcttctgaatgttaygacatatttagaaatagctttccc

SEQ ID NO: 113284 - DNA, 50 bp, homo sapien
gcacacaaattatgtaactgaaatcraagagccaacaaaaattgccctgg

SEQ ID NO: 113285 - DNA, 50 bp, homo sapien
aataatctgcagctgattcattccgrcagtggagccctgaagagatgacc

SEQ ID NO: 113286 - DNA, 50 bp, homo sapien
atgcgtcataaactcattcatggaaratgatgcttgacattttgaagtgt

SEQ ID NO: 113287 - DNA, 50 bp, homo sapien
taattaatccttgatgctgttcttcyctctatatgagttctctctctgtt

SEQ ID NO: 113288 - DNA, 50 bp, homo sapien
ctcaaaacaaaggaagtgcaatttayagaaggtagtagaataggcagata

SEQ ID NO: 113289 - DNA, 50 bp, homo sapien
gtaaaacaatgtaaatattggaaaawctattaatggaatacatcaaactt

SEQ ID NO: 113290 - DNA, 50 bp, homo sapien
ttgctgccaaagaacattctccttakgacgcgtgcagctgttcagtgcat

SEQ ID NO: 113291 - DNA, 50 bp, homo sapien
aatgactccaaggtttctgagttaaytgactgaaaagaaagtgatagcaa

SEQ ID NO: 113292 - DNA, 50 bp, homo sapien
cttggaataatggtcttccacaaaascagtccgtggtaccaaaaaggctg

SEQ ID NO: 113293 - DNA, 50 bp, homo sapien
cttttgggcttgtttttcaaaatcarctatttcaagtgacagcaaatttc

SEQ ID NO: 113294 - DNA, 50 bp, homo sapien
caattttattaaggctcactagatayggctttctttgtatttatccagaa

SEQ ID NO: 113295 - DNA, 50 bp, homo sapien
tatcatgcattagtacctagactgcraatatattgtattacaaagtaaaa

SEQ ID NO: 113296 - DNA, 50 bp, homo sapien
tacatttaaaggagctcagtaatcawgtatagagacaatatggatacaaa

SEQ ID NO: 113297 - DNA, 50 bp, homo sapien
ttctgtaatagccacaaagatagacygaggttctggtggcaaaatggaca

SEQ ID NO: 113298 - DNA, 50 bp, homo sapien
tgcttcctttaaactgcatgtaatcragttttaaaaatctagtctgacat

SEQ ID NO: 113299 - DNA, 50 bp, homo sapien
agttcaagtcagcttccattgaagartcaagtaattttgtcctgaaagca

SEQ ID NO: 113300 - DNA, 50 bp, homo sapien
tggttacacaatggtgagggaaatgracatttatttagcagctagatttt

SEQ ID NO: 113301 - DNA, 50 bp, homo sapien
aggttgaaaggtaaagcatgagaaartatataacatgaaaatactaatcc

SEQ ID NO: 113302 - DNA, 50 bp, homo sapien
ctctttacaacaaagagaaaaatacycaatgttgcctgcaagtaagtgta

SEQ ID NO: 113303 - DNA, 50 bp, homo sapien
tgcacttaaaatgggtgaaattatascgtggaagttatacctcaataaag

SEQ ID NO: 113304 - DNA, 50 bp, homo sapien
tacaatcaatggcatgttataatttmattggcagcattatttgtctctta

SEQ ID NO: 113305 - DNA, 50 bp, homo sapien
gagttgttttcaaacactaaaaatayatgaagttagacatacatatgaag

SEQ ID NO: 113306 - DNA, 50 bp, homo sapien
aaagcaataatgtaaggaaattagartccctgtcctagttctaccaccta

SEQ ID NO: 113307 - DNA, 50 bp, homo sapien
ttttcagagaatttcttcaatttccyttggcagtaaattttcccttagat

SEQ ID NO: 113308 - DNA, 50 bp, homo sapien
agcctgtcaatcacaagctacaacaygtaaccgctctggctgactctcac

SEQ ID NO: 113309 - DNA, 50 bp, homo sapien
gcagtgtcacatcttcagtaaagagwatttaatgttccttttttgtctct

SEQ ID NO: 113310 - DNA, 50 bp, homo sapien
aaataacaaaagatatgaaacaacartcataaatgagtagggatttgaat

SEQ ID NO: 113311 - DNA, 50 bp, homo sapien
ttgctagcaagaatcatactaaaagraaactcaagagtgcatttgtgtct

SEQ ID NO: 113312 - DNA, 50 bp, homo sapien
ggaggacgaattaatagagggcttamctgtgtgattttcatgagagactg

SEQ ID NO: 113313 - DNA, 50 bp, homo sapien
tattccactattctactattctagckatctttcataacctgctccctgga

SEQ ID NO: 113314 - DNA, 50 bp, homo sapien
gccgaaatagaggctaagacttaaartaacaatgtggcagcctgagacat

SEQ ID NO: 113315 - DNA, 50 bp, homo sapien
ttattgttgatctgcatgagggtctyagaatattaaaaaataagtgctta

SEQ ID NO: 113316 - DNA, 50 bp, homo sapien
ctctagaaatcatagaagaaacaaargaaagctgttttcatagactggaa

SEQ ID NO: 113317 - DNA, 50 bp, homo sapien
ccatttcttcaattgcttgaaagaaytaaagagtcagacatgacaaactg

SEQ ID NO: 113318 - DNA, 50 bp, homo sapien
cctaagttgacattctggcttctaayacctgatatcaatatgatttcctg

SEQ ID NO: 113319 - DNA, 50 bp, homo sapien
atgtgtactccatatttctaacaaarttacaattctgaatctctgttagg

SEQ ID NO: 113320 - DNA, 50 bp, homo sapien
acctttgctattcgggtttgctgaamattcaggaggggaatcctaagctc

SEQ ID NO: 113321 - DNA, 50 bp, homo sapien
catcccaaccctctgcttggaaacastataggaacaggtccaggtggcaa

SEQ ID NO: 113322 - DNA, 50 bp, homo sapien
ttgctgaccctttctctggattacargaactcaatctgtataggagattt

SEQ ID NO: 113323 - DNA, 50 bp, homo sapien
gttactgctaaatcactacaactgcraatagagactgaacactgtgtagg

SEQ ID NO: 113324 - DNA, 50 bp, homo sapien
gtgatttagcagtaacgttatcaacrcaagatgacaccaaaagatctcat

SEQ ID NO: 113325 - DNA, 50 bp, homo sapien
cttcttaagtagtgtttactacatasagctttcatagttcctatatgaat

SEQ ID NO: 113326 - DNA, 50 bp, homo sapien
agaagtgcctacctcatctggtgcarctagagctaataaagtcagagata

SEQ ID NO: 113327 - DNA, 50 bp, homo sapien
tgaaaaatagaaacaatatctaggamagttaaggaaggggatcaaagatg

SEQ ID NO: 113328 - DNA, 50 bp, homo sapien
acagagatgatgaagacttgcttgakacttactggtttcttcagagagcc

SEQ ID NO: 113329 - DNA, 50 bp, homo sapien
gagcttagctgtcaagcaacgatacscaggagaaccatccaaaaagtgaa

SEQ ID NO: 113330 - DNA, 50 bp, homo sapien
gtaattttgttagaaatatggagtayacattctgctgctgtatccccttg

SEQ ID NO: 113331 - DNA, 50 bp, homo sapien
attacgctctgtttgtaaattcaggwcagtaaggctatgtcttcaaccga

SEQ ID NO: 113332 - DNA, 50 bp, homo sapien
taaagactgtggtgtgagtataacayagttaattgactactaaaataaaa

SEQ ID NO: 113333 - DNA, 50 bp, homo sapien
ggctggggtaagagaagctaacagartatgtttaccactgctttgaagac

SEQ ID NO: 113334 - DNA, 50 bp, homo sapien
catgttatagccgtgagttgacaaayataacagtgacatggtaaaaataa

SEQ ID NO: 113335 - DNA, 50 bp, homo sapien
atgagaaaaatatgtttggcatctgmaagtactaattcaaaacaaatgca

SEQ ID NO: 113336 - DNA, 50 bp, homo sapien
atatgaaaaaaagttaaaatgagatyaatagagccgactttatgtccata

SEQ ID NO: 113337 - DNA, 50 bp, homo sapien
caaagaaactataagaaatgaaacartaaagaacagaaattactgggaac

SEQ ID NO: 113338 - DNA, 50 bp, homo sapien
gacacatgctagactgaataaattcraagatgactaagccatgatttctg

SEQ ID NO: 113339 - DNA, 50 bp, homo sapien
agctaaactagccctgtgaagatacrgaagcacagagttgcaggctgaga

SEQ ID NO: 113340 - DNA, 50 bp, homo sapien
attaccatagacattaagtcagagargaataaaaagcccatgtctagacc

SEQ ID NO: 113341 - DNA, 50 bp, homo sapien
gaatttcaaaacttcaagagttcacrcaagtattaagtgagaaactggga

SEQ ID NO: 113342 - DNA, 50 bp, homo sapien
tagataatgctcagttttctgctgayggcacacagtaatctttttggtcc

SEQ ID NO: 113343 - DNA, 50 bp, homo sapien
catcaacaaaatcattacaatagcartaaaatttcacctcaaatctctac

SEQ ID NO: 113344 - DNA, 50 bp, homo sapien
agagagcaagcatcatcagctaagcrgaccatggtaaacttcccctcaaa

SEQ ID NO: 113345 - DNA, 50 bp, homo sapien
ggccagggaaagagcatcttggtagkaaaaacaataaacatttttgaaaa

SEQ ID NO: 113346 - DNA, 50 bp, homo sapien
gtttcagtgcatatttaatgaaagasagcatccactttttctagagaaac

SEQ ID NO: 113347 - DNA, 50 bp, homo sapien
ctaataaaacattagaaatagctgaragttgagaggtagtcttcctgcaa

SEQ ID NO: 113348 - DNA, 50 bp, homo sapien
agatctcaataatataatcattgaayccaactacctcactccaagatcca

SEQ ID NO: 113349 - DNA, 50 bp, homo sapien
tccaattagaatgagattcttaacckttctaatgcgctgacctacctttg

SEQ ID NO: 113350 - DNA, 50 bp, homo sapien
gctgtttcatattttttatgatctgwgtattcactggagaatcactttta

SEQ ID NO: 113351 - DNA, 50 bp, homo sapien
ctgaaggattagtgaagaaagaaaascttccacaatttggattaattgaa

SEQ ID NO: 113352 - DNA, 50 bp, homo sapien
ccagaagaaacaggaatggaccagtyaatttctctgatgggaccctgaaa

SEQ ID NO: 113353 - DNA, 50 bp, homo sapien
gatgaagatacataagccaagccaastaaaatcatctagtagcaatgggc

SEQ ID NO: 113354 - DNA, 50 bp, homo sapien
aaagacaagtcttatcagaaattgargccattttctctaatacaaatttt

SEQ ID NO: 113355 - DNA, 50 bp, homo sapien
acctatttcttcttcacggtcagaawgcagaacataggtattgagcaccc

SEQ ID NO: 113356 - DNA, 50 bp, homo sapien
tgtctacctcttactctttgatgatyacagcaagcccacaatgacataga

SEQ ID NO: 113357 - DNA, 50 bp, homo sapien
agcaagagaggttaaatcgtgcttayatttctctactatacccgtattct

SEQ ID NO: 113358 - DNA, 50 bp, homo sapien
agcgtgtgttcacttttggactccayacattgagagactcatggactggt

SEQ ID NO: 113359 - DNA, 50 bp, homo sapien
atgtttggaatgaacgatttgtctayataagatcctgctcattatcttgc

SEQ ID NO: 113360 - DNA, 50 bp, homo sapien
ttcaccttgttttctgggtttctgayaaatattactcgagtataaggtgg

SEQ ID NO: 113361 - DNA, 50 bp, homo sapien
ggtattacatagtagttgatgtatayagtacactttggcctgaatgcttt

SEQ ID NO: 113362 - DNA, 50 bp, homo sapien
actgcattatttgataagaacgtaasggagttgcccagagcatctaatct

SEQ ID NO: 113363 - DNA, 50 bp, homo sapien
tataccttgcaatcaatatgtgtaaraattgagaaaactttgtaataaat

SEQ ID NO: 113364 - DNA, 50 bp, homo sapien
gcacgtattttgtgtattttctcatmaacatatccctagcactaggaatc

SEQ ID NO: 113365 - DNA, 50 bp, homo sapien
gttcaacctaatcatcatatctttcraatgcaggataattctgccaaagc

SEQ ID NO: 113366 - DNA, 50 bp, homo sapien
caaagataactaaagtcaatcgcaayggtctcaacttttcaatgaagcaa

SEQ ID NO: 113367 - DNA, 50 bp, homo sapien
gaccctatctattctaaatgttgtcwctacttctgtttttaaagcacaca

SEQ ID NO: 113368 - DNA, 50 bp, homo sapien
cttgaggtctgagtagaacagaaaawtcacagctttggagagtgaggtaa

SEQ ID NO: 113369 - DNA, 50 bp, homo sapien
aaaaattgtgaacaaaatatgaacaraaatatcctagtgaaaataaggat

SEQ ID NO: 113370 - DNA, 50 bp, homo sapien
ctaagaaaagacagggagttaggaaygcatgggtctctttatggactaag

SEQ ID NO: 113371 - DNA, 50 bp, homo sapien
aaccaatattaaaagtcttacatgcyttcttaaaacacagggagttggtt

SEQ ID NO: 113372 - DNA, 50 bp, homo sapien
tgatgtgcaggaatatatttaacaastgactttcatgtttgtcaattgtc

SEQ ID NO: 113373 - DNA, 50 bp, homo sapien
cgaaatactgctattagtggtcttayaccctagaatcaagaggaagacac

SEQ ID NO: 113374 - DNA, 50 bp, homo sapien
caaatatttttcagttatataagagraggagccgactttttttttctttc

SEQ ID NO: 113375 - DNA, 50 bp, homo sapien
taatgtcatacaatatttcaactcamatactgattttgccacaaatgaga

SEQ ID NO: 113376 - DNA, 50 bp, homo sapien
gcctcattttgtagcacctgttgcaytaattaccagaaagctccgttcag

SEQ ID NO: 113377 - DNA, 50 bp, homo sapien
ggtaaggtctttgtcctcctccacaratataggtcagcatcagtaagtgt

SEQ ID NO: 113378 - DNA, 50 bp, homo sapien
cattatttgaatgcatgaaacttctracctataagacatgaaatacatta

SEQ ID NO: 113379 - DNA, 50 bp, homo sapien
acattgtaaattcttctgtaggcacrataaggtataccatggacaaacat

SEQ ID NO: 113380 - DNA, 50 bp, homo sapien
agcattctaatgcaagtgatccagaragcatttgttgagaaacggcaaca

SEQ ID NO: 113381 - DNA, 50 bp, homo sapien
tggtggaaaaataccttgtatttgayaaaaatccattacatgaaataact

SEQ ID NO: 113382 - DNA, 50 bp, homo sapien
gataattgtgtaaaatgcacttgacmcataatatgtatgtataaatattg

SEQ ID NO: 113383 - DNA, 50 bp, homo sapien
tagatttgctatttaacctatcaaaraattgtgtcttacagtattattca

SEQ ID NO: 113384 - DNA, 50 bp, homo sapien
ttaggatagagcttgatacattttcrcaactgaacacaatcatgtaacca

SEQ ID NO: 113385 - DNA, 50 bp, homo sapien
tatcatgaagaataaagacaaatgakaacagatctaccttaggctgatac

SEQ ID NO: 113386 - DNA, 50 bp, homo sapien
gtggataaaaaagcctcaatatccayaaatacagcaagcacttatattgt

SEQ ID NO: 113387 - DNA, 50 bp, homo sapien
agaacagtgcaaattataaaaatgawccactgtctccctctcttatctca

SEQ ID NO: 113388 - DNA, 50 bp, homo sapien
aattttccctatacaatctttcaccrctcagtagtcgatcctttgtcaga

SEQ ID NO: 113389 - DNA, 50 bp, homo sapien
ctttatgatagtgttcaatcctgagraaactcttgttctttgaactcttc

SEQ ID NO: 113390 - DNA, 50 bp, homo sapien
gctagtctctggctaactgaaagaargtccataatgaagagagaaaaagg

SEQ ID NO: 113391 - DNA, 50 bp, homo sapien
tgcccatcaataatacactggattamaacaaattgtgattaaaacctagg

SEQ ID NO: 113392 - DNA, 50 bp, homo sapien
tttaaactacactggtttcaaccaayggtttcaagaggtagatgactttg

SEQ ID NO: 113393 - DNA, 50 bp, homo sapien
ttaaagaactccatccaagttattayaaccacttctaatacatcttaagc

SEQ ID NO: 113394 - DNA, 50 bp, homo sapien
agctctaaaaatttaagtactacaawgttcaaaaatcaatatcttatctt

SEQ ID NO: 113395 - DNA, 50 bp, homo sapien
tgagcccataaaagttgttattatawcttcatggaaaaagatctgtaaaa

SEQ ID NO: 113396 - DNA, 50 bp, homo sapien
gtcaaatgaatgtacacattcatctsttcttatgggaattacatccagga

SEQ ID NO: 113397 - DNA, 50 bp, homo sapien
agatgtgaattcctttttatttactwagatggaatgaatgccaaaatttc

SEQ ID NO: 113398 - DNA, 50 bp, homo sapien
gggagggttaaaagtctgactcaaargcgcactgtcacaatagcctgggg

SEQ ID NO: 113399 - DNA, 50 bp, homo sapien
ggaggactgtaagagaatattgctcraaacaaaccaaagactgttgttat

SEQ ID NO: 113400 - DNA, 50 bp, homo sapien
tctttttagctgctttgatctataawgttttctcctgaagaaccatccta

SEQ ID NO: 113401 - DNA, 50 bp, homo sapien
catcaatgaaagaatatcacggtaaygaagctgattcctgagccatgaca

SEQ ID NO: 113402 - DNA, 50 bp, homo sapien
tcttaatctcccatttggccctttcmaaagtataagcacagattactttt

SEQ ID NO: 113403 - DNA, 50 bp, homo sapien
cattaaagacatgctgtagtatccartagtaaatggcaacgcaaacttca

SEQ ID NO: 113404 - DNA, 50 bp, homo sapien
aagatggctactcttagatcacctcrctttcatggtaaaaaatggaaagg

SEQ ID NO: 113405 - DNA, 50 bp, homo sapien
atagagatgaccagcagctagctacrataattggtacgtaaatatacaca

SEQ ID NO: 113406 - DNA, 50 bp, homo sapien
accatatcacctcatgaagaggtgawacattctagctcatgaagaggtga

SEQ ID NO: 113407 - DNA, 50 bp, homo sapien
atccttaatcaattcaaatctataayggcagagttttctgaagtgacact

SEQ ID NO: 113408 - DNA, 50 bp, homo sapien
atttaaaagatggatttaatccaaartgaaatcagttcaacaagtttctc

SEQ ID NO: 113409 - DNA, 50 bp, homo sapien
aacatcagcaagataaggcaaacatmataagcctcaacaaattccccagt

SEQ ID NO: 113410 - DNA, 50 bp, homo sapien
gagatgaaacaacttatggagaaaastggtaatcatgagatggtaagttt

SEQ ID NO: 113411 - DNA, 50 bp, homo sapien
gtggtaataatgtgcaatgcatgctytttaaatagaaaaggtaaagtgat

SEQ ID NO: 113412 - DNA, 50 bp, homo sapien
ttctcgccaagcttcagttcctccaygcgtaaatacaaaaacaaaccaaa

SEQ ID NO: 113413 - DNA, 50 bp, homo sapien
tggtgactcccattcaaattcaggaycatggatttccatttaatctcccc

SEQ ID NO: 113414 - DNA, 50 bp, homo sapien
gaaattacatggttatcctttatagmacttgtcttatttacaattttaca

SEQ ID NO: 113415 - DNA, 50 bp, homo sapien
ctcagcagcatcactcctgactacakaagatcactccctgccccacattc

SEQ ID NO: 113416 - DNA, 50 bp, homo sapien
atgtcacatagctatcttgaaaaaamaagcttcgtgttctataggtaagt

SEQ ID NO: 113417 - DNA, 50 bp, homo sapien
atttactgaacatgtattaccaacargatactctaattatgttactttat

SEQ ID NO: 113418 - DNA, 50 bp, homo sapien
gaacttcttaattatcatcaaacccyctatggtaacagcacatgcttatg

SEQ ID NO: 113419 - DNA, 50 bp, homo sapien
aataactggtcaaatggtcatattaragaagactgataaatattaaaagg

SEQ ID NO: 113420 - DNA, 50 bp, homo sapien
caacctcagcataatcctgagtaaamattagacaaatccaaattggtgaa

SEQ ID NO: 113421 - DNA, 50 bp, homo sapien
tgaaactattccaaagaattaatgargaaggtctcctccctaactcgttc

SEQ ID NO: 113422 - DNA, 50 bp, homo sapien
atttggaggagtcagatcccatagamcttcagaggaggctgtgtgaactc

SEQ ID NO: 113423 - DNA, 50 bp, homo sapien
ttaaaagtcttatagtcagtaaatayactcaacacaggtacagatttaaa

SEQ ID NO: 113424 - DNA, 50 bp, homo sapien
acagagaagtagccctatgtatttcyagttagtataagtattcatgggtt

SEQ ID NO: 113425 - DNA, 50 bp, homo sapien
acagttaggtatagtattttcaaaaygctagtgagcactatactttgcat

SEQ ID NO: 113426 - DNA, 50 bp, homo sapien
attatgatttctaagtggcagatgayaatgtggaaaattctgaaggggaa

SEQ ID NO: 113427 - DNA, 50 bp, homo sapien
ccagactcagtccagattggatccascatcaagttagtgtagaaaaaccc

SEQ ID NO: 113428 - DNA, 50 bp, homo sapien
agagggactgtcatttgtctccctgmaatatccatactgttacttgttat

SEQ ID NO: 113429 - DNA, 50 bp, homo sapien
gaagaataaaccctataaacattcaygagcatgtaatatctgtggaattt

SEQ ID NO: 113430 - DNA, 50 bp, homo sapien
tattctggcactatctgaattggacratgaggcactacaggtgtggcctt

SEQ ID NO: 113431 - DNA, 50 bp, homo sapien
tcaataattgattgactttgacagaraaatagtagagtggaaaattccaa

SEQ ID NO: 113432 - DNA, 50 bp, homo sapien
ggtaagaaactgcattaaaggttgakttttccttagtgctcatgtctggt

SEQ ID NO: 113433 - DNA, 50 bp, homo sapien
gagaacagtctgcaaatggacagaasaagtcaaaagagaccagcaataag

SEQ ID NO: 113434 - DNA, 50 bp, homo sapien
ctagtatagaatagatgtgaatctcycagtagacagtgtacagagtaggg

SEQ ID NO: 113435 - DNA, 50 bp, homo sapien
aaatttaaaatagatgcaaaagatamgagcaaataggatacaaaaccctc

SEQ ID NO: 113436 - DNA, 50 bp, homo sapien
agccaacacacacagtaattattatytccaaaccaatatctaaacacatt

SEQ ID NO: 113437 - DNA, 50 bp, homo sapien
atgtatatacgtgggtcttcactgayataagaatgttctataaattattt

SEQ ID NO: 113438 - DNA, 50 bp, homo sapien
cagcaagctgtatgagttcaggcaartcatctaagtccccggggtacaga

SEQ ID NO: 113439 - DNA, 50 bp, homo sapien
tacgtccatattccttttatagtccrcctatgaaatacccttttttatat

SEQ ID NO: 113440 - DNA, 50 bp, homo sapien
tacttacatttgatatttcatcaccsaattatatatttagggagttattt

SEQ ID NO: 113441 - DNA, 50 bp, homo sapien
gtagtatttttaagagcttaacatgstgtatggtgcttagcagatatttg

SEQ ID NO: 113442 - DNA, 50 bp, homo sapien
acaattaaagcatgaagaaaagatasacaaaagaattgcagagacataga

SEQ ID NO: 113443 - DNA, 50 bp, homo sapien
cactattgatatttattaataaacartatgaacagtggaaagaacatggg

SEQ ID NO: 113444 - DNA, 50 bp, homo sapien
cacctcaccacaccctggccaatacygaacatgcatttttaagttgtgac

SEQ ID NO: 113445 - DNA, 50 bp, homo sapien
caggggatgggacaaatatactcctsagtccatgaaaccaaaattgccaa

SEQ ID NO: 113446 - DNA, 50 bp, homo sapien
taatttaaatttccagagaagaaaayggaccaaacaattgaaataaaaag

SEQ ID NO: 113447 - DNA, 50 bp, homo sapien
ccctgtgcagaggcattttgggctcratagatccagagtgctccagtcaa

SEQ ID NO: 113448 - DNA, 50 bp, homo sapien
gcatgggccataatagcaggatatakggttcagtctagcatgcgccctcc

SEQ ID NO: 113449 - DNA, 50 bp, homo sapien
agatgcaatgctccatgtggatttayatcatgccttacaaatttctcata

SEQ ID NO: 113450 - DNA, 50 bp, homo sapien
aatatgcactaatcctgttaggcaaygtatcttgtagacagttgtttcta

SEQ ID NO: 113451 - DNA, 50 bp, homo sapien
gaaaaatactgatttaatgttgtacygaacatagaaaactcaattgtttt

SEQ ID NO: 113452 - DNA, 50 bp, homo sapien
ctaggagtatatatcacatttaagcratttaagaaatatctgtgacatga

SEQ ID NO: 113453 - DNA, 50 bp, homo sapien
tgcatgaatgtttaaagatcaggtargttttataatatacctaaattaat

SEQ ID NO: 113454 - DNA, 50 bp, homo sapien
ttcttatttacatccttggaggatckcaaatagtctgcactagggcaatc

SEQ ID NO: 113455 - DNA, 50 bp, homo sapien
tcaggagttggggtaatggcatctaygtttacaatcagcctgccacacca

SEQ ID NO: 113456 - DNA, 50 bp, homo sapien
atcaggtatttttaaaaccatcttgmaaaacatggaatgataaggaagag

SEQ ID NO: 113457 - DNA, 50 bp, homo sapien
ctttaggctcctgaccaagtcctggraccaaatatatactcatgcatttc

SEQ ID NO: 113458 - DNA, 50 bp, homo sapien
tctgttaattgtttgtgccaaagaayataaggctgaatttgcaaattttg

SEQ ID NO: 113459 - DNA, 50 bp, homo sapien
tcacaaatggttttactgggactctractaatgtccaattaattccaaac

SEQ ID NO: 113460 - DNA, 50 bp, homo sapien
aaaattctcaagaaccagattaatamaatgtgctactgatttctttatac

SEQ ID NO: 113461 - DNA, 50 bp, homo sapien
agagagagattcagagaaggtagtayaaggtttggaattaattggacatt

SEQ ID NO: 113462 - DNA, 50 bp, homo sapien
ttagtttgctggagctatgacagaargtagaataattgtcaaatcattat

SEQ ID NO: 113463 - DNA, 50 bp, homo sapien
tagctccagcaaactaatagcataaycttgcttcatcagagaattctaag

SEQ ID NO: 113464 - DNA, 50 bp, homo sapien
gtagcaatattttatttgtatattargacatctgttgacacttcctacat

SEQ ID NO: 113465 - DNA, 50 bp, homo sapien
aaatccttctttacttggcgaaatascttgcttcaatactaatttaaaca

SEQ ID NO: 113466 - DNA, 50 bp, homo sapien
aattttacagaccctctcattattaytaaccttttgtccttttgaaagtt

SEQ ID NO: 113467 - DNA, 50 bp, homo sapien
tatttatcgcatttacttatcacacyagactctgagtcagataagacatg

SEQ ID NO: 113468 - DNA, 50 bp, homo sapien
gttacgtatttatggatttattatgyattgattcttccactagttcatgt

SEQ ID NO: 113469 - DNA, 50 bp, homo sapien
caaagggagaaatgattgagaaatayacctgcttggaactagaggaacat

SEQ ID NO: 113470 - DNA, 50 bp, homo sapien
caaaacgggattgaagggcttgaaayaactagatgcctacacttttacaa

SEQ ID NO: 113471 - DNA, 50 bp, homo sapien
ctttgtggcagttgtatgacaattamgacattttagcaactgcatggatg

SEQ ID NO: 113472 - DNA, 50 bp, homo sapien
tatttacgaaatgattgaaggattcyatgagaaaaaatatcataaaagta

SEQ ID NO: 113473 - DNA, 50 bp, homo sapien
attataaatgaaaacctcaataccaytacttattggcaacattaggaaca

SEQ ID NO: 113474 - DNA, 50 bp, homo sapien
gtatatatataatcacatttggagayaacactaaaaatccaaaaactcaa

SEQ ID NO: 113475 - DNA, 50 bp, homo sapien
tccagtgtatgatatttagggtgtamttgtcacatcactgagaagtttgc

SEQ ID NO: 113476 - DNA, 50 bp, homo sapien
acagattacggttttgagatttatartacaacctggggcaatgaagaaaa

SEQ ID NO: 113477 - DNA, 50 bp, homo sapien
caatatacataggaaacataccagartcagtcccattactaacttgctaa

SEQ ID NO: 113478 - DNA, 50 bp, homo sapien
tctaagctatctttttgcacactctyaagggaactactgtgggtatcatt

SEQ ID NO: 113479 - DNA, 50 bp, homo sapien
gctaggttctgggtattaggccagasaaaatatacaacgtctcaccctaa

SEQ ID NO: 113480 - DNA, 50 bp, homo sapien
tctttgagggtcagtatccaccacaytgcttggaactttctctaagtcct

SEQ ID NO: 113481 - DNA, 50 bp, homo sapien
tatagatataaagtcaatgacctackattacagcaaagtttttagtcttt

SEQ ID NO: 113482 - DNA, 50 bp, homo sapien
taggaccacgtggatttctcatcaarcttactggagaaagtcccgttgct

SEQ ID NO: 113483 - DNA, 50 bp, homo sapien
gaaacgattttgaacttcttcatatratagtcagatagttgtaggttaat

SEQ ID NO: 113484 - DNA, 50 bp, homo sapien
tatatattcctgattttggctacaasgttctccatacaaagattatttga

SEQ ID NO: 113485 - DNA, 50 bp, homo sapien
tttcttggcataatagacatgaaaasctttccttaatatactccaggtta

SEQ ID NO: 113486 - DNA, 50 bp, homo sapien
atttgtaccaagattatcctcaaaayatcactgaatacagtaaacactgg

SEQ ID NO: 113487 - DNA, 50 bp, homo sapien
tacacaaataacattaaaggatgctsaatgatattagtaactgggcaaat

SEQ ID NO: 113488 - DNA, 50 bp, homo sapien
ttagttttcttaaaatgagaatctayagttgtatttgctagtatctgcct

SEQ ID NO: 113489 - DNA, 50 bp, homo sapien
tatgtcttaacaattttaatcagaaytcatatgacgtgaacagcattttt

SEQ ID NO: 113490 - DNA, 50 bp, homo sapien
aaaatgataacagggaattagtgtakagacaattaaacacacctggtgat

SEQ ID NO: 113491 - DNA, 50 bp, homo sapien
ctcagcctggaccctgtgacttttcrattcaatggctcacgactaacaac

SEQ ID NO: 113492 - DNA, 50 bp, homo sapien
taaacaagcagaaaacattaccatasagtggagcgcttaaatttcaccaa

SEQ ID NO: 113493 - DNA, 50 bp, homo sapien
tacacattggttgctttatctcttgsgagtacgatttcaatttcaccttt

SEQ ID NO: 113494 - DNA, 50 bp, homo sapien
agagttagtgacggagccacattttmactccgggccagtggtcctccctt

SEQ ID NO: 113495 - DNA, 50 bp, homo sapien
atgctagcctgtagcgaatttttagraagaatccaaaagtacagcaaagt

SEQ ID NO: 113496 - DNA, 50 bp, homo sapien
agatctcgacacagatgggaatggamgctaaatggcctctgttaggtcag

SEQ ID NO: 113497 - DNA, 50 bp, homo sapien
tttgtttgtcatagaatttttccccsaagacattgaaactgggagactgg

SEQ ID NO: 113498 - DNA, 50 bp, homo sapien
atgtggaacttctggctaaccaaagmatatttaaagccctgtggattctg

SEQ ID NO: 113499 - DNA, 50 bp, homo sapien
atagataatgggagaaaaaggagtaycctaatcatagatgaggcgtgttg

SEQ ID NO: 113500 - DNA, 50 bp, homo sapien
accataataagatttagtgagaagaygctactaagaaagattagatactg

SEQ ID NO: 113501 - DNA, 50 bp, homo sapien
agacattggtgtcagggcatttttawctcttccttctcttcatttcccac

SEQ ID NO: 113502 - DNA, 50 bp, homo sapien
acaggaagtagctatgtgtcttgcamcaggaatgatacgaaggttctaat

SEQ ID NO: 113503 - DNA, 50 bp, homo sapien
gtgagggtttttttaattgaaatgaygcttccaatgccaaacactaaatt

SEQ ID NO: 113504 - DNA, 50 bp, homo sapien
tcaccctctgattaggaagcaatgcsatcttttgagctcctgtggtcagt

SEQ ID NO: 113505 - DNA, 50 bp, homo sapien
tcacagtgtgcctaagaaaggcacasgtttccatttgattttaaatgttt

SEQ ID NO: 113506 - DNA, 50 bp, homo sapien
gagaaggttatgagaaagagttaccraagccaatatatatcaaacttggg

SEQ ID NO: 113507 - DNA, 50 bp, homo sapien
ctaggcatgaaggtaggaaatagcayggtgagtaagaaatatgtttgcag

SEQ ID NO: 113508 - DNA, 50 bp, homo sapien
cagaccaatatcttcaataaatatasatgcaaaagtggtaaaaaaaaata

SEQ ID NO: 113509 - DNA, 50 bp, homo sapien
tgtttgatataaaatctacaggttgsatagctacacaagtgtccatcttc

SEQ ID NO: 113510 - DNA, 50 bp, homo sapien
aagtcataggaaaagctcgttcatcrccttactttcaacaattgtatgtc

SEQ ID NO: 113511 - DNA, 50 bp, homo sapien
cttctagaaggtacattagaaaatasaacttacgtactttatcttaaatc

SEQ ID NO: 113512 - DNA, 50 bp, homo sapien
atgtattcccaacccctagtttatasatgaagagattgaaagggaaaggg

SEQ ID NO: 113513 - DNA, 50 bp, homo sapien
ttcttatctatgctgaaagttttcayatctcttctggcaaacataagcct

SEQ ID NO: 113514 - DNA, 50 bp, homo sapien
aacaggattatatccatcagattaartgtaccaacaaatatttaaaatgc

SEQ ID NO: 113515 - DNA, 50 bp, homo sapien
tctgtgaaaaaatgaaaattgctgayctttgaggttttatgtttttaatt

SEQ ID NO: 113516 - DNA, 50 bp, homo sapien
gagtgtggctatcaaagggaaacacragtgatgttctgatcaaggaatta

SEQ ID NO: 113517 - DNA, 50 bp, homo sapien
ggctggagagaaggggtagaaaggcyagagaaatgttgaaataatttaag

SEQ ID NO: 113518 - DNA, 50 bp, homo sapien
actttaagatacctacttctgttacmaagatgaaattaccatgaacacct

SEQ ID NO: 113519 - DNA, 50 bp, homo sapien
aatcacataaacacataaatacagayaggtactaagagagagaattacaa

SEQ ID NO: 113520 - DNA, 50 bp, homo sapien
ataaagtggaaatctacatccactarctggacaagtaacccttatggaat

SEQ ID NO: 113521 - DNA, 50 bp, homo sapien
gctgctcaccctggaagatatgtgasagttgcccataggagaaacagata

SEQ ID NO: 113522 - DNA, 50 bp, homo sapien
tgacacatcctctactagtcatgatwaaagtgtgtgttttcataaagcct

SEQ ID NO: 113523 - DNA, 50 bp, homo sapien
accaactcaagttagctgaaatacartaaggctttgactaattcaggaaa

SEQ ID NO: 113524 - DNA, 50 bp, homo sapien
aactcctagagaatattcaactccayagaatgttgttcttctaaaatatt

SEQ ID NO: 113525 - DNA, 50 bp, homo sapien
cacttgttatgtacttaactctataytaaattgaataaggctgaggcact

SEQ ID NO: 113526 - DNA, 50 bp, homo sapien
tgaaattctccttgatcattatttaycattatttatacatcaaacagcaa

SEQ ID NO: 113527 - DNA, 50 bp, homo sapien
aaaagtgctagccattgagtctgcaygagaacacgttagggaaataaaaa

SEQ ID NO: 113528 - DNA, 50 bp, homo sapien
attcggaaggaatatcaaaacctgcrccatgggttgaatgcaaagcagtt

SEQ ID NO: 113529 - DNA, 50 bp, homo sapien
ggataatggaaaaatgatctgtgaayaaaagagaaaagtaccaagaagtt

SEQ ID NO: 113530 - DNA, 50 bp, homo sapien
tattgctgatgtcttcaccataaaasgtttcaatgaagaaatttaagtgt

SEQ ID NO: 113531 - DNA, 50 bp, homo sapien
agttctgagaatgttcctttatccaycatcaacttctatcacacttccac

SEQ ID NO: 113532 - DNA, 50 bp, homo sapien
tggggatccaatcaaaatgtaaacaraggcactgtagagaagacagagac

SEQ ID NO: 113533 - DNA, 50 bp, homo sapien
atagatatctaaaggttatttgaagrccaatctggcatatagaatattct

SEQ ID NO: 113534 - DNA, 50 bp, homo sapien
caggattcaacaagatatactattcmattagacatacaaatgactgagtt

SEQ ID NO: 113535 - DNA, 50 bp, homo sapien
catacacgcccttctcaactttccakgtgctatgtggggacacatcctac

SEQ ID NO: 113536 - DNA, 50 bp, homo sapien
aaactctgcaggaaggacatttacawcattcttcttatcactagcatggt

SEQ ID NO: 113537 - DNA, 50 bp, homo sapien
ctgattgcattccttttagctgccartgcacatacatgcacacagcacga

SEQ ID NO: 113538 - DNA, 50 bp, homo sapien
agtctttgacatttacaagatcactyaccatggaagggagaaactaaata

SEQ ID NO: 113539 - DNA, 50 bp, homo sapien
ctgccaaagctcatgttgaaaggatraaaagtcaagatacaaattctgag

SEQ ID NO: 113540 - DNA, 50 bp, homo sapien
attatggtcaattccttggcgctcasgtttagtagctactccaaaactgg

SEQ ID NO: 113541 - DNA, 50 bp, homo sapien
ccttttcctaatcagatcaacccacrcagatgtgcatgaatgatttgatg

SEQ ID NO: 113542 - DNA, 50 bp, homo sapien
agcttaaacaagactagggagatcasaaaagaaagacaggatacatatga

SEQ ID NO: 113543 - DNA, 50 bp, homo sapien
atgcagcatcggctttcctgtagacsaccacatttcaggccctttgaaaa

SEQ ID NO: 113544 - DNA, 50 bp, homo sapien
gagaggtatttagaggaatgggaaaraagaatagattcaaaatgttgcaa

SEQ ID NO: 113545 - DNA, 50 bp, homo sapien
ataaagaattgcttttccaagccaawttagtacaatcttctctgataaag

SEQ ID NO: 113546 - DNA, 50 bp, homo sapien
gtcctaatattgtttatactaatcaraaacacaaataaatatatcaacat

SEQ ID NO: 113547 - DNA, 50 bp, homo sapien
ttgttgtttttgttgttatgggtagragttccatttacttgaaaagtgtc

SEQ ID NO: 113548 - DNA, 50 bp, homo sapien
tctaattccaaaattaagagctgaargaaaatctaattatgtttaactct

SEQ ID NO: 113549 - DNA, 50 bp, homo sapien
gttgcccaaaatcatgtttgtgagaratcctaaagcacattcatgaatgc

SEQ ID NO: 113550 - DNA, 50 bp, homo sapien
actgagttgaacattcatatgagacyaatcaaaaggcactagcttgtgag

SEQ ID NO: 113551 - DNA, 50 bp, homo sapien
taggaacagtgcaagagtgatacaarctattcctgtgtgaatacagcact

SEQ ID NO: 113552 - DNA, 50 bp, homo sapien
cacatagtcggaggataatcaagtcyaccgatgaggcactctaacttctt

SEQ ID NO: 113553 - DNA, 50 bp, homo sapien
atgctaaagttgagttctgattttcrcatagtcggaggataatcaagtct

SEQ ID NO: 113554 - DNA, 50 bp, homo sapien
ctacataacatgatgaaaaaatgtgraaactcaggaaaaattcagacaga

SEQ ID NO: 113555 - DNA, 50 bp, homo sapien
ttggggggggctgggctactgtatcscattttcttctcacttgacatcaa

SEQ ID NO: 113556 - DNA, 50 bp, homo sapien
tgggatttgaggtgagcattaaggtmaatcaagtgaaatctagtaaagaa

SEQ ID NO: 113557 - DNA, 50 bp, homo sapien
atgttattctagtgtgtacgtgactrtatcttgtatagaaatcttatttc

SEQ ID NO: 113558 - DNA, 50 bp, homo sapien
aatgagatttttactttaacaagaawcacctgaagaaaccttgcttgcaa

SEQ ID NO: 113559 - DNA, 50 bp, homo sapien
caacttgaggtgagatcacatgttakcttgtatatcttccagtcttccag

SEQ ID NO: 113560 - DNA, 50 bp, homo sapien
atataaagatgaacaaaagcaatacyggttttcatagaatttacatagta

SEQ ID NO: 113561 - DNA, 50 bp, homo sapien
tgaaaaacaaagctttcctcaaaccygatagtagaacccaggaaaaaaaa

SEQ ID NO: 113562 - DNA, 50 bp, homo sapien
ttgaaggctaacaggtcagccacaawttagtcattaatatgtcctgtccc

SEQ ID NO: 113563 - DNA, 50 bp, homo sapien
agtgattcacaagcttttccttcaaygaacctttgtaggcataaggacgt

SEQ ID NO: 113564 - DNA, 50 bp, homo sapien
aagtggattctgaaaaagagaggaaygatgtaagttagctaaccagtttc

SEQ ID NO: 113565 - DNA, 50 bp, homo sapien
aaatgacctcttctacaagttttccrctttcaaatctctcaaacagaaaa

SEQ ID NO: 113566 - DNA, 50 bp, homo sapien
ctgatttaaagaaagcaataaatgaygaagaaagtaagtaaacaaggaca

SEQ ID NO: 113567 - DNA, 50 bp, homo sapien
cattcattgctagaatgtaactttargaaccagaatatttcttagacttc

SEQ ID NO: 113568 - DNA, 50 bp, homo sapien
aataagtgtagagaactattattaamtcttgtctcattcttacctatctc

SEQ ID NO: 113569 - DNA, 50 bp, homo sapien
ttttatttttacatagttcttccatyaactttttataagtacgtggaatc

SEQ ID NO: 113570 - DNA, 50 bp, homo sapien
gacttatctgaaagttggagaataaygaaagagaagtaactggagaatga

SEQ ID NO: 113571 - DNA, 50 bp, homo sapien
tatccgaaatgaacttagtgttaaawcatcaaaacattagcaaattaccc

SEQ ID NO: 113572 - DNA, 50 bp, homo sapien
ggtcttctccagaacatataagcaaygaaagatatgcaaagtatgcctac

SEQ ID NO: 113573 - DNA, 50 bp, homo sapien
aaagataataacttttacatgtaccraagttcttaataggattcaaagtg

SEQ ID NO: 113574 - DNA, 50 bp, homo sapien
acccccaatatcttgatgcttggaaygacaatctgtttggcattgagtat

SEQ ID NO: 113575 - DNA, 50 bp, homo sapien
actccttgccagcaagggaacaaaaytggacgaatgagtttgacaaactg

SEQ ID NO: 113576 - DNA, 50 bp, homo sapien
aataggctacttataccacctcaaakgcctatttcaggacaactgggagc

SEQ ID NO: 113577 - DNA, 50 bp, homo sapien
tagctagaatgttccaggtaatcaaygttcactttaatattattatctgg

SEQ ID NO: 113578 - DNA, 50 bp, homo sapien
ctcatagacacacatatttttgttcyatggactgggcaatgtaatcttat

SEQ ID NO: 113579 - DNA, 50 bp, homo sapien
ttttatagctgaagaaattgacatgyagagagattaagtgacttacttaa

SEQ ID NO: 113580 - DNA, 50 bp, homo sapien
attatgatgtactcttagcataaacratcagagaagtatacaaaccaaaa

SEQ ID NO: 113581 - DNA, 50 bp, homo sapien
gcaagaaatgagccacagcagcataygtatttctgaaaactcagacctat

SEQ ID NO: 113582 - DNA, 50 bp, homo sapien
tacaccccagacacagaaagtaggtytgagcagtgaaaaagcatacattt

SEQ ID NO: 113583 - DNA, 50 bp, homo sapien
agttctggccaatgtgatgttacctraaacaatgcataccattactaggt

SEQ ID NO: 113584 - DNA, 50 bp, homo sapien
caaaactccaattattattgcttcaraaacttttatcttagacatccctc

SEQ ID NO: 113585 - DNA, 50 bp, homo sapien
tctccttatataaaatcaacctgtaygtgaatttgcttttcaacagctgt

SEQ ID NO: 113586 - DNA, 50 bp, homo sapien
aaataagctgtaaataactccagagygtagcatcaaagcaaacataagtt

SEQ ID NO: 113587 - DNA, 50 bp, homo sapien
gaagctttcttaccataacattccasgagaagtgatagcaacaaaaatta

SEQ ID NO: 113588 - DNA, 50 bp, homo sapien
atatattttattatggagcatcaaartcagagtaagagataatttgatgg

SEQ ID NO: 113589 - DNA, 50 bp, homo sapien
ttgactgcttgaactcggatccttaraaataggaattcatccacaataag

SEQ ID NO: 113590 - DNA, 50 bp, homo sapien
gaacataaacctgcattcttttaatratagcagccaaggataaattaaaa

SEQ ID NO: 113591 - DNA, 50 bp, homo sapien
caagtgtaacatttactgcacttagytacacattaagggctctgcacaca

SEQ ID NO: 113592 - DNA, 50 bp, homo sapien
atgccctgtatctgcgtagccttcarcttagatataatttcccaaagatg

SEQ ID NO: 113593 - DNA, 50 bp, homo sapien
taaacagaaagaacacttatcaaccragttagcagtatgctgacaaaagc

SEQ ID NO: 113594 - DNA, 50 bp, homo sapien
atatgccctgcagctatcacctttgwtgagtggccatcttccctggcaat

SEQ ID NO: 113595 - DNA, 50 bp, homo sapien
tacatttttattgtgtgagtatttakagatgtgacacttgtctaagtaac

SEQ ID NO: 113596 - DNA, 50 bp, homo sapien
gattatcagatatctttctattccaytccttatgagttacaaaagctcag

SEQ ID NO: 113597 - DNA, 50 bp, homo sapien
acattggaggaaggtttccaaaaagrccaacatgctgaaggcagtagagg

SEQ ID NO: 113598 - DNA, 50 bp, homo sapien
gcaaagaaaaattactggggaataartgtacaagtctatgaataactgct

SEQ ID NO: 113599 - DNA, 50 bp, homo sapien
ttcagtttataatgacaataaagtaygaatacacaagtaatctcattttg

SEQ ID NO: 113600 - DNA, 50 bp, homo sapien
cttccacacttaccaccttttactayaggatccttgttctttttgtccac

SEQ ID NO: 113601 - DNA, 50 bp, homo sapien
tggggatagtaataaatagtgtttamctccctggattattgtgaggatta

SEQ ID NO: 113602 - DNA, 50 bp, homo sapien
gaatcagaaaaatcgtagcaaaaacrgcatcaaaggtgaagatgctagtt

SEQ ID NO: 113603 - DNA, 50 bp, homo sapien
catgtaaagtacaactatactgttgragagaggcaggccctggaggatga

SEQ ID NO: 113604 - DNA, 50 bp, homo sapien
cattgagtaggagtgacacaatttascttaggaactattaaaccaatttt

SEQ ID NO: 113605 - DNA, 50 bp, homo sapien
aggctggttattatttccaagatcartcaaaagcctttgtcctcagactc

SEQ ID NO: 113606 - DNA, 50 bp, homo sapien
agctcttatgcactggactaaggaaygtactaaaagatatctcaagcaaa

SEQ ID NO: 113607 - DNA, 50 bp, homo sapien
tatttgaattgcttttccagtagaartcaaaggcagtttagtgttatgac

SEQ ID NO: 113608 - DNA, 50 bp, homo sapien
taaggtttgggaaatgcaataatcartaataagaggatgactaaagttgg

SEQ ID NO: 113609 - DNA, 50 bp, homo sapien
ccctaatccgacatattcaaactcartctactctgtcacctcaactcctc

SEQ ID NO: 113610 - DNA, 50 bp, homo sapien
gaggctgatgcaaggcaatgtagaarttataaaatgtaacagagtgcttc

SEQ ID NO: 113611 - DNA, 50 bp, homo sapien
tgtgatcacttctttcatactttcayagaactgtaactataatactataa

SEQ ID NO: 113612 - DNA, 50 bp, homo sapien
ggtggtagtctgaaggataccatatracttggcactcattaaccctgctc

SEQ ID NO: 113613 - DNA, 50 bp, homo sapien
ctatacattaacaaatggagactaasgcagcactttcttcagtaattttc

SEQ ID NO: 113614 - DNA, 50 bp, homo sapien
tatatcaaaatatatcatctaaataygtgaggggagagagagagagagag

SEQ ID NO: 113615 - DNA, 50 bp, homo sapien
ttggaaatgcctgtgattcagactargaaacaaatgcctaatttttatta

SEQ ID NO: 113616 - DNA, 50 bp, homo sapien
tcagttacatgaggtttattagcagkaaatacaggccccatggctaacgt

SEQ ID NO: 113617 - DNA, 50 bp, homo sapien
aatttgatgatttcaagggtctcaaytgaagaaagtaggggaggttgacc

SEQ ID NO: 113618 - DNA, 50 bp, homo sapien
taaccactttaagatgtaggggaaarctcctaatatagagctcggcataa

SEQ ID NO: 113619 - DNA, 50 bp, homo sapien
cactgtgttttcctggaatatgtaaygttaagaaataagagctcacacgc

SEQ ID NO: 113620 - DNA, 50 bp, homo sapien
cattcatttaaaagtctgtggaatargagcataaaattattgatgaagag

SEQ ID NO: 113621 - DNA, 50 bp, homo sapien
tttagaatgagacaaatctgtgaaamatccatctgtatcatattaattgt

SEQ ID NO: 113622 - DNA, 50 bp, homo sapien
ttagtgtcttagttgcaaatgaaagractagaaaacttgcccagctagaa

SEQ ID NO: 113623 - DNA, 50 bp, homo sapien
acatagtctagaggagttgaaaaacmcattaagagctcccttctctcctg

SEQ ID NO: 113624 - DNA, 50 bp, homo sapien
agaataaagttagaaagcctaactcracagttccgtagcctcatcagtca

SEQ ID NO: 113625 - DNA, 50 bp, homo sapien
aacagttttaaaagatcatgaaaccwggttaatataagaaacttatcttt

SEQ ID NO: 113626 - DNA, 50 bp, homo sapien
ttcctttacttctccatgtaaataaycatactagtaaatttataggaggc

SEQ ID NO: 113627 - DNA, 50 bp, homo sapien
tggtttttttgggaaaactcttagayagtacagtgagttgtgaccctcca

SEQ ID NO: 113628 - DNA, 50 bp, homo sapien
atcagtatttctcaattacagccgtktaagacattttcttcctaatcatc

SEQ ID NO: 113629 - DNA, 50 bp, homo sapien
tcattgcctatgtctactgcatacamaaaaatgttctgaaaatttgtttc

SEQ ID NO: 113630 - DNA, 50 bp, homo sapien
caggatttttttttctccttttgaaygtgacgggactaatattagcagcc

SEQ ID NO: 113631 - DNA, 50 bp, homo sapien
ctagttttccaaaatggatttagacyggaatattcagaggtggaagtgct

SEQ ID NO: 113632 - DNA, 50 bp, homo sapien
tgaattgcagctatttttagacaaaygacaaaactaagatatttaatgct

SEQ ID NO: 113633 - DNA, 50 bp, homo sapien
ccaccaaatcatatgctttttttaartcggatcccaacaccttccctcta

SEQ ID NO: 113634 - DNA, 50 bp, homo sapien
gttacaagttcatttctcatatgggwcagtttacattgttccaatctaca

SEQ ID NO: 113635 - DNA, 50 bp, homo sapien
ttctgtctggttaagtgaagacgaaygaatgaagaatcacagtgttctta

SEQ ID NO: 113636 - DNA, 50 bp, homo sapien
tcctttttattattccttctcccaaktagagttatataccttcttacttg

SEQ ID NO: 113637 - DNA, 50 bp, homo sapien
tgtaaagccagaggtattgaatgtayctcaaaaatataatcagaaaattg

SEQ ID NO: 113638 - DNA, 50 bp, homo sapien
gcaatgaagtactgctgagctatgamaagaaataaactactgatatacaa

SEQ ID NO: 113639 - DNA, 50 bp, homo sapien
gatcactggactatggggccttaaayattataagtctaatgttcaatgaa

SEQ ID NO: 113640 - DNA, 50 bp, homo sapien
cattatatctttctacctatcaaaasgaagagttgaaacaaattttcaga

SEQ ID NO: 113641 - DNA, 50 bp, homo sapien
catcacccacttcgtgacaaagactmactgccctagctgcctgaagtgct

SEQ ID NO: 113642 - DNA, 50 bp, homo sapien
ctttctatgaaccatgaacaaggtayaatcttttcacaaaacacttctgc

SEQ ID NO: 113643 - DNA, 50 bp, homo sapien
ggcgtaaaagtcgcatgttgagagcrgagaaatctgaggcagggaggtga

SEQ ID NO: 113644 - DNA, 50 bp, homo sapien
tatctttattttttcacagttaatcratttttagtagattgcttttaatg

SEQ ID NO: 113645 - DNA, 50 bp, homo sapien
ctagggaactaaggaaaacaatgatsacatttagtagcccagatactact

SEQ ID NO: 113646 - DNA, 50 bp, homo sapien
tagtgtggactctcatttaaagatgragactagcccagactccattcttg

SEQ ID NO: 113647 - DNA, 50 bp, homo sapien
taagcaaaagtacattttggtaacamcacacaaacatgttacccctagaa

SEQ ID NO: 113648 - DNA, 50 bp, homo sapien
gaaagaagaattaattcattgaagastatggtcaaactctttgggctatt

SEQ ID NO: 113649 - DNA, 50 bp, homo sapien
attagggtaggtactaagtgtaacargtagtgtgctgataagaaggccat

SEQ ID NO: 113650 - DNA, 50 bp, homo sapien
ctttattctatctccaatacttctaycagtttttcaaatatgccatgcag

SEQ ID NO: 113651 - DNA, 50 bp, homo sapien
tttcccagaagttcctctgtatatayaataggaaatgcaggatcagatct

SEQ ID NO: 113652 - DNA, 50 bp, homo sapien
gaattggagactttaattgggagcasatgttcaggtctgaatccagtttt

SEQ ID NO: 113653 - DNA, 50 bp, homo sapien
catattgtatgtttcaatttggtcasagcaaaagtggcctttgatcatct

SEQ ID NO: 113654 - DNA, 50 bp, homo sapien
atcttcaggtggcaacagcaggtaargttctcacatcactctcaccatag

SEQ ID NO: 113655 - DNA, 50 bp, homo sapien
aagagaagacatatgctgttacagargaacatttggttgggaggaggaaa

SEQ ID NO: 113656 - DNA, 50 bp, homo sapien
agacaacttttacagaagtctctaarcaggatatgatgttgacaacccca

SEQ ID NO: 113657 - DNA, 50 bp, homo sapien
aactgattctattatcattatataaygcccttccttgtctcttataagag

SEQ ID NO: 113658 - DNA, 50 bp, homo sapien
aatgtgtacgtaaaattgtaaaatgsatagtgtaaaagtaatcttttcag

SEQ ID NO: 113659 - DNA, 50 bp, homo sapien
acatcactaaaacacagaaaacttayaatacaagcaaacattatagcagt

SEQ ID NO: 113660 - DNA, 50 bp, homo sapien
tttgtaaccaacccaattataggccrggataaaataagtcaaagagcaga

SEQ ID NO: 113661 - DNA, 50 bp, homo sapien
agagtccacgaatagcatgatgtcasaagactggcaaatgaaaagaggca

SEQ ID NO: 113662 - DNA, 50 bp, homo sapien
attggcaatatacagcaataaaggayggtactccattaactagaactccc

SEQ ID NO: 113663 - DNA, 50 bp, homo sapien
tctaaggctacagagtttggttggargttttctgattcatgctagtactt

SEQ ID NO: 113664 - DNA, 50 bp, homo sapien
ctgtaagactgaaacagaaaaggtawcataaggagaggtagcagaagaga

SEQ ID NO: 113665 - DNA, 50 bp, homo sapien
agttggagggagccttgtttttaaaygggtctcagtgattaacatggacc

SEQ ID NO: 113666 - DNA, 50 bp, homo sapien
aagggtgactattcctaaaagctaargaaagatgaagcactctcatactt

SEQ ID NO: 113667 - DNA, 50 bp, homo sapien
atatgtcattagttaattacaaattraaacagtatcgagaagctatacac

SEQ ID NO: 113668 - DNA, 50 bp, homo sapien
ctacgtcccgcacgtgttctaagaaracgacattcccataattcaggcat

SEQ ID NO: 113669 - DNA, 50 bp, homo sapien
aagttttattccactaaggaacaaaygaacgactgcttctgatctaagtt

SEQ ID NO: 113670 - DNA, 50 bp, homo sapien
tgaaaatgaaagactgtagcattacscagtgactcagagagtgtggggga

SEQ ID NO: 113671 - DNA, 50 bp, homo sapien
ttctttcatattagccatgttatcakatcgcataagcttctctagtgatc

SEQ ID NO: 113672 - DNA, 50 bp, homo sapien
atgcaagcacttaaaaggacttgaartattacccagtgacctctggaaga

SEQ ID NO: 113673 - DNA, 50 bp, homo sapien
tgcctttccacctttatctaagggargacatacgaccatgtgatattcca

SEQ ID NO: 113674 - DNA, 50 bp, homo sapien
agaaacttttattttactgtcgtaaygccatgacttcctccaaatctcca

SEQ ID NO: 113675 - DNA, 50 bp, homo sapien
cactttgtcactgctttatctccaaygactcttacagagtaagcacacag

SEQ ID NO: 113676 - DNA, 50 bp, homo sapien
ttcttaataatattattttattcctkaaaatgcagtaatgctctcaaata

SEQ ID NO: 113677 - DNA, 50 bp, homo sapien
gtttggtgaattttactccaaagaarggaatccactatcattaaaaacta

SEQ ID NO: 113678 - DNA, 50 bp, homo sapien
ttgttctagaagcagctcaaggaacmagatcatggcagtaaaagggctgt

SEQ ID NO: 113679 - DNA, 50 bp, homo sapien
ttttggtttttggtcatctctggtarctcatctaatagatgggacatcca

SEQ ID NO: 113680 - DNA, 50 bp, homo sapien
aattacatttgaactttacaataacmctttatcttaggatcatttcatta

SEQ ID NO: 113681 - DNA, 50 bp, homo sapien
cagatgcatgttttctctgtaggaaytcttaaatgtaggcttcaaaaaat

SEQ ID NO: 113682 - DNA, 50 bp, homo sapien
tgtttttatattataatttatattayggcttatgtcaaaatgttttgttc

SEQ ID NO: 113683 - DNA, 50 bp, homo sapien
tcctgtgtttggtgacctctttagayaacccacctgactctgcacctttg

SEQ ID NO: 113684 - DNA, 50 bp, homo sapien
tcaaaggctatcaatgatgcagatamaaatgaactaagggccaggcgcag

SEQ ID NO: 113685 - DNA, 50 bp, homo sapien
caggacttctggaccttcatgtgacrcccgagtccccaggatttgctgtg

SEQ ID NO: 113686 - DNA, 50 bp, homo sapien
ccacctcttatatagaaacatgaaawtgcccttttatggacttataggca

SEQ ID NO: 113687 - DNA, 50 bp, homo sapien
actcacagtgctttttatccagaggygtggacttagtactccaaaggagt

SEQ ID NO: 113688 - DNA, 50 bp, homo sapien
gaccaccccatctcactctctaaaaygctggcaatgccctcagttctaaa

SEQ ID NO: 113689 - DNA, 50 bp, homo sapien
tttctgtacctgaggacacatttgcraaaatcttagcgccgtctcaggct

SEQ ID NO: 113690 - DNA, 50 bp, homo sapien
gaaggaactcagtgaacaagtcaacrgaaaaatataaaatattttagaat

SEQ ID NO: 113691 - DNA, 50 bp, homo sapien
ttgtgcaagctcaattgaacagcaasaactagatgcaaggaagaagtcag

SEQ ID NO: 113692 - DNA, 50 bp, homo sapien
cttcccataggccttaaggaagctgraatctaccagaccccaagacaccg

SEQ ID NO: 113693 - DNA, 50 bp, homo sapien
gagaatcattcaattgggccagaagraagttctagatatttttgtcagat

SEQ ID NO: 113694 - DNA, 50 bp, homo sapien
aagactattggaataggagcttacayaggtaattgagtgattctttgctt

SEQ ID NO: 113695 - DNA, 50 bp, homo sapien
agcttcaacagccttgttacttctargcaccttcagctatttgcaagaat

SEQ ID NO: 113696 - DNA, 50 bp, homo sapien
cacaaatacattgaacaagaggtcaygtgcttttaggtgttaaaagatgt

SEQ ID NO: 113697 - DNA, 50 bp, homo sapien
tctacttcaggctgtcaggaagttgmgttttgaatatgctcagtgtgaga

SEQ ID NO: 113698 - DNA, 50 bp, homo sapien
ttttttgtaaattagtccaaaattakaaaattaagctggaaggagtattg

SEQ ID NO: 113699 - DNA, 50 bp, homo sapien
atttgtcttggagagctttccatagyaatatacgtggatcaatgtaatga

SEQ ID NO: 113700 - DNA, 50 bp, homo sapien
gcaatgttgatttacaagcatgtgcrtgagtctgtgtaccctggaaagta

SEQ ID NO: 113701 - DNA, 50 bp, homo sapien
  misc_feature (1)..(1): n is a, c, g, or t
ntaattaaacataactcttttgaacrtacaattcggtgactttttcacta

SEQ ID NO: 113702 - DNA, 50 bp, homo sapien
ggggtaacacaaaatcagagtagagyaagtagcagttttacacaggacaa

SEQ ID NO: 113703 - DNA, 50 bp, homo sapien
tgcatcaccatttgcagagcagttaygttgaagaaagcgaatatagcatc

SEQ ID NO: 113704 - DNA, 50 bp, homo sapien
ctggagtcctagttttagtattagargcaaagaagcagagttggaaggag

SEQ ID NO: 113705 - DNA, 50 bp, homo sapien
tttaagagcactaacacttgtaacasaatctgaagtatagttgccagtct

SEQ ID NO: 113706 - DNA, 50 bp, homo sapien
tttttcataatccctgtaagcactargacatggtacgaaatgatggacaa

SEQ ID NO: 113707 - DNA, 50 bp, homo sapien
ctccatttggggaagcacacttttgsagaagcactctcttaggtggtgcc

SEQ ID NO: 113708 - DNA, 50 bp, homo sapien
aataaactttgtcccagttaccaatkaccaaaaacaagtacaattttctg

SEQ ID NO: 113709 - DNA, 50 bp, homo sapien
gtctgcagcctcctttagggaactcrctctacactggaccactgacatct

SEQ ID NO: 113710 - DNA, 50 bp, homo sapien
ggtcaccttttcttgtcgtcctacaycaccaacaaaccttgtctatggct

SEQ ID NO: 113711 - DNA, 50 bp, homo sapien
ttttcttttctgtattatcataatcratactgcaaaattagtttttcagc

SEQ ID NO: 113712 - DNA, 50 bp, homo sapien
agagtgcttctttatcagtcttggaycttcagataaactacagcgagaag

SEQ ID NO: 113713 - DNA, 50 bp, homo sapien
gtcatctcttcgctaagtcaattccyacaaaaaggaagaagaagagtatt

SEQ ID NO: 113714 - DNA, 50 bp, homo sapien
ttaggcactcataaagccaaatattrctcctacatacataacttttggtg

SEQ ID NO: 113715 - DNA, 50 bp, homo sapien
tcccttgcttgtctcttcatgtgtawattctcccccattgttcaaggact

SEQ ID NO: 113716 - DNA, 50 bp, homo sapien
tattcattcttttctaaaatccttgraagatcccactagggctgttcttg

SEQ ID NO: 113717 - DNA, 50 bp, homo sapien
tctccatgtttctagcaaagatcggractggtgtttcactaattctttcc

SEQ ID NO: 113718 - DNA, 50 bp, homo sapien
gtggctggcatgaaattaaccaaccstggatattagtatagcttagttaa

SEQ ID NO: 113719 - DNA, 50 bp, homo sapien
tgcatagtgttgaaagtgacggtagraaaattataatgtcttccctaagc

SEQ ID NO: 113720 - DNA, 50 bp, homo sapien
atcaagcacacccttattgttgaaaygagacgattttggcttttaattgc

SEQ ID NO: 113721 - DNA, 50 bp, homo sapien
ttaactagagtccaataaaaccacarcaaacagctttacttcctaaggtt

SEQ ID NO: 113722 - DNA, 50 bp, homo sapien
gtagcttttgacacacttataaaatsacgcagcagctttacattaagtaa

SEQ ID NO: 113723 - DNA, 50 bp, homo sapien
aggtcagcttcaccgtgggcaagcayaatcatcatttgcagacaaaagga

SEQ ID NO: 113724 - DNA, 50 bp, homo sapien
ggataatggttacttctggtggaacygctaatgacctggatgctggagag

SEQ ID NO: 113725 - DNA, 50 bp, homo sapien
ttagctttcctttatactgaatatgyaagtcttgtaccacatcccatttt

SEQ ID NO: 113726 - DNA, 50 bp, homo sapien
cctcccacatggtaaacatacactayaccactgatattaccaatgttata

SEQ ID NO: 113727 - DNA, 50 bp, homo sapien
acaagctatctgactccatagctcartaatcactatgatacattttgctt

SEQ ID NO: 113728 - DNA, 50 bp, homo sapien
ttggtattattaaagaatttatgtcwcttaacaaaagttcaaatgaatga

SEQ ID NO: 113729 - DNA, 50 bp, homo sapien
cttcccttttccagctgagctacaayacgaattcaagactcctggccatc

SEQ ID NO: 113730 - DNA, 50 bp, homo sapien
gaccccagtcttggagggaacagaargagtgagctaggtgatgaaggagg

SEQ ID NO: 113731 - DNA, 50 bp, homo sapien
cctgcagaagaggaaatgagggttasaggaccaaaatgagacagcttgga

SEQ ID NO: 113732 - DNA, 50 bp, homo sapien
tttattcaatcttctttctccttgamctctgtgatatatggaggtggttt

SEQ ID NO: 113733 - DNA, 50 bp, homo sapien
atgagacacttctcagaatcatccawccaggaaagaaaggggatagggtt

SEQ ID NO: 113734 - DNA, 50 bp, homo sapien
ttgtcagactgaagtacctggaagaytagacatgttagggatatttaggc

SEQ ID NO: 113735 - DNA, 50 bp, homo sapien
ggtcattggcactggaattaagttcrctcaagaggctgagctcagagggt

SEQ ID NO: 113736 - DNA, 50 bp, homo sapien
cttgccttattaaaataaatatgcaygatatacttctgggaaagggcaca

SEQ ID NO: 113737 - DNA, 50 bp, homo sapien
tgcatctcgtgctcacgttccagacycatcaacaggaagaaaacaagagg

SEQ ID NO: 113738 - DNA, 32 bp, homo sapien
caaatgcagtatatccraagtttaattcaaag

SEQ ID NO: 113739 - DNA, 50 bp, homo sapien
aaagtggacctttaagggatgtataygatgtacatgatgaaagaaaagca

SEQ ID NO: 113740 - DNA, 50 bp, homo sapien
ttattaaagtgtgaagcaatttggaygataccaatacacacaggcaggtt

SEQ ID NO: 113741 - DNA, 50 bp, homo sapien
aaaaagaaaaacctctttgctaatawctttcacttcacttccattgtatg

SEQ ID NO: 113742 - DNA, 32 bp, homo sapien
ccacataatctgtccartcctgacatacacac

SEQ ID NO: 113743 - DNA, 50 bp, homo sapien
tagaagcatacaatacacgctgttaygaatttgtttttatttttgagggg

SEQ ID NO: 113744 - DNA, 50 bp, homo sapien
gagacaaactgtcctatgatagaaayactaagaatagtttacttttccca

SEQ ID NO: 113745 - DNA, 50 bp, homo sapien
ctgccagtatgtgttgatgaaggacragacaggaaaggtaagagagacaa

SEQ ID NO: 113746 - DNA, 50 bp, homo sapien
tagatccctgcaaacaggataccaaygttctagtgcagctgtggttacta

SEQ ID NO: 113747 - DNA, 50 bp, homo sapien
tctttttgggtaaaagcatactgtayaaattcctatccattttttttcca

SEQ ID NO: 113748 - DNA, 50 bp, homo sapien
cctcctggacacaaatagaaaactcrctgagtcctgcttgcatttacaca

SEQ ID NO: 113749 - DNA, 50 bp, homo sapien
gtgtgacctctggcaggtaatacaaygatctgagcatggggctttctttg

SEQ ID NO: 113750 - DNA, 50 bp, homo sapien
ctttactcagatggcttgcataatartatcacttgtcacactgtatttta

SEQ ID NO: 113751 - DNA, 50 bp, homo sapien
gtatatttttaaatcttttagtcaartgtatcaaactccctgccaaaata

SEQ ID NO: 113752 - DNA, 50 bp, homo sapien
tggatccccttcctgctctgaatatyaacctgtgtcaggctggcgtttgc

SEQ ID NO: 113753 - DNA, 50 bp, homo sapien
gcttcagcagtcggattgtgttttgktgattgtatgtgtcaatatagtaa

SEQ ID NO: 113754 - DNA, 50 bp, homo sapien
aatttctgtttgcaggttaaagcccrattgagagagaaaagcacctcgac

SEQ ID NO: 113755 - DNA, 50 bp, homo sapien
catacccagattttctctggtttcckgccagaattgaaaattattgtaca

SEQ ID NO: 113756 - DNA, 50 bp, homo sapien
ttaaagacacttttctccactctgartacccagtgagtttccactttctc

SEQ ID NO: 113757 - DNA, 50 bp, homo sapien
cagagcagtcatttggttatttgtasgttctgtttcttcaagtatacata

SEQ ID NO: 113758 - DNA, 50 bp, homo sapien
aaggatcaaacatgggacatcaacakaaattttcttcagtgagagccagt

SEQ ID NO: 113759 - DNA, 50 bp, homo sapien
tgtatttttgtgtgtaattctttaayccatctggagatattttggttgtt

SEQ ID NO: 113760 - DNA, 50 bp, homo sapien
tgattatgaatctgtggagcaatcaygtcacaagaaggtgcagacgggga

SEQ ID NO: 113761 - DNA, 50 bp, homo sapien
aggtaacttcacagcatcaaagagarattctaaatatcagacatcttagc

SEQ ID NO: 113762 - DNA, 50 bp, homo sapien
tgaaaaggcatatacaaccagtaatraacagcaatttgaatataagtaac

SEQ ID NO: 113763 - DNA, 50 bp, homo sapien
atggcaaaacaattcacatggtatargtacaaggttgcccattgctgcat

SEQ ID NO: 113764 - DNA, 50 bp, homo sapien
aatttaatcaaagttttacatatcaraagagctttcaaaaatgaagaacc

SEQ ID NO: 113765 - DNA, 50 bp, homo sapien
tgtgctgaactcagtaccagccatasagtagggttaataattgtttggag

SEQ ID NO: 113766 - DNA, 50 bp, homo sapien
ggcaactagatggagcatgatctgayagaggaaactctgggaaaccatgc

SEQ ID NO: 113767 - DNA, 50 bp, homo sapien
ctggctttttatctgctctctgataygttggaaaatgtattctacctcta

SEQ ID NO: 113768 - DNA, 50 bp, homo sapien
tacataatttattctcattcactcartccttaactttgttctcttgtctc

SEQ ID NO: 113769 - DNA, 50 bp, homo sapien
tgtacttcctataataaacttcagcrattggctctctttcttgtcatcat

SEQ ID NO: 113770 - DNA, 50 bp, homo sapien
ctttgggtgttcatcgtgttatagasaagacaagccacatagaaaactcc

SEQ ID NO: 113771 - DNA, 50 bp, homo sapien
ggttttctcgggctttacctcctcaytaaataacagtgatagagttctga

SEQ ID NO: 113772 - DNA, 50 bp, homo sapien
tgctgagcatcctccatgctagggartacggctacaaagactacgtgtcc

SEQ ID NO: 113773 - DNA, 50 bp, homo sapien
ggtgtccctgcaggggaagcaagacracttctggaagagaagcctcagat

SEQ ID NO: 113774 - DNA, 50 bp, homo sapien
ctgtcatctctttatttttctgctcyactgttattgaaaatcaataaggc

SEQ ID NO: 113775 - DNA, 50 bp, homo sapien
aagtcacacagtcaggatctggccaygccaaattggaacctgagaggcca

SEQ ID NO: 113776 - DNA, 50 bp, homo sapien
aaatgcatttgtagtaaaacattagrgcaataaggtgaccagcccaaagt

SEQ ID NO: 113777 - DNA, 50 bp, homo sapien
cccatctcctcacatcttaaccttaygtctctagccagttcccagcaact

SEQ ID NO: 113778 - DNA, 50 bp, homo sapien
caaggctaaagttacaaatttggtckatggtataagtctcataaagtttt

SEQ ID NO: 113779 - DNA, 50 bp, homo sapien
ttaaggtctttgacatcagatactcygccttttgtaaaataagattaaaa

SEQ ID NO: 113780 - DNA, 50 bp, homo sapien
taatgttttttattttttaggagagwcagcaagaatgctttgatctgctt

SEQ ID NO: 113781 - DNA, 50 bp, homo sapien
tacttatagcaacagtgcttcaatcmagaacggctgggcatatgccctgg

SEQ ID NO: 113782 - DNA, 50 bp, homo sapien
gttggtttcactagagtaaaagacamgtgaccactgtacaggacacaaac

SEQ ID NO: 113783 - DNA, 50 bp, homo sapien
gtccaaagctcataacagcacattaraagaaagtggggagcctgttagaa

SEQ ID NO: 113784 - DNA, 50 bp, homo sapien
ctcctatggtaatgatgagttctcaytctggtagttcatgtgagaactga

SEQ ID NO: 113785 - DNA, 50 bp, homo sapien
actgcttgtcatctcattctcttgaygaacacttaccctggggatgcaag

SEQ ID NO: 113786 - DNA, 50 bp, homo sapien
ctgccttttgtccattgacttttcarcaaaccataagaagtcaaagggaa

SEQ ID NO: 113787 - DNA, 50 bp, homo sapien
atgttttactacaaatgcatttaagsagatgtcaaggggattttcaaaag

SEQ ID NO: 113788 - DNA, 50 bp, homo sapien
gccttctggtaagagtagtggaaaamgggtaggatcattttgcgatcaca

SEQ ID NO: 113789 - DNA, 50 bp, homo sapien
tgtggtgaaggtggggacatgatgasgacttagctctcagagttagcaat

SEQ ID NO: 113790 - DNA, 50 bp, homo sapien
cagttatcgttactaaagaagagtcrggtaaatataaatctgaatgtaat

SEQ ID NO: 113791 - DNA, 50 bp, homo sapien
agaaaagaagggaaaatgcagaaaaygttatcaatccatcagtctagaaa

SEQ ID NO: 113792 - DNA, 50 bp, homo sapien
tcttggtcatacaacagtacttttaraaattagctagtcgtagtcgccct

SEQ ID NO: 113793 - DNA, 50 bp, homo sapien
gcaacgtgcatgtgccattattcackggatgagcttgaggtggatgaact

SEQ ID NO: 113794 - DNA, 50 bp, homo sapien
gaagtcagggtttgtcaagactaacmagtgactccactctggtgatttga

SEQ ID NO: 113795 - DNA, 50 bp, homo sapien
aaacagctttctcagtagtggtgctkagaggttcctcaggcagaggatcc

SEQ ID NO: 113796 - DNA, 50 bp, homo sapien
cccaagaaacacatacatactggcakacctgctttgtgctctgctctatt

SEQ ID NO: 113797 - DNA, 50 bp, homo sapien
taaaatcttgagttcctttgaaggarattccggggacctagctagcctta

SEQ ID NO: 113798 - DNA, 50 bp, homo sapien
aacaatttgtttgtccaagagaatartaagcaaatgcattttcctggatt

SEQ ID NO: 113799 - DNA, 50 bp, homo sapien
gaaagtaaaattataatgcttggcayaatgtagacagaaatagaaattcc

SEQ ID NO: 113800 - DNA, 50 bp, homo sapien
gaagctgaagtagtgactgcacaacrgttatgtaaccaaccttaaatagt

SEQ ID NO: 113801 - DNA, 50 bp, homo sapien
cttaggtagactatattgatagctgraggagtgatagagtactctgtttt

SEQ ID NO: 113802 - DNA, 50 bp, homo sapien
gtagccttcccattctgtacctgcaygtgactttgaggccctacgactta

SEQ ID NO: 113803 - DNA, 50 bp, homo sapien
ctcttgatgcgtcagtgatagcaacrgtcaaacacaatctggaggaactg

SEQ ID NO: 113804 - DNA, 50 bp, homo sapien
cccacccaatctttgcagggctttaygactctgctccttggacacttgcc

SEQ ID NO: 113805 - DNA, 50 bp, homo sapien
attttgtctttgcctgatcagcttckcttctttgtctaccccaacttgac

SEQ ID NO: 113806 - DNA, 50 bp, homo sapien
aacctgaataaatcctgggccttatstcaccaagtttcagggcagtgtaa

SEQ ID NO: 113807 - DNA, 50 bp, homo sapien
acaggcacctccatatcacatgcatyctcacatgcacaatcctagaggca

SEQ ID NO: 113808 - DNA, 50 bp, homo sapien
ttatggacagggcatagcttttgagwcacacagacctgtattttaaatcc

SEQ ID NO: 113809 - DNA, 50 bp, homo sapien
ataaaagtaatgcaccgagttgatcrcaaaagatttgcgtgggcatctta

SEQ ID NO: 113810 - DNA, 50 bp, homo sapien
gctccataacctagatagaagaggtraaaagttcagatccttaacaaagg

SEQ ID NO: 113811 - DNA, 50 bp, homo sapien
atttaaagttcaccctgtcagttacrggcttatcaaatactaagtggctg

SEQ ID NO: 113812 - DNA, 50 bp, homo sapien
tcaggtggcccctctcctctgaagtkgtctgtttgttcttctgtcttctt

SEQ ID NO: 113813 - DNA, 50 bp, homo sapien
agggacctctactatcctcagtcaasggtgcttttgtttggtattttggg

SEQ ID NO: 113814 - DNA, 50 bp, homo sapien
cagaaagagctccacaaaggttgacraattattcaaaccagcaacgatgt

SEQ ID NO: 113815 - DNA, 50 bp, homo sapien
aatttactgtgctacagaatttttgsatgaagtaattggccatgttgctc

SEQ ID NO: 113816 - DNA, 50 bp, homo sapien
ctagcaggtgacttcatacttctaayctcagtgtccttatgagatcttga

SEQ ID NO: 113817 - DNA, 50 bp, homo sapien
gttagaagtatgaagtcacctgctartaagttagtaagttcctaactagt

SEQ ID NO: 113818 - DNA, 50 bp, homo sapien
gtgtgctgcttgcccctttatcaaayatacactgtgccctatggggagtc

SEQ ID NO: 113819 - DNA, 50 bp, homo sapien
ttaggatctacagctgctagggatayagtggattaatgccttacctagtg

SEQ ID NO: 113820 - DNA, 50 bp, homo sapien
aattgctttcactttgttttatttcractctatgtgcacccagtgtatgt

SEQ ID NO: 113821 - DNA, 50 bp, homo sapien
gtcatgaaagataaagactgagaaayggtcacagattggaggagaataag

SEQ ID NO: 113822 - DNA, 50 bp, homo sapien
agatgccaacccaggcacccttgtgragaaatctggcccttgcagcaatt

SEQ ID NO: 113823 - DNA, 50 bp, homo sapien
tatgctaatgttctcttgtcaagaayctttgagagcacacactatataaa

SEQ ID NO: 113824 - DNA, 50 bp, homo sapien
gccatgtgaacgtgcctcttagcagyattacagtccatgcaaagatgtat

SEQ ID NO: 113825 - DNA, 50 bp, homo sapien
caaaaaaaaagaaagttttgagtgargatctgaagagtctttggtgcatg

SEQ ID NO: 113826 - DNA, 50 bp, homo sapien
agcactgcgaggtcctcaactgtgamaagtgtttactatccaaaacccat

SEQ ID NO: 113827 - DNA, 50 bp, homo sapien
cacttcatgaaaatgactgttactayggcaacttttccatgtgtattatt

SEQ ID NO: 113828 - DNA, 50 bp, homo sapien
acagaagccccttgtagagtacaggmataagcagagtaaatctaaatgaa

SEQ ID NO: 113829 - DNA, 50 bp, homo sapien
agagttttgcttttgcaattcttcarcttctacaattttatatgctcgag

SEQ ID NO: 113830 - DNA, 50 bp, homo sapien
tctagaaagcaattcctgcagcaaasaaaagatatataacatgcagatac

SEQ ID NO: 113831 - DNA, 50 bp, homo sapien
tgtcatctcttttatttctcccttcraagccacattcttcaccaactatt

SEQ ID NO: 113832 - DNA, 50 bp, homo sapien
agaggatagtcattataatgggaaaycataaactgatgtggaatttgacc

SEQ ID NO: 113833 - DNA, 50 bp, homo sapien
tcccaggagacctagcaggactggartattagttgtcccatgtgcctcct

SEQ ID NO: 113834 - DNA, 50 bp, homo sapien
gcctccttttattttcccagtactcmagttaatcctaaaagtgggaaaat

SEQ ID NO: 113835 - DNA, 50 bp, homo sapien
ctggccagggtgtggagggtgtaaayagtacctgacaaaatagattggtg

SEQ ID NO: 113836 - DNA, 50 bp, homo sapien
ccccagcttctttgttgttcccagayggatttgttaagcctcttaaccta

SEQ ID NO: 113837 - DNA, 50 bp, homo sapien
atcagcttcatctttatcccaagtcytctgactcgtccttctggttcctc

SEQ ID NO: 113838 - DNA, 50 bp, homo sapien
cagagctttcaagctggaaccacacraaaagcttagcaaatggttttaaa

SEQ ID NO: 113839 - DNA, 50 bp, homo sapien
gtaaggttcatcttcatgaagttaawctatgtctcacacttctgtccagt

SEQ ID NO: 113840 - DNA, 50 bp, homo sapien
cccgcttgatgtattctgtctctaargccttgctcttatttccacactgt

SEQ ID NO: 113841 - DNA, 50 bp, homo sapien
tgatttatctgtgtattcattatgaygagatttagctacaagtaaccaag

SEQ ID NO: 113842 - DNA, 50 bp, homo sapien
caataagtggcagccacagtttacaygagcacagagttcaaaggaaatca

SEQ ID NO: 113843 - DNA, 50 bp, homo sapien
acatagggagtagtgtgggagaaacygttggaaagctaggttgatgcaat

SEQ ID NO: 113844 - DNA, 50 bp, homo sapien
agaaaaaatgcctttttccttcatcrgcatatatgcaaagagtaaactgg

SEQ ID NO: 113845 - DNA, 50 bp, homo sapien
gtgctgttaccagagatagcagatcratttttactgtcaaaataccacta

SEQ ID NO: 113846 - DNA, 50 bp, homo sapien
ataggtagaaggcatttatatgtgamagatactatagtggagcatatttt

SEQ ID NO: 113847 - DNA, 50 bp, homo sapien
aaatattgttcacacgagtatcctayaaaataatcttatatgccacatgc

SEQ ID NO: 113848 - DNA, 50 bp, homo sapien
aaatggcatagtgtttgcctctaacrtacgtgcatcctcccgtatacatt

SEQ ID NO: 113849 - DNA, 50 bp, homo sapien
tcagtatttcttatattgtaaagaarcattgcatctgacgttaatttcta

SEQ ID NO: 113850 - DNA, 50 bp, homo sapien
gtctgccattacccttggtgtaatcrgaaagaatcaatatatcttttggg

SEQ ID NO: 113851 - DNA, 50 bp, homo sapien
gatgtttactagagaaaaagaatacraaggcaataattaaatattatatt

SEQ ID NO: 113852 - DNA, 50 bp, homo sapien
tctccagcccaaaactcacatggaasgaagtaagaaaggctttggtgcag

SEQ ID NO: 113853 - DNA, 50 bp, homo sapien
aattctactttctctcttactattasgtatatgcatctaggcaagtaaca

SEQ ID NO: 113854 - DNA, 50 bp, homo sapien
gcagggtgatagtggaagtatagcaytacaatagcaggcaagtctgcagc

SEQ ID NO: 113855 - DNA, 50 bp, homo sapien
gagatttaggagtcatgggaaaatayaccaacacagtaaatcttgtgtta

SEQ ID NO: 113856 - DNA, 50 bp, homo sapien
ccttatctacattaataatagcaacrgacctatcaaccagaagtaataca

SEQ ID NO: 113857 - DNA, 50 bp, homo sapien
ccttacaataagattttcccaaatayggctggcttgtctccaacagttgt

SEQ ID NO: 113858 - DNA, 50 bp, homo sapien
ttcttatgtaaatcttgatccctaamgtcatgtgaaaagagggacggggt

SEQ ID NO: 113859 - DNA, 50 bp, homo sapien
tttaaaagcatcatgttcttaaaacmacctcactcatttcgttgactcct

SEQ ID NO: 113860 - DNA, 50 bp, homo sapien
caaattctgaattcatatttccaaarctgaaggtatctgaaaggcatctt

SEQ ID NO: 113861 - DNA, 50 bp, homo sapien
cagcttgtttcttgaaaggtttagcraaagcaatctctatggtgatgagt

SEQ ID NO: 113862 - DNA, 50 bp, homo sapien
atcgaccctagtgcaatggcaagaakcgaattaaattgacttccgcccca

SEQ ID NO: 113863 - DNA, 50 bp, homo sapien
agatgtttgtcacaacatatagtgaragaagcacgttgagacagagagaa

SEQ ID NO: 113864 - DNA, 50 bp, homo sapien
attgtgattatggttgactgtaacayatgagtgatttttcctgccaggaa

SEQ ID NO: 113865 - DNA, 50 bp, homo sapien
ggttccccaacattctcgagttgccrattactgacacactcacactcttt

SEQ ID NO: 113866 - DNA, 50 bp, homo sapien
atggaataagattctggaaaccactmtaatagctctaagattttttaaat

SEQ ID NO: 113867 - DNA, 50 bp, homo sapien
gggcccacctggtcccattcttcctstagtgcgcagcacacccactagta

SEQ ID NO: 113868 - DNA, 50 bp, homo sapien
tttctactgatctcattgtctcttcsatgcttgtacccaagtacccacaa

SEQ ID NO: 113869 - DNA, 50 bp, homo sapien
aaaaagttgttatttcaggttttcawgattatgggccatgtttcttttca

SEQ ID NO: 113870 - DNA, 50 bp, homo sapien
cagttatggagggaataatgacagcrcaatttaaaaaaaatccagcagca

SEQ ID NO: 113871 - DNA, 50 bp, homo sapien
gccgatgcataaagtcagcctgttcmaagtgctcagggacttagcaaaat

SEQ ID NO: 113872 - DNA, 50 bp, homo sapien
tatcccaaaattgtacactagaagayatgaaggacacaagcgtgaactta

SEQ ID NO: 113873 - DNA, 50 bp, homo sapien
ctattgctggtgtatatccgtctccyacgctatttctttgccatctggaa

SEQ ID NO: 113874 - DNA, 50 bp, homo sapien
aagaaccaccggtagagcaaacacasaaacatgaaagagaaaaagataaa

SEQ ID NO: 113875 - DNA, 50 bp, homo sapien
tggctgccaagggaacctgattttaygaatagtttccatctctagagaag

SEQ ID NO: 113876 - DNA, 50 bp, homo sapien
gatagaaccctccattcattaggaaraataacttgccatacataagttgt

SEQ ID NO: 113877 - DNA, 50 bp, homo sapien
caaaataccttcaaaagctttaacartagaatatagcaggcagaagaaag

SEQ ID NO: 113878 - DNA, 50 bp, homo sapien
agataacaaccagagtcaaacctcargaaatatctaccaaatgtttactg

SEQ ID NO: 113879 - DNA, 50 bp, homo sapien
tggggaacatataggactgagaagakgtaaggaaccatttgggaagtaga

SEQ ID NO: 113880 - DNA, 50 bp, homo sapien
tacctacaatttttaaggccaaataycttaatgtgaaaattttaaaaaag

SEQ ID NO: 113881 - DNA, 50 bp, homo sapien
tacattaatcaacaatgcattccacygtaagtatctgagctggatattta

SEQ ID NO: 113882 - DNA, 50 bp, homo sapien
gctcaaaggtgtgttggcttactgaygttctccagggcaatagagggtgt

SEQ ID NO: 113883 - DNA, 50 bp, homo sapien
gccaaaggaaatatttgtagtaaagrcccatctgttaaagaaatcaaatt

SEQ ID NO: 113884 - DNA, 50 bp, homo sapien
cacaagtgctgctctctaggaactckcaatttagtaaggaagatataccc

SEQ ID NO: 113885 - DNA, 50 bp, homo sapien
ctttgaaaacggcgttagaatggtakgttttaaaagcatggaggcttata

SEQ ID NO: 113886 - DNA, 50 bp, homo sapien
gaatctttaagttgagagttccctasagcattgagtcaatagaggaatga

SEQ ID NO: 113887 - DNA, 50 bp, homo sapien
taatgcaagcatgctacatacactayaatttttgtaaccttatttgatca

SEQ ID NO: 113888 - DNA, 50 bp, homo sapien
gaatagagcaaataatgactaaataygtaagcgtccaggaacagtacttt

SEQ ID NO: 113889 - DNA, 50 bp, homo sapien
tttgaacaaagaaatcccattcatakaaataaatcaggtggtaacatctg

SEQ ID NO: 113890 - DNA, 50 bp, homo sapien
gtcagggtgtttgacaacaaggccartctagtctatcaattgagtttcag

SEQ ID NO: 113891 - DNA, 50 bp, homo sapien
gaggaagctcttgagagtaatataayattgtttgtgacactcactgatct

SEQ ID NO: 113892 - DNA, 50 bp, homo sapien
ctctggtagttcatctgcttgcaaasgtatgtcatttctctttctgaatg

SEQ ID NO: 113893 - DNA, 50 bp, homo sapien
ttcccaacacaaagtagtctataaawggaaggctctttcaggagaggaat

SEQ ID NO: 113894 - DNA, 50 bp, homo sapien
attcataaccaaatcaaaatgaaacsaaaataagagtggttatgaaaatt

SEQ ID NO: 113895 - DNA, 50 bp, homo sapien
gagccctggatctcttgttaataaaygctgcacccacagtggtagagaaa

SEQ ID NO: 113896 - DNA, 50 bp, homo sapien
ctttattctgtattgatataattacrgaaatggataatagtgattttttt

SEQ ID NO: 113897 - DNA, 50 bp, homo sapien
atgcaggaaatgaaatgtctgtatcmaccaagacattttttagttaggta

SEQ ID NO: 113898 - DNA, 50 bp, homo sapien
aaaacaaccacaaccaagcatctaaytgttaagtaaacatatctctcctt

SEQ ID NO: 113899 - DNA, 50 bp, homo sapien
agtgaggaaaagaatctcaggtagtyaaccttatgtggataattggacac

SEQ ID NO: 113900 - DNA, 50 bp, homo sapien
accttccttcatatactggtctttamactggtttacaataaagtcatgtt

SEQ ID NO: 113901 - DNA, 50 bp, homo sapien
caaaagagagtgaccagccggataaygtataaagaagatatagtatttta

SEQ ID NO: 113902 - DNA, 50 bp, homo sapien
tgcattgatattttgtgcgctttttscaagtgtgctgtattttgactaaa

SEQ ID NO: 113903 - DNA, 50 bp, homo sapien
atgacttttttggaagatatgtagayatagtcatagatgtagatatattt

SEQ ID NO: 113904 - DNA, 50 bp, homo sapien
tggttcagtaaaagcagctagacacwccaaacaatacataccattttatt

SEQ ID NO: 113905 - DNA, 50 bp, homo sapien
tatgatgcagtaatttgttcagtatkaattgatacctgcctctaggcatg

SEQ ID NO: 113906 - DNA, 50 bp, homo sapien
aattacatgctagagaagagcttacratagaatgggatttctttcagggt

SEQ ID NO: 113907 - DNA, 50 bp, homo sapien
gagacttgaggagattaatgaggaartgatacgatgcttgcttccaccag

SEQ ID NO: 113908 - DNA, 50 bp, homo sapien
atgaacagagagactaggtaataaartatcacagacgaacttaatacaat

SEQ ID NO: 113909 - DNA, 50 bp, homo sapien
gatgttacctgctgccaattgtaaaytattgtgtatgaaatactgatatt

SEQ ID NO: 113910 - DNA, 50 bp, homo sapien
tcgaaggagacttttcccagttgcaraattacctggttaattaattcagg

SEQ ID NO: 113911 - DNA, 50 bp, homo sapien
catttttgtcttataaattgtaaaakgtccaatagcttctctacactttc

SEQ ID NO: 113912 - DNA, 50 bp, homo sapien
actcttttgaccccatttatttcaaktgccacattaaggtaagagtttca

SEQ ID NO: 113913 - DNA, 50 bp, homo sapien
atattaagataatgatgatgatggckataaatagatgaagatgatgatag

SEQ ID NO: 113914 - DNA, 50 bp, homo sapien
tactcaaggtagcaacccattcatcrcctttagttcttctatctcttccc

SEQ ID NO: 113915 - DNA, 50 bp, homo sapien
tttgagttccttggggaatgagccaygttttaattcacctgaggcaggcc

SEQ ID NO: 113916 - DNA, 50 bp, homo sapien
tacgctaatattatctcttaagcgcrtaggaatctctatttgctgtattt

SEQ ID NO: 113917 - DNA, 50 bp, homo sapien
atttgttttaactgtgaaaggtagcrtcatcaaaacagcaatgctcccca

SEQ ID NO: 113918 - DNA, 50 bp, homo sapien
ctcagatttgactacggactactcartaatttatccagctgagcagcctt

SEQ ID NO: 113919 - DNA, 50 bp, homo sapien
attttcctcagaattataaaaagaarttaagctcaatcactatttgaatt

SEQ ID NO: 113920 - DNA, 50 bp, homo sapien
ttactgtctggctctttacaaaatasgttttcagacccttactctagagg

SEQ ID NO: 113921 - DNA, 50 bp, homo sapien
tgatgggatcaaagtgatgacaaaayataaactatgacagaaaatagcat

SEQ ID NO: 113922 - DNA, 50 bp, homo sapien
tgtgaatcccattcatgtaccactasaactttatttcccaattctgtcct

SEQ ID NO: 113923 - DNA, 50 bp, homo sapien
tatgtctgctttcacataatgatgayagaattaagttgttggaatagaga

SEQ ID NO: 113924 - DNA, 50 bp, homo sapien
acgtgctctcaatacattattttacrctgaatgcatatacacccacacat

SEQ ID NO: 113925 - DNA, 50 bp, homo sapien
gtttatcttgctcatagtcaaacagytcatcagtgtctggcaggatttat

SEQ ID NO: 113926 - DNA, 50 bp, homo sapien
ttactttgttcctgatggttcaaatkatcttactcttaccaaagtgggat

SEQ ID NO: 113927 - DNA, 50 bp, homo sapien
tgctgatatgaagtatgagctctctraaaataggtattactttttggtaa

SEQ ID NO: 113928 - DNA, 50 bp, homo sapien
gagcagagaagtggtggtgttcttayagttgtgcttctgacagaggaatt

SEQ ID NO: 113929 - DNA, 50 bp, homo sapien
atttgttcagccggatgcttgggtcyacttctctgtgattcttatcatgg

SEQ ID NO: 113930 - DNA, 50 bp, homo sapien
caatattatctgtgaggaattttacrcagtcttactagcagctctcagca

SEQ ID NO: 113931 - DNA, 50 bp, homo sapien
tgtattcaaaatgtagttattacacrgccattgtgcagctattgtttagg

SEQ ID NO: 113932 - DNA, 50 bp, homo sapien
cttgagaacagatgtttgaaaacaartgacaggataaggaggtattggaa

SEQ ID NO: 113933 - DNA, 50 bp, homo sapien
ttaagtaagggatacttaacctatamgtggctgccaagagtgggtttggg

SEQ ID NO: 113934 - DNA, 50 bp, homo sapien
atttcagccttgttttaatcagaacratcacagatctcagtgaactaaga

SEQ ID NO: 113935 - DNA, 50 bp, homo sapien
aaaatacatgttctacttaggaaatraaggtcttcaagtctttaaaactg

SEQ ID NO: 113936 - DNA, 50 bp, homo sapien
ttaactttgccaattacagatacaaraggttaggaaaactgaagaaaccc

SEQ ID NO: 113937 - DNA, 50 bp, homo sapien
tctttctactctcctctttacatcawcttttgcttattgcctggtttttg

SEQ ID NO: 113938 - DNA, 50 bp, homo sapien
taataaaaggggaaacatatttttaycctgcagtccttatgtagtcatga

SEQ ID NO: 113939 - DNA, 50 bp, homo sapien
tccatggtcaatactgaattggttcyctaagtaacaaagacttttttttt

SEQ ID NO: 113940 - DNA, 50 bp, homo sapien
atgtgattggtgccccctgaagttaygcagtgtgatggacctgaacaaga

SEQ ID NO: 113941 - DNA, 50 bp, homo sapien
tctagaacatgaatactatgctcacragtaaacctgctccaagggatact

SEQ ID NO: 113942 - DNA, 50 bp, homo sapien
caacctcgaatgtgtctcccaccaawagggtctcacgtaggattcaaaca

SEQ ID NO: 113943 - DNA, 50 bp, homo sapien
cagcatgaattttgcaaagacacacsatatctaaatcagaactcagggcc

SEQ ID NO: 113944 - DNA, 50 bp, homo sapien
tggataacgagcttatttgcctaagratgtaaattgcaaacctgaacttg

SEQ ID NO: 113945 - DNA, 50 bp, homo sapien
aactcacaagcatgcatacttcctcrcaacatagggcaagatttaaagta

SEQ ID NO: 113946 - DNA, 50 bp, homo sapien
agtcttaggacagtaggggtcatccmagagcaatcctctctaaattttta

SEQ ID NO: 113947 - DNA, 50 bp, homo sapien
acattccatgaacaagaaccagtgaraacataaacagactgataggccat

SEQ ID NO: 113948 - DNA, 50 bp, homo sapien
gagaggtgggcatggtgatttgctasagaactgtctcatggtaagttggt

SEQ ID NO: 113949 - DNA, 50 bp, homo sapien
ttccaacaaaggagaaggacatacayatttaacacaacagctttctggat

SEQ ID NO: 113950 - DNA, 50 bp, homo sapien
cattgtaacagtgttcacctttggayatctctcatggtgagcaagttcct

SEQ ID NO: 113951 - DNA, 50 bp, homo sapien
aatgcctgaaatgattgtgtttggayggtggttaatattccatctccgag

SEQ ID NO: 113952 - DNA, 50 bp, homo sapien
tgagcaagttcctctttatgtttccrctgtatgaaaatatatagggtaat

SEQ ID NO: 113953 - DNA, 50 bp, homo sapien
ggagagatctggaatttcctataaamgcaagaaagactatgaactaacgc

SEQ ID NO: 113954 - DNA, 50 bp, homo sapien
agtgtatgtactgttgaaagctgaayaaatctttgtgggttactagtatc

SEQ ID NO: 113955 - DNA, 50 bp, homo sapien
gccccacccataggatcattcttaaygtgcattgttcctcagatgttaga

SEQ ID NO: 113956 - DNA, 50 bp, homo sapien
tctaataatcctagagtaagaaggcygatataagaatatttgcatacaca

SEQ ID NO: 113957 - DNA, 50 bp, homo sapien
ctcaaatagagttaaatatgctaaayagatgcagataaacaaaacagatg

SEQ ID NO: 113958 - DNA, 50 bp, homo sapien
gctaactatctcacattttcgttgaygcttcaccacaaccctgtgaaata

SEQ ID NO: 113959 - DNA, 50 bp, homo sapien
gaacacagaataattagtcctttaasaactgtctatggctgctttcatgc

SEQ ID NO: 113960 - DNA, 50 bp, homo sapien
tgagttcagtaattctcaggtaaaartgcaatgatggtgggcaggaagtt

SEQ ID NO: 113961 - DNA, 50 bp, homo sapien
tgtcaactctgtgataaaaacagtcrtagaatggataacccaatttgccc

SEQ ID NO: 113962 - DNA, 50 bp, homo sapien
gaaggcccaggacattactctacacragcggagactttatgtgtacactt

SEQ ID NO: 113963 - DNA, 50 bp, homo sapien
agagaggctacagctttcactccaaygagtctgaagcagatgcttccatc

SEQ ID NO: 113964 - DNA, 50 bp, homo sapien
cgccctgccaagtataactgtcttayatatcctattcactgccaaatctc

SEQ ID NO: 113965 - DNA, 50 bp, homo sapien
gcataagtgaaactttatgtatagcrgactctggtgcccttacttgtctt

SEQ ID NO: 113966 - DNA, 50 bp, homo sapien
tgggatcagttggtatcctagaaaastctcactcctacaatagctcccaa

SEQ ID NO: 113967 - DNA, 50 bp, homo sapien
ttgaaaacatagggtcatggtccaaytgacagaaaaaagaacagatgtgg

SEQ ID NO: 113968 - DNA, 50 bp, homo sapien
gtgctagagtagaacatttaagattkaagaggttaacataaaaatcatga

SEQ ID NO: 113969 - DNA, 50 bp, homo sapien
tgctaatggtttaggaagtagaaatkcttggagataaaattgacttctat

SEQ ID NO: 113970 - DNA, 50 bp, homo sapien
tgctattacgcctgaaagtaatctgsaaacctaatcaaaagccatcattg

SEQ ID NO: 113971 - DNA, 50 bp, homo sapien
cataaaggcaacatctggtgtgctgsaaagaatgctgaagagaacctgga

SEQ ID NO: 113972 - DNA, 50 bp, homo sapien
acagatacgtgccaaatcaccctttkcaaactaatagtttctcttttatc

SEQ ID NO: 113973 - DNA, 50 bp, homo sapien
attatccattcaatttcatacatgcrataacacaaatgtatttttgtgag

SEQ ID NO: 113974 - DNA, 50 bp, homo sapien
ctcaaggtgcacgtggcttaactgaktatcctaaggtgttatccctgaag

SEQ ID NO: 113975 - DNA, 50 bp, homo sapien
ctttgtcagtgttgctaaagatttcycaattttactggacttcacaaaga

SEQ ID NO: 113976 - DNA, 50 bp, homo sapien
ttgccatccaggaactgataatagayttggcaaaaacacaaatgtaaaca

SEQ ID NO: 113977 - DNA, 50 bp, homo sapien
gaagcagctctttccatatgagctcrctttttcagaaaacctatccagtc

SEQ ID NO: 113978 - DNA, 50 bp, homo sapien
agcattggatatgtcctgccttattkgagattctagatcattagtttaga

SEQ ID NO: 113979 - DNA, 50 bp, homo sapien
aaacacttgagtgtattggaatggayaagattatagataagtatttggaa

SEQ ID NO: 113980 - DNA, 50 bp, homo sapien
aaaatagagacatgacacaatattaratttaaagccagggacttagaagc

SEQ ID NO: 113981 - DNA, 50 bp, homo sapien
cagttgcaccatttgcattactgccrattcaaacatttattcattatccc

SEQ ID NO: 113982 - DNA, 50 bp, homo sapien
gtatgtgcaattatatttctgtgtayattttgagaaataaattgcactgg

SEQ ID NO: 113983 - DNA, 50 bp, homo sapien
gtggtaactattttctttttatctastaacaggctatgtgaccttctaaa

SEQ ID NO: 113984 - DNA, 50 bp, homo sapien
ctctacctctaatagcctttattatkactttatgtttcatttgagtggat

SEQ ID NO: 113985 - DNA, 50 bp, homo sapien
aagccatgcaggcttatagtatgcarccttatatccatcagccaaagcta

SEQ ID NO: 113986 - DNA, 50 bp, homo sapien
ggagaggaattgagcctcttttttaygcaatatctccaactctgctagtc

SEQ ID NO: 113987 - DNA, 50 bp, homo sapien
gttgttgattacttgtggcagaaaayttatgagttccctgaaaataagag

SEQ ID NO: 113988 - DNA, 50 bp, homo sapien
agagagaaatgagcttctgaaatgcraaactatggattaatttcagaaat

SEQ ID NO: 113989 - DNA, 50 bp, homo sapien
agccatcttgccagccaccagtgtaragaagttttatccccagtctgtta

SEQ ID NO: 113990 - DNA, 50 bp, homo sapien
cagatgttctagaggaaactttatgsacttctggacagtgaagagctata

SEQ ID NO: 113991 - DNA, 50 bp, homo sapien
gaagtttgtctacattggaaatttasagtcaaagattgtggcatttctat

SEQ ID NO: 113992 - DNA, 50 bp, homo sapien
attttaacatgggagattccttatayggagttaatcagattaaaagtata

SEQ ID NO: 113993 - DNA, 32 bp, homo sapien
gtctttcaaattttcaygtgtcagaatatagt

SEQ ID NO: 113994 - DNA, 50 bp, homo sapien
ctggcacacccttgtttcaatatgasccatacaaattcatatactattcc

SEQ ID NO: 113995 - DNA, 50 bp, homo sapien
tctacatgattatagtttgtagataytaaggctatggattttttgataac

SEQ ID NO: 113996 - DNA, 50 bp, homo sapien
cagtgtttgaataaagtctacaggcstttaagcctctggttcaccccagg

SEQ ID NO: 113997 - DNA, 50 bp, homo sapien
catgtgcagtatttctaaaattacamatctccagacatgttcatttttat

SEQ ID NO: 113998 - DNA, 50 bp, homo sapien
gtgctgtgaaaactggctagctataygcaaaagattgaaactggacctct

SEQ ID NO: 113999 - DNA, 50 bp, homo sapien
ttgggagtcactcctaatggacatamgatttaattttggggtgctgaaat

SEQ ID NO: 114000 - DNA, 50 bp, homo sapien
gaaatctgagagagagtaaagcaaaragtagaggaaatgggattgttctg

SEQ ID NO: 114001 - DNA, 50 bp, homo sapien
gaaggagcaattattgctgtattgaygctcagtgcccttgaatttactct

SEQ ID NO: 114002 - DNA, 50 bp, homo sapien
ttaatcttgttaattatgctttttayaatgctaggtctaatacatataaa

SEQ ID NO: 114003 - DNA, 50 bp, homo sapien
tcttttaaggctggtctagtgacaamaactttatttagtgcttgcttgtc

SEQ ID NO: 114004 - DNA, 50 bp, homo sapien
cttttaagactatgaatttatggaakcatctgaaaattaaaaagcacata

SEQ ID NO: 114005 - DNA, 50 bp, homo sapien
acaacttgctcctgaatgatttctargtaaacaacaaaattaaggctgaa

SEQ ID NO: 114006 - DNA, 50 bp, homo sapien
cagcattcaatcgattctcactataytgttttataattttttgaaaaaaa

SEQ ID NO: 114007 - DNA, 50 bp, homo sapien
taagataaaacaaagtattacctcasttgccgcttattttagggccttta

SEQ ID NO: 114008 - DNA, 50 bp, homo sapien
tggagaaagatctaagaaggacctawgagctccctaatcaattggtcctc

SEQ ID NO: 114009 - DNA, 50 bp, homo sapien
tcaccagcttgcatgggatcatctcyactcaaggtctgagtttcttttct

SEQ ID NO: 114010 - DNA, 50 bp, homo sapien
cttttcttacagggacaactcgcatracttttaacacgtggtttcagaga

SEQ ID NO: 114011 - DNA, 50 bp, homo sapien
tggtggcatatttcctgtatttacawagctccctgttttatttttattat

SEQ ID NO: 114012 - DNA, 50 bp, homo sapien
gtgtcgactcactattgattcctgaygcaatgagtcccctagctctctcc

SEQ ID NO: 114013 - DNA, 50 bp, homo sapien
gacggagttgggctaatgctgtaggyatccgtagaaatctatatctatat

SEQ ID NO: 114014 - DNA, 50 bp, homo sapien
gataatgacagttttgaagagtactyacctgtgtctttttaacatgccca

SEQ ID NO: 114015 - DNA, 50 bp, homo sapien
ataacatcaaaatactgcattcagaytacaaagttccaagatttggcccc

SEQ ID NO: 114016 - DNA, 50 bp, homo sapien
ttttgtgccttaacgttttggaagaytatatagagaaattaattattcat

SEQ ID NO: 114017 - DNA, 50 bp, homo sapien
gccatagagatatagtgtttgtactyaggcagtcatatgacgtggtgcct

SEQ ID NO: 114018 - DNA, 50 bp, homo sapien
cttctctacaggccaaggccatagaratatagtgtttgtactcaggcagt

SEQ ID NO: 114019 - DNA, 50 bp, homo sapien
acccatattcactcagtgtgagcaargtgaaacggaggtcaaaacaatag

SEQ ID NO: 114020 - DNA, 50 bp, homo sapien
caaggctgccttctgggaactaaagkacagggcccaaagatgaccgtagg

SEQ ID NO: 114021 - DNA, 50 bp, homo sapien
catgtttttctacctatggtgagtayacatcaaagtaatctaaagaggca

SEQ ID NO: 114022 - DNA, 50 bp, homo sapien
attcccagatctttacgtgcaattgratattttacacatcaaaatcacta

SEQ ID NO: 114023 - DNA, 50 bp, homo sapien
attacaaaaattttgatgtatttcaraaaaacttatgagctaatgtgact

SEQ ID NO: 114024 - DNA, 50 bp, homo sapien
ctagtagaagaagcataaagctgccrgatgattttgattgctgacaccca

SEQ ID NO: 114025 - DNA, 50 bp, homo sapien
gcttgagctctatttgtcatatgtayggtttaagctctattgaagctgaa

SEQ ID NO: 114026 - DNA, 50 bp, homo sapien
tagtgagagtctcttctttagctggracagaatgacaagaaacaggatgc

SEQ ID NO: 114027 - DNA, 50 bp, homo sapien
acatctgacatcagctcacatgatcrcaaaaatttcttttagttccatta

SEQ ID NO: 114028 - DNA, 50 bp, homo sapien
ctttttgctagctcatcttcatgtayaaagcatcagtccaacaataatat

SEQ ID NO: 114029 - DNA, 50 bp, homo sapien
tttcagaaattaactatagccaatgyatttaaactatctgccaactataa

SEQ ID NO: 114030 - DNA, 50 bp, homo sapien
aagaagccaggtctacgtcagtaacrgtatagttcttacctggcctaaac

SEQ ID NO: 114031 - DNA, 50 bp, homo sapien
ctatatggtttggtttttcaaggatkagactaaacatcttagtttaactt

SEQ ID NO: 114032 - DNA, 50 bp, homo sapien
tttgttactttgattccctggtccamgtttggccatttgaaatggcacaa

SEQ ID NO: 114033 - DNA, 50 bp, homo sapien
gatctatataaaagacaagggactaygtaatgacaattgcttatacaaaa

SEQ ID NO: 114034 - DNA, 50 bp, homo sapien
aatttctggtctggtatctaaaagaragaggaagttccagtgtaaacctc

SEQ ID NO: 114035 - DNA, 50 bp, homo sapien
tgcttctgcctttaaacaaagtctaycttttccagtgctgaacttggccc

SEQ ID NO: 114036 - DNA, 50 bp, homo sapien
actctctaaactgacctaaataaaayaagtgccatgtaaatatctgagta

SEQ ID NO: 114037 - DNA, 50 bp, homo sapien
cagaaaatatgttaagtaattccaakgggcacaattttctagaatgcaat

SEQ ID NO: 114038 - DNA, 50 bp, homo sapien
tcctctgtcacattgaggaagctaarattgaaaatatatgagattcagat

SEQ ID NO: 114039 - DNA, 50 bp, homo sapien
tgaggattcaccaagcttaaaactayccaggttgatatgattactgtcca

SEQ ID NO: 114040 - DNA, 50 bp, homo sapien
ttaaaaacaacagacaggtgaggtcratgttctagctgatcaatgatatt

SEQ ID NO: 114041 - DNA, 50 bp, homo sapien
tgcagatttctcaaagaagatattaygggcaatgtgaccagctaatgcaa

SEQ ID NO: 114042 - DNA, 50 bp, homo sapien
accaaaaactgataataaccataacrtctacgaacaggtgaaaggacaaa

SEQ ID NO: 114043 - DNA, 50 bp, homo sapien
gtaaggcaaattggtgttttcacaaygttaccaacttcttttggtacata

SEQ ID NO: 114044 - DNA, 50 bp, homo sapien
ggattgcctcaagccaatttttgtaycagattatgtatttttgtgtatta

SEQ ID NO: 114045 - DNA, 50 bp, homo sapien
ttgctcccttccaaaagccaaattayactgccaaaaccttaaaaatctaa

SEQ ID NO: 114046 - DNA, 50 bp, homo sapien
gggcaccaaccagttcactgaaggastcaagtttgaagacagatgaaatg

SEQ ID NO: 114047 - DNA, 50 bp, homo sapien
acaattgtgatggtacagaaatcaaygatgatggggcatttgtccaaaga

SEQ ID NO: 114048 - DNA, 50 bp, homo sapien
cttccttgacttatactaaagcatcrccaatttgttttaataaaatgagg

SEQ ID NO: 114049 - DNA, 50 bp, homo sapien
ctttctgagctctttcagctctttcrttactgtcttttatgttgtatctt

SEQ ID NO: 114050 - DNA, 50 bp, homo sapien
agaaatgcatgtgattgagcattaayggcccagtgtttcaggcctgtctc

SEQ ID NO: 114051 - DNA, 50 bp, homo sapien
caccactcacgattgtaaaagtgaasagtcaacaagcagtcatccacttg

SEQ ID NO: 114052 - DNA, 50 bp, homo sapien
tgggattcagtcagatgtcagatacragggttagtgaggagcctgccagg

SEQ ID NO: 114053 - DNA, 50 bp, homo sapien
gacaagcattatgccattacgattaygctaaaaatgaagtccaagcacaa

SEQ ID NO: 114054 - DNA, 50 bp, homo sapien
ggagggtggactctgctgtgaagaaytccctgatttctgtagacaatgaa

SEQ ID NO: 114055 - DNA, 50 bp, homo sapien
tagtatattcacattgtcttaatccsagagagagagagagagagagagag

SEQ ID NO: 114056 - DNA, 50 bp, homo sapien
gtctcctccctccagcctgttaggargtcaggtacagatttatgctctaa

SEQ ID NO: 114057 - DNA, 50 bp, homo sapien
tatcatgctgttctatgacttcaaastataaataaagaacttagaaatat

SEQ ID NO: 114058 - DNA, 50 bp, homo sapien
gacataattcttagaaaacactccartgcagacagaacagaaatgcacta

SEQ ID NO: 114059 - DNA, 50 bp, homo sapien
gtgctgttactcattgggacatactsagaattacaaagagacagacattc

SEQ ID NO: 114060 - DNA, 50 bp, homo sapien
tttaatttttgtatactaaaacataktacgtctttatggagttttttgta

SEQ ID NO: 114061 - DNA, 50 bp, homo sapien
cacatcatggcctagtactctctaayggcttgtgattttaaaatgaagtc

SEQ ID NO: 114062 - DNA, 50 bp, homo sapien
aagatctttcttactttaaaacaaakctccactgtaaagagaattccatt

SEQ ID NO: 114063 - DNA, 50 bp, homo sapien
acaaacatcttgctcagctgtaaaarcaccttctctgctatccactgtat

SEQ ID NO: 114064 - DNA, 50 bp, homo sapien
tgtgagtgtcaaagagaactgtagayagagtgtacacaacccatcaatgg

SEQ ID NO: 114065 - DNA, 50 bp, homo sapien
taacaatatgcctgtctgatcctgtraaatttctttctgcaatgtgagtg

SEQ ID NO: 114066 - DNA, 50 bp, homo sapien
tatgaccttaacaccttccagattaygtattcaaactgttgaaacctttt

SEQ ID NO: 114067 - DNA, 50 bp, homo sapien
cttgaacagtttaaccacagtggaarccgacgtgactttggccttcaggg

SEQ ID NO: 114068 - DNA, 50 bp, homo sapien
aaccatttcttaagtttgaaagagaygataaaaagcagtcttagctatct

SEQ ID NO: 114069 - DNA, 50 bp, homo sapien
ttaaaacacataaacgaaaattaaamgagagttcacggcctagaagaaaa

SEQ ID NO: 114070 - DNA, 50 bp, homo sapien
tctttgcagtgagcgccacgtttccrgagtgtttggtccacaaagcgtta

SEQ ID NO: 114071 - DNA, 50 bp, homo sapien
gctgttgttttaagctactgtatttwaaattggcttattccacagtaatt

SEQ ID NO: 114072 - DNA, 50 bp, homo sapien
cagagatggaaggcagatagaatcayagcaaccttaggtgacagtataag

SEQ ID NO: 114073 - DNA, 50 bp, homo sapien
catgttcatatgattattgttcagayggaaacatttaaaaactcatgaaa

SEQ ID NO: 114074 - DNA, 50 bp, homo sapien
tctttgtgggtttttccagaggcgaycacgtgaaagttcatgtctcagca

SEQ ID NO: 114075 - DNA, 50 bp, homo sapien
taattaacatcaactgattgtaaacrttaatgccatccacaaagtaccct

SEQ ID NO: 114076 - DNA, 50 bp, homo sapien
agttgctagaggtcagtgatgtttayggaaggcctcaatatattgtccag

SEQ ID NO: 114077 - DNA, 50 bp, homo sapien
gacagtacttacatattctaaagagrcccctggtatttgaagtagaattg

SEQ ID NO: 114078 - DNA, 50 bp, homo sapien
tttactagggatcttagatcctttayctgacaaacagcttcctgcagtgg

SEQ ID NO: 114079 - DNA, 50 bp, homo sapien
gaattgttgttccccaggaccgagamagagattaaagtaggtaggtgggg

SEQ ID NO: 114080 - DNA, 50 bp, homo sapien
gtctatgaaatattgacacctatatyatccagacaattctagaatcacct

SEQ ID NO: 114081 - DNA, 50 bp, homo sapien
gtgtgccaaggtctatgctaagtgckatggatgtgaaaatgaataataca

SEQ ID NO: 114082 - DNA, 50 bp, homo sapien
tacctggttattctaatcggtcccaygagctaactgtttgtaggaacaag

SEQ ID NO: 114083 - DNA, 50 bp, homo sapien
aaaacagcattacttcactgcactaytaggattagagtatgctataatcc

SEQ ID NO: 114084 - DNA, 50 bp, homo sapien
agactcagaattaaaaagactttgamgtgaaatatcatttttgatacttg

SEQ ID NO: 114085 - DNA, 50 bp, homo sapien
ggaataaataatcctcttttatacayggtgaaattgactctcagagagtc

SEQ ID NO: 114086 - DNA, 50 bp, homo sapien
caaatcaataggaaataatagaatayggactttattatacattatatttt

SEQ ID NO: 114087 - DNA, 50 bp, homo sapien
tgagaaccagagccaggaggtggacrtaatttaccctcagccaagggaag

SEQ ID NO: 114088 - DNA, 50 bp, homo sapien
gttggtttatgaaatgatagtattaratggcccgtcttgcagaatgctgg

SEQ ID NO: 114089 - DNA, 50 bp, homo sapien
taacctgacttcaattgaaaagatarataaaccagagaaagacccagtgt

SEQ ID NO: 114090 - DNA, 50 bp, homo sapien
tcaagcaattgagatgatccaagacyaaaacctaggacatttcatttcca

SEQ ID NO: 114091 - DNA, 50 bp, homo sapien
atcatcattttctctgttgacaagamagaatttggaaacatgaaaagcaa

SEQ ID NO: 114092 - DNA, 50 bp, homo sapien
aataaatgaatgaataaaaatgttcrcgaattaagtgagagatgtgataa

SEQ ID NO: 114093 - DNA, 50 bp, homo sapien
cttcatgcagaatttcacatatggargatttcactttgtaattcccagat

SEQ ID NO: 114094 - DNA, 50 bp, homo sapien
actcaatgagcaagaaaactgaggtsaagcacttggaagcataccatgtc

SEQ ID NO: 114095 - DNA, 50 bp, homo sapien
ctaaagataataccatgtaaacctaygaggaaaaaaacagactggcatgc

SEQ ID NO: 114096 - DNA, 50 bp, homo sapien
cagcaaattggaaagattactgataygggcaaagtttcaggcagagtggg

SEQ ID NO: 114097 - DNA, 50 bp, homo sapien
agctgtagtaggggaagagtgtaaargtaatattcttctgcggatgtgtc

SEQ ID NO: 114098 - DNA, 50 bp, homo sapien
attgtgctagaaacagagaaagatgmaataaagtcgatgaaatggggaag

SEQ ID NO: 114099 - DNA, 50 bp, homo sapien
gaatggtataatttaggatgtcttcrtttaattcactgctaatgttgtat

SEQ ID NO: 114100 - DNA, 50 bp, homo sapien
ttcagctttttctaagagtgtcaacmggcttattttgtcaatatgtctat

SEQ ID NO: 114101 - DNA, 50 bp, homo sapien
acttgtcagtgcattattgtactcaygttgaaaagaattctttctgacat

SEQ ID NO: 114102 - DNA, 50 bp, homo sapien
tgaataatttatagaaagctctcacratgattcttccttcagtggggact

SEQ ID NO: 114103 - DNA, 50 bp, homo sapien
atggaacacaagacaactctctaaaytgtcaccttaacgctcttctcaca

SEQ ID NO: 114104 - DNA, 50 bp, homo sapien
ttcactacagcattaaaatgtccaargcactctaatgatctcacaactcc

SEQ ID NO: 114105 - DNA, 50 bp, homo sapien
ggatcacagcttttatttaattacaygggccaagtgttctgggcattctc

SEQ ID NO: 114106 - DNA, 50 bp, homo sapien
aaggcagctttgatctcccacagaamgtccctgaaagcccctgatagcca

SEQ ID NO: 114107 - DNA, 50 bp, homo sapien
aaaattaaagagaccacacttggaayacaacttagacatctagaagaaat

SEQ ID NO: 114108 - DNA, 50 bp, homo sapien
aagaggctatttcttccctctgatawaaagtaaaagtcatcgcatattag

SEQ ID NO: 114109 - DNA, 50 bp, homo sapien
gcagtgacagatagcttggctaaatratctaaaagagaaaaagagaacat

SEQ ID NO: 114110 - DNA, 50 bp, homo sapien
tgatgcccagatatttggattaagcratcatttggcaggaggcaaactgt

SEQ ID NO: 114111 - DNA, 50 bp, homo sapien
gaacttgttagaaaagcagattatgsaaccctgtctcagacctactgagt

SEQ ID NO: 114112 - DNA, 50 bp, homo sapien
gagggtgtgtgtgatgtatgtgatarataaccagcatttggaagctgaca

SEQ ID NO: 114113 - DNA, 50 bp, homo sapien
agcacaagtgacttgctgggtaagcyagaataagactggaagctgagggt

SEQ ID NO: 114114 - DNA, 50 bp, homo sapien
cttttggcatgttttcctggaactcrattttaaatcctgtgagtgtgtgt

SEQ ID NO: 114115 - DNA, 50 bp, homo sapien
gttgtagtcaaacagggataaggcartataaagctgggagtcaatgagtt

SEQ ID NO: 114116 - DNA, 50 bp, homo sapien
aggagggtttgaaatccaaggctccyattctgagcatctcactggcataa

SEQ ID NO: 114117 - DNA, 50 bp, homo sapien
aatttgaggttataaggaggaaattraaatactcataaccaaaatcacca

SEQ ID NO: 114118 - DNA, 50 bp, homo sapien
tttttaaaaatgagagcaataaacamtgacataaatttgaggttataagg

SEQ ID NO: 114119 - DNA, 50 bp, homo sapien
aaattgctagtaacttgctctcttaraaaaaacaggttattcattttatg

SEQ ID NO: 114120 - DNA, 50 bp, homo sapien
ttgaattgtgtcctttcagaattcayaggctgaagtcctaacctgtatcc

SEQ ID NO: 114121 - DNA, 50 bp, homo sapien
ggttcagaaattccttcagctagatyagatgctctttaagaaccaagcgc

SEQ ID NO: 114122 - DNA, 50 bp, homo sapien
aaaataaatcccccattatttttcaragcctcagagcatccagcaacata

SEQ ID NO: 114123 - DNA, 50 bp, homo sapien
taacattgaacccccaaagtgaccayggactgatggcctcagatcatcca

SEQ ID NO: 114124 - DNA, 50 bp, homo sapien
agacagacccaaatacacttattccrgaagcatcgattaggtctgccctt

SEQ ID NO: 114125 - DNA, 50 bp, homo sapien
atcatcattttctgattcatacaaakaaactttgcagtggagtagaccct

SEQ ID NO: 114126 - DNA, 50 bp, homo sapien
tagaactttcatcagcagcaaaagargaatgttattgggaaggtatacat

SEQ ID NO: 114127 - DNA, 50 bp, homo sapien
aaggcttaatttaacctgcatgttayagcagataaaagcaatggaattat

SEQ ID NO: 114128 - DNA, 50 bp, homo sapien
caatcttagcatcttgtgtttaatayatgcaaaatctaaaagaccataaa

SEQ ID NO: 114129 - DNA, 50 bp, homo sapien
ataatgggctgggtgcgaaagttccsaaagatttcatcctgggtaggaca

SEQ ID NO: 114130 - DNA, 50 bp, homo sapien
gacctgaggcaaaatctcagatcatracaccttacactcttattaggaaa

SEQ ID NO: 114131 - DNA, 50 bp, homo sapien
agcatggaagagtaaaaagaccagtyacataaattgatagtatggttaat

SEQ ID NO: 114132 - DNA, 50 bp, homo sapien
caacagtccaattcaaattagacctyacaaagcaaactactctgattagg

SEQ ID NO: 114133 - DNA, 50 bp, homo sapien
cagtggacagggatgttggggacgakacatactgagataccagctggggc

SEQ ID NO: 114134 - DNA, 50 bp, homo sapien
aatagctgagacttaaaagcactaamgaatatttaaatctactccacagt

SEQ ID NO: 114135 - DNA, 50 bp, homo sapien
tgccagaattccattaggcctgcaayaaatgatagagtcaatctatttag

SEQ ID NO: 114136 - DNA, 50 bp, homo sapien
tgggcaatcttagggttcactttgaygcagggcagctgagcccccaaatt

SEQ ID NO: 114137 - DNA, 50 bp, homo sapien
taatatgctcatggagttttctgaaycttgtaaagtgctgcacaactgtg

SEQ ID NO: 114138 - DNA, 50 bp, homo sapien
cttactctttattgtgattctaaatkacaggagcagcagccacactccag

SEQ ID NO: 114139 - DNA, 50 bp, homo sapien
tgtaagaaaagacagtgattgttacmgaagaattggtgggtcttggcaac

SEQ ID NO: 114140 - DNA, 50 bp, homo sapien
actccagacttgttattcatctttaygtttaagaggtgaattattgtaga

SEQ ID NO: 114141 - DNA, 50 bp, homo sapien
tttaatagaaatgaatataactgtakagtgaaaaactgagttacgtgaca

SEQ ID NO: 114142 - DNA, 50 bp, homo sapien
atctggccctccaatatcccagtgaytatgcagagagccaagacctctgc

SEQ ID NO: 114143 - DNA, 50 bp, homo sapien
aaagtgtgcatatgtgaaacggacamaaggaaagtcaggaccactaaagg

SEQ ID NO: 114144 - DNA, 50 bp, homo sapien
gtcttctcagaactgaaaggatacarggactattcaaatgtaagaaaaaa

SEQ ID NO: 114145 - DNA, 50 bp, homo sapien
ttctcctcccattatttcattaatakcttgccttcattaaactactctcc

SEQ ID NO: 114146 - DNA, 50 bp, homo sapien
ggactgcacaggtttcttagtagcakgagaacaaggagagcatggttcat

SEQ ID NO: 114147 - DNA, 50 bp, homo sapien
ggattcttaggcttccttcaatgacraggatctctatgtctgacattcca

SEQ ID NO: 114148 - DNA, 50 bp, homo sapien
ccacactcccctcaatttgcaatcartcaccaagttctgctactgtccct

SEQ ID NO: 114149 - DNA, 50 bp, homo sapien
atggaaatactgggctcccattgaaygcactaatctttaaatttaatttc

SEQ ID NO: 114150 - DNA, 50 bp, homo sapien
aaaattaagctaaattcaaagtaccragtgtgcacgtggaagccagatcc

SEQ ID NO: 114151 - DNA, 50 bp, homo sapien
gaagtagaagtaactgatttgcatakaaagaatttttcttgcattttggg

SEQ ID NO: 114152 - DNA, 50 bp, homo sapien
atcaatgtcagtctctaacccagtcrttttgtagcccagatgagaagcaa

SEQ ID NO: 114153 - DNA, 50 bp, homo sapien
gaaatatgtcactggagggatccaaygaccagataggaaccatggcttgg

SEQ ID NO: 114154 - DNA, 50 bp, homo sapien
gtcaaccaccacgccctgcctagacracaagatttcttaatcaattctac

SEQ ID NO: 114155 - DNA, 50 bp, homo sapien
acctcagctctctggacaggactacygggtttgtagatccaggttggact

SEQ ID NO: 114156 - DNA, 50 bp, homo sapien
ttgccacagaaggtgtaatccatcartccatggtgtgtgctcgaaatcag

SEQ ID NO: 114157 - DNA, 50 bp, homo sapien
tttaaggtgttccatggaactgaacyatctaattaaacctctctctgtag

SEQ ID NO: 114158 - DNA, 50 bp, homo sapien
aggctggttcactttttggacacaaygatgatctttcatagttaaaacaa

SEQ ID NO: 114159 - DNA, 50 bp, homo sapien
ttacctgagacaatcttgtacttatmaccttcaacaaaggaaaaagtatg

SEQ ID NO: 114160 - DNA, 50 bp, homo sapien
tgtctttattaaatgtgagacttaawaaaactagcagttaaagtgataaa

SEQ ID NO: 114161 - DNA, 50 bp, homo sapien
attttgtgatgctgactggtatggasaagaaatagggcaatctgaatgaa

SEQ ID NO: 114162 - DNA, 50 bp, homo sapien
tcaagttgactgtgggtatttgaaawcataaatcatatattatcttgcca

SEQ ID NO: 114163 - DNA, 32 bp, homo sapien
tctgtgtactgaaaacygtaaaatggtgttga

SEQ ID NO: 114164 - DNA, 50 bp, homo sapien
acaatatggaactctgaagatttttrtggcaattccaagagattctcagg

SEQ ID NO: 114165 - DNA, 50 bp, homo sapien
atggaatctacaaagaaagctaatasaactaacaggtgaggttagcaagt

SEQ ID NO: 114166 - DNA, 50 bp, homo sapien
tatctgagatgcctgtgagaacatayctaaccattccccttggaacataa

SEQ ID NO: 114167 - DNA, 50 bp, homo sapien
taaaatgctaactgtgttatacttayactcaagggatccccgggtacaaa

SEQ ID NO: 114168 - DNA, 50 bp, homo sapien
cctgttttatacttaaatagacatasagttttcatctgtgtagcacactc

SEQ ID NO: 114169 - DNA, 50 bp, homo sapien
tgcttgatcagtataagaatttatcygaagagttgctagaatagatgagg

SEQ ID NO: 114170 - DNA, 50 bp, homo sapien
cttccttagattcagtgacctttackagattgtgtatgcatcactttttc

SEQ ID NO: 114171 - DNA, 50 bp, homo sapien
gagtatgtagtgggagtgaatgtacracataattttgaaacttaacatct

SEQ ID NO: 114172 - DNA, 50 bp, homo sapien
gggtctgtggcacttgcacgtcaaargaaggtgtgagcccaaagttctgg

SEQ ID NO: 114173 - DNA, 50 bp, homo sapien
acttaccttaaagatgatgttaaatkagtttaaaatagtgcggtatgatc

SEQ ID NO: 114174 - DNA, 50 bp, homo sapien
cagctcatgcacaggtatggatgaargatttgtacatttctcaagtattc

SEQ ID NO: 114175 - DNA, 50 bp, homo sapien
cttgttccctggaatttgtaattgargaagagaaaaacagagagaatgaa

SEQ ID NO: 114176 - DNA, 50 bp, homo sapien
cccaggacttaaggtaggtaaatcaragtcttgttccctggaatttgtaa

SEQ ID NO: 114177 - DNA, 50 bp, homo sapien
ttgagccatgttaatggaatatcctraataagaaccccattctttttcat

SEQ ID NO: 114178 - DNA, 50 bp, homo sapien
tgatccagtattacttctagctctaytaaatatggcccaggatgtggtct

SEQ ID NO: 114179 - DNA, 50 bp, homo sapien
gaaatctttcataaatatttagtcawcaagtatggcatgaatcacagaaa

SEQ ID NO: 114180 - DNA, 50 bp, homo sapien
tatggggatgagcattagtatgagawcctgtaggtgatttgaaggaggtg

SEQ ID NO: 114181 - DNA, 50 bp, homo sapien
gggtgtcttcagaagctgaccctgaygcaaagattcatgtgcaaggagtt

SEQ ID NO: 114182 - DNA, 50 bp, homo sapien
atcctcaatatgacaccatcaaatgyatgtgagaaagtggttatttatac

SEQ ID NO: 114183 - DNA, 50 bp, homo sapien
gaaacatacacttctaacacctgcayataaaatttactacacctgcatat

SEQ ID NO: 114184 - DNA, 50 bp, homo sapien
ctccatggcacctcacagtaaacacrcattcataagggtcgcaggggcaa

SEQ ID NO: 114185 - DNA, 50 bp, homo sapien
gctcattgaagtatccagcacagtgmattaacgtaaacctaagacacatc

SEQ ID NO: 114186 - DNA, 50 bp, homo sapien
attggaggatgagttccaccaaatcragaggtaaaccaagaaaaggaaga

SEQ ID NO: 114187 - DNA, 50 bp, homo sapien
catagcctagccaaattgacacatakaatttgaacatcataacaggcata

SEQ ID NO: 114188 - DNA, 50 bp, homo sapien
aaatgatgatgtagtcttctcaatgraactgaaaagggtgataaattcag

SEQ ID NO: 114189 - DNA, 50 bp, homo sapien
tttctaagactcagtttcatggttawatcccacatcagggactcaatttt

SEQ ID NO: 114190 - DNA, 50 bp, homo sapien
cctctagcaggactaattgatcaaaygatttttttcagatatggtatgaa

SEQ ID NO: 114191 - DNA, 50 bp, homo sapien
agctctgtatttcttagaacccatgrcagcattgcatatgacatttcttt

SEQ ID NO: 114192 - DNA, 50 bp, homo sapien
ctatgatcctgtggaattctgatgaygctttgaagatgctccaagggtct

SEQ ID NO: 114193 - DNA, 50 bp, homo sapien
ggaggcgtctgtcttcgagacatggscaaattcatacccagtacagtccc

SEQ ID NO: 114194 - DNA, 50 bp, homo sapien
agcagattacacttgcttttctgttrcatctatctgtacctaagcagctt

SEQ ID NO: 114195 - DNA, 50 bp, homo sapien
gggctacagagactccaggctggtcratcagtgacagaaatttgagttcc

SEQ ID NO: 114196 - DNA, 50 bp, homo sapien
gagagagggtgtgtgtgtgtggaaaygagggtaatagataatggacgtta

SEQ ID NO: 114197 - DNA, 50 bp, homo sapien
ctagaagaggccaattacttcatacygataacctttcctatattttggaa

SEQ ID NO: 114198 - DNA, 50 bp, homo sapien
tcaatgaaaagaaaaaaccaggccakattgcaaaatcccaaccactgctt

SEQ ID NO: 114199 - DNA, 50 bp, homo sapien
tggatcacatgactcagggataaaaygtagaggaagaagagcagaaggca

SEQ ID NO: 114200 - DNA, 50 bp, homo sapien
gacctgtggaggatggtcaagtcctktctcctataacgtggggcagtgat

SEQ ID NO: 114201 - DNA, 50 bp, homo sapien
caatacccttagttgaccagttcaawctttccctgcacttgaatgctact

SEQ ID NO: 114202 - DNA, 50 bp, homo sapien
tgatcagatcagaatcagaacaatamtactcaggaaaatatcttgtatca

SEQ ID NO: 114203 - DNA, 50 bp, homo sapien
ttaatctgatcctaaagtgcccattraactgtagtgggctctttaaaaaa

SEQ ID NO: 114204 - DNA, 50 bp, homo sapien
catcttgccttcaggataatgtgaamtatggcctaatttttgaagttttt

SEQ ID NO: 114205 - DNA, 50 bp, homo sapien
cagggtctcagcaaatagacaaagaygtaaagatgtgtggtgcctgatgc

SEQ ID NO: 114206 - DNA, 50 bp, homo sapien
tgccacgattctatccaaacgtccawctctactctttgggcgtttgttct

SEQ ID NO: 114207 - DNA, 50 bp, homo sapien
aattacatggaattttatttcctgaractctaatcatcaagttctcctat

SEQ ID NO: 114208 - DNA, 50 bp, homo sapien
tttcacgtgctgtttcttgtcaccaygaagtaacaacaacaacaaacgac

SEQ ID NO: 114209 - DNA, 50 bp, homo sapien
tgtttgaagcggactcaggatagaamcgctgtgtttgtgctaatagtttt

SEQ ID NO: 114210 - DNA, 50 bp, homo sapien
tgctgttttttttttttaaatgacartagattcttgaatgaagacatcca

SEQ ID NO: 114211 - DNA, 50 bp, homo sapien
tccagaccaggtgctggtccatagayagaattaagtgtaccctttggctt

SEQ ID NO: 114212 - DNA, 50 bp, homo sapien
cagaagttacttaaggttgcacttayctaaaatgaaatactagatcaaat

SEQ ID NO: 114213 - DNA, 50 bp, homo sapien
agtcacaatggatcacaaacctaaaygtaaaatgcaaaattgtcgagggc

SEQ ID NO: 114214 - DNA, 50 bp, homo sapien
gcagatattaaataagtatgattacrgagtgaagacatttcaggcatgca

SEQ ID NO: 114215 - DNA, 50 bp, homo sapien
caaggaaagtgtgggaaatcctatcragttactctggagaaagacggctg

SEQ ID NO: 114216 - DNA, 50 bp, homo sapien
ataaagattgcagacaaaaatatccrgagtttgtgcgtctaattcaatta

SEQ ID NO: 114217 - DNA, 50 bp, homo sapien
tgtatttctgccactgtattttcagrcctttgttatagccatgcagccta

SEQ ID NO: 114218 - DNA, 50 bp, homo sapien
atccctcctaactctgatttacaatygagaccactacagttctgattgga

SEQ ID NO: 114219 - DNA, 50 bp, homo sapien
cgtttgcagctttggagaacagcccrattttcctaggtcctcaaaaagag

SEQ ID NO: 114220 - DNA, 50 bp, homo sapien
gcccatttattatttattccaggtaygtcctagatgcatacaatttcttc

SEQ ID NO: 114221 - DNA, 50 bp, homo sapien
ccaattgcgttttacaattctacaaytctgtctatttctactcacttctg

SEQ ID NO: 114222 - DNA, 50 bp, homo sapien
tacatttcactctgtaagtgtgcacygcgggaaggatattcaattctgtt

SEQ ID NO: 114223 - DNA, 50 bp, homo sapien
atctggaattctttctgggctcctcraacacctctaagaatccacaacct

SEQ ID NO: 114224 - DNA, 50 bp, homo sapien
gtctccatgttgcgcttggaagtaaycctttagtggctaaaggatgtgga

SEQ ID NO: 114225 - DNA, 50 bp, homo sapien
cagaaaggtttacttatttaccttasattccactttcagaagctcagggt

SEQ ID NO: 114226 - DNA, 50 bp, homo sapien
gaaagctaccttgtacaccttgccartaacagcccatggtatacctggtt

SEQ ID NO: 114227 - DNA, 50 bp, homo sapien
ttggttcaacgaaagataccaaagayaaagttaacagacgggtgatagag

SEQ ID NO: 114228 - DNA, 50 bp, homo sapien
ttaaaaaatatctattgacatatgayggacataatgaaaaaaacatggaa

SEQ ID NO: 114229 - DNA, 50 bp, homo sapien
ttaagagctccttcctgcagattgaygctactttgtagatcaggccacgc

SEQ ID NO: 114230 - DNA, 50 bp, homo sapien
cgcttaagtcagtaatctcctcactrtggaaacattggagaatggggtcg

SEQ ID NO: 114231 - DNA, 50 bp, homo sapien
ggctggtattaccaaatacgtcttayatcttcagacaagtgagcttactg

SEQ ID NO: 114232 - DNA, 50 bp, homo sapien
gaaaaaggagtaagctattgatatamacaactgttacatgaaataagcta

SEQ ID NO: 114233 - DNA, 50 bp, homo sapien
ttaaaacaaggtggagggattaagcraagaaacagatacattcatagaaa

SEQ ID NO: 114234 - DNA, 50 bp, homo sapien
aattaagatctcttccatggctcctyaatatacatacatacttcatatca

SEQ ID NO: 114235 - DNA, 50 bp, homo sapien
ctcccagcaaccttgaggcaaactawcatattcatataaaagttcaagga

SEQ ID NO: 114236 - DNA, 50 bp, homo sapien
ccaattcacagttaatacaatagcaractcttcagtgacttcccattgcc

SEQ ID NO: 114237 - DNA, 50 bp, homo sapien
taaaagccaagtgtttcttacaaggyaggggataaaatgagattgaaact

SEQ ID NO: 114238 - DNA, 50 bp, homo sapien
tgtagggaaaccacaagagacagagyatatgaagagcaggagtaggggaa

SEQ ID NO: 114239 - DNA, 50 bp, homo sapien
tcctccacgaataatgtaagctctayaaaggcaggtggctcttctctttc

SEQ ID NO: 114240 - DNA, 50 bp, homo sapien
aggagctgatgaaaaggctaaaggasacagttatatgactctgagaagca

SEQ ID NO: 114241 - DNA, 50 bp, homo sapien
gccactgaatttagtgattggtaacraaatagttaaattgagagtgctag

SEQ ID NO: 114242 - DNA, 50 bp, homo sapien
cgcaaatacaagcccaccagagagamtaagggtgcttagagaaacataga

SEQ ID NO: 114243 - DNA, 50 bp, homo sapien
cattatgtgtactccacttggactcrgaatctacagacagcatggcccta

SEQ ID NO: 114244 - DNA, 50 bp, homo sapien
tggaatctttcttcatattcatagastagcaaacctaaatatccctgaag

SEQ ID NO: 114245 - DNA, 50 bp, homo sapien
cttatctgtttgctacctaaagcacygaaacacagaagggtactgtattc

SEQ ID NO: 114246 - DNA, 50 bp, homo sapien
ggtactgggaggagtagaaagataartaattgtcctttgactttaatgat

SEQ ID NO: 114247 - DNA, 50 bp, homo sapien
gaaaacgtatgaattgaccattaccrttaccattaccctagcttgattac

SEQ ID NO: 114248 - DNA, 50 bp, homo sapien
gacaaaggacataaatagccaagacrcaaaagaagacttataaatgacaa

SEQ ID NO: 114249 - DNA, 50 bp, homo sapien
gtgggccatctttgaaaagattttcsgacatgataattagctatgacgga

SEQ ID NO: 114250 - DNA, 50 bp, homo sapien
agaaaaataaggacatatgctcctamaaaaacttgtaccaaaagtttact

SEQ ID NO: 114251 - DNA, 50 bp, homo sapien
aagcgatgccttctgttacgtacctrtgcttcttttaagcccttctaaag

SEQ ID NO: 114252 - DNA, 50 bp, homo sapien
agacaagaacactgaggatgcactcyaccttcacctcctggccccaaggt

SEQ ID NO: 114253 - DNA, 50 bp, homo sapien
ttaaaatatgtgaagcaaatgcctayataactgaaaggagaagtagacaa

SEQ ID NO: 114254 - DNA, 50 bp, homo sapien
agtggctggaatggaacagatcaaargagtaaattaaaaagaagatgtat

SEQ ID NO: 114255 - DNA, 50 bp, homo sapien
acatgttcatacctctcagggaaatraccaagagcagaaagagatgagat

SEQ ID NO: 114256 - DNA, 50 bp, homo sapien
tattctatggttcggtatgttgggcyctttaagaaatggattctagagcc

SEQ ID NO: 114257 - DNA, 50 bp, homo sapien
atctgattgttgatcaaagaaggcaytgatgtttattttaagtagtgcta

SEQ ID NO: 114258 - DNA, 50 bp, homo sapien
acaaatcgtacaatataagccatgaragaagtatgaaaataaatacagaa

SEQ ID NO: 114259 - DNA, 50 bp, homo sapien
tggattagttatttgttgggtctagsaaccagtgcagagttgcaattata

SEQ ID NO: 114260 - DNA, 50 bp, homo sapien
atttgtacagtaggataaaatgtcaygtcaaacaatttgaaaatatcagg

SEQ ID NO: 114261 - DNA, 50 bp, homo sapien
tttgcagttatgaagtggtatcggaygctctgattatgaaactagtattt

SEQ ID NO: 114262 - DNA, 50 bp, homo sapien
aaacaaaaaactaggttcctaagtargttgcacacttgcctggaaaaaga

SEQ ID NO: 114263 - DNA, 50 bp, homo sapien
gctccacacagggcctggcatgcgasgaatgctccatcaaagctggctgg

SEQ ID NO: 114264 - DNA, 50 bp, homo sapien
gtttaacatgacagtgcaggtacggyaatatttctgcactcagcattttt

SEQ ID NO: 114265 - DNA, 50 bp, homo sapien
acagtgtataatgaaatcaccaagaracaacactatacagaatattttcc

SEQ ID NO: 114266 - DNA, 50 bp, homo sapien
agagaaaacacacccgtaacaatgtsaagttggtctcactgtatttttcc

SEQ ID NO: 114267 - DNA, 50 bp, homo sapien
cctgaacgtatgttggcaatagaacrcttctgaaaccagtggaagcttct

SEQ ID NO: 114268 - DNA, 50 bp, homo sapien
ttcagccaactctcacatgacacagwttctaaacccttcataatcctagt

SEQ ID NO: 114269 - DNA, 50 bp, homo sapien
taaattactttattttgactttcaartagcatagttaactgataaaagct

SEQ ID NO: 114270 - DNA, 50 bp, homo sapien
tgattctagagagagggcagtacccrgcgtcctctggcagctgttctgtg

SEQ ID NO: 114271 - DNA, 50 bp, homo sapien
taccattccagtgctaggaatagaarggtaaaaacataaggtctctactc

SEQ ID NO: 114272 - DNA, 50 bp, homo sapien
gtcctgcgtgcagctcagcagttagyacacccagtggtaacacacaaggt

SEQ ID NO: 114273 - DNA, 50 bp, homo sapien
taaatctatgcttcaaatgaataacratgaggtgtaattcatcctgactg

SEQ ID NO: 114274 - DNA, 50 bp, homo sapien
gttgttaaataaggattgaatgagcraagttataagctgctatattgatt

SEQ ID NO: 114275 - DNA, 50 bp, homo sapien
tctttgagatagatttctgtacttgsagttgctagggcaaaaggtaaatg

SEQ ID NO: 114276 - DNA, 50 bp, homo sapien
tattggccttggaaactttttctgckcagctcatcaatattgttagtgac

SEQ ID NO: 114277 - DNA, 50 bp, homo sapien
agattctgctttttgtaacaagcctwcctactgatgctactctacatggc

SEQ ID NO: 114278 - DNA, 50 bp, homo sapien
aagcccttgtcatccttcactgtgcrtatgtgagaggatttctgtcagtt

SEQ ID NO: 114279 - DNA, 50 bp, homo sapien
ctttcatgcctttccccacctttaaytatctcttgaaaggcaccatcatc

SEQ ID NO: 114280 - DNA, 50 bp, homo sapien
aaaggcaccatcatccattaccctayagtctcaaagcagcaatcatcctg

SEQ ID NO: 114281 - DNA, 50 bp, homo sapien
ggagttgggtgatttatcagttcagytgcttcaaacatagaaccttattt

SEQ ID NO: 114282 - DNA, 50 bp, homo sapien
ctgatgtgggattctcttagcctaaytgagtatttatgtagtccatctgt

SEQ ID NO: 114283 - DNA, 50 bp, homo sapien
catagaaccttattttaagtatgtgyagattcaagcaattcaagtaagta

SEQ ID NO: 114284 - DNA, 50 bp, homo sapien
tggggagggcttttttggacagggtygtgtgatggtttcccatatccctc

SEQ ID NO: 114285 - DNA, 50 bp, homo sapien
gactattcatccagttgaattttccyagtgattcgggtcaaaatggtttt

SEQ ID NO: 114286 - DNA, 50 bp, homo sapien
ttctcttacctggtaacacattatarcttgattctactccaggaaaactt

SEQ ID NO: 114287 - DNA, 50 bp, homo sapien
cagtatgtttactatgcatatatttyaaatagttgtaatcctaacataga

SEQ ID NO: 114288 - DNA, 50 bp, homo sapien
tgcatacatctctgttcattggacaygtttactcccatatggctgtttgt

SEQ ID NO: 114289 - DNA, 50 bp, homo sapien
ttgtctcagaaaagtagcaaaaatcmagggtatctaagcaactgaattca

SEQ ID NO: 114290 - DNA, 50 bp, homo sapien
acaagctgctgaagctctcatctaargcttcatggcatcgtgggtggcaa

SEQ ID NO: 114291 - DNA, 50 bp, homo sapien
cagctaatcctccctcttccataaartattccttcccttttgatctcagc

SEQ ID NO: 114292 - DNA, 50 bp, homo sapien
tacttagtttcaaggtgtgggtggawtatcaactcagggaagtggcttgt

SEQ ID NO: 114293 - DNA, 50 bp, homo sapien
tgctgcacaatagggttctaggggaraatgtcaatctggtcatcacagct

SEQ ID NO: 114294 - DNA, 50 bp, homo sapien
aggaaaatatgaagattactttgcawaatattggatatgtgctgtggcag

SEQ ID NO: 114295 - DNA, 50 bp, homo sapien
tcaggagggaaccaggagccagctamgtgtctataacagcaatccaatgt

SEQ ID NO: 114296 - DNA, 50 bp, homo sapien
cccttttgctccaaatgactgcaacrcctctctatcaagggctcagaatg

SEQ ID NO: 114297 - DNA, 50 bp, homo sapien
ttttcagaattcactttctttaatgsacttttattctgtaactactccac

SEQ ID NO: 114298 - DNA, 50 bp, homo sapien
atctcagctataaaaataacatacaycaagtaatcacatattttccctga

SEQ ID NO: 114299 - DNA, 50 bp, homo sapien
aggtcccagcctacttccttactgckaattaccctccaccatgaggaact

SEQ ID NO: 114300 - DNA, 50 bp, homo sapien
ctgccaccctctgattaaggaatgaytacagatgtgtacaaagagctaat

SEQ ID NO: 114301 - DNA, 50 bp, homo sapien
ggcagatatttacgattgttccaagragaactgtggaaggggtgactaaa

SEQ ID NO: 114302 - DNA, 50 bp, homo sapien
atttctctatatttttgtagccaaasattcttgacatttaaaattagaga

SEQ ID NO: 114303 - DNA, 50 bp, homo sapien
acggaggccactaaacatgctacgaygcacaagatagcctccatgacaaa

SEQ ID NO: 114304 - DNA, 50 bp, homo sapien
gtagtttttaaagtatagaattttarcctcactgaattccactatattat

SEQ ID NO: 114305 - DNA, 50 bp, homo sapien
aagaagcgcctaagcacctctatgayggactctaagaaccgagaaatgaa

SEQ ID NO: 114306 - DNA, 50 bp, homo sapien
actgtttcctgagtaaacattaaaartactccatctaaaaagctagaagt

SEQ ID NO: 114307 - DNA, 50 bp, homo sapien
taaagcccactgtgggttatttatcrctagaaacagagcagggtgcagaa

SEQ ID NO: 114308 - DNA, 50 bp, homo sapien
gtcacggtactaagtaataaacataygaattcagaatgtgaaatgcttat

SEQ ID NO: 114309 - DNA, 50 bp, homo sapien
acccatgaagccctaagtgtgaactsaagaaggggtgttggtgcaaagca

SEQ ID NO: 114310 - DNA, 50 bp, homo sapien
cctggaattatccattgttgtagtaygatattcccaaatgtagaatcaat

SEQ ID NO: 114311 - DNA, 50 bp, homo sapien
agtctctctccttgactatcaaggarctgacacggagaagccttaaacag

SEQ ID NO: 114312 - DNA, 50 bp, homo sapien
gctagagccaggtcacagtttgcttyaaggtctacaaccaagattaaggt

SEQ ID NO: 114313 - DNA, 50 bp, homo sapien
ctgtgaaaggccgctgaaggacagayatgttactcacctcgtctagcacc

SEQ ID NO: 114314 - DNA, 50 bp, homo sapien
gaactcatttcaaaagtaggtaaaaygatttgcagcatggtttaggctgg

SEQ ID NO: 114315 - DNA, 50 bp, homo sapien
tagcaaataacatatcttgaagaacrctaattttaccactaaaatatttc

SEQ ID NO: 114316 - DNA, 50 bp, homo sapien
tggtaagtgtgcattgttgtttaaasctattaagagctagtataatttga

SEQ ID NO: 114317 - DNA, 50 bp, homo sapien
ttgtttaaagaaacagttttggaagsaacaataagcaaaaaataaaagta

SEQ ID NO: 114318 - DNA, 50 bp, homo sapien
ttaaaagtaaacatttggattgccaygattctgattataaatggataaaa

SEQ ID NO: 114319 - DNA, 50 bp, homo sapien
cactctgtggctaaacaacgtgtaasaaaattcagtgttgccatgacagt

SEQ ID NO: 114320 - DNA, 50 bp, homo sapien
caggggagaagcaatgcacaaccccrcaagtatgccagtgtataaaaccc

SEQ ID NO: 114321 - DNA, 50 bp, homo sapien
caggaaaattacaaactaagaagaargtgtatgtagagatcaatataggt

SEQ ID NO: 114322 - DNA, 50 bp, homo sapien
tcacgtagactaacctcagtacagtstaggagagaactatgcaagggtct

SEQ ID NO: 114323 - DNA, 50 bp, homo sapien
ctagtgactccctttaaaatgcacaracatcctttaaaaagtccatgtcc

SEQ ID NO: 114324 - DNA, 50 bp, homo sapien
gctggagggtccagctgcataatgamgtcctgataaacagtaatgagaca

SEQ ID NO: 114325 - DNA, 50 bp, homo sapien
atgttgaaacatttatttatatctayatggacccattgatatttacgtta

SEQ ID NO: 114326 - DNA, 50 bp, homo sapien
taataaatcttgtagttctacgttaraggacatggactttttaaaggatg

SEQ ID NO: 114327 - DNA, 50 bp, homo sapien
gcataaagaagtcacaattcataaartacacccaggcagtctgagggaag

SEQ ID NO: 114328 - DNA, 50 bp, homo sapien
gattaaaatatctgtctacttttcasagtttttaagcccaaatgagataa

SEQ ID NO: 114329 - DNA, 50 bp, homo sapien
tattttatgaattgtgacttctttaygccagcgactcaaatgctctttgc

SEQ ID NO: 114330 - DNA, 50 bp, homo sapien
atgaaggtgcattactaattttaaaktggccaggttgactttaagagaca

SEQ ID NO: 114331 - DNA, 50 bp, homo sapien
agtgatgactgccattctattactakcaccacaaacaataaagcaggttt

SEQ ID NO: 114332 - DNA, 50 bp, homo sapien
gtgcctgcacagaatgggccctcaaygttgatttattgaatgaacacatg

SEQ ID NO: 114333 - DNA, 50 bp, homo sapien
tatgagatgatgaagagctatttaartgggggaaagtccttgtggagaca

SEQ ID NO: 114334 - DNA, 50 bp, homo sapien
gatgctaaaatagatagctgagtgaygatgtggataatatttccttgtct

SEQ ID NO: 114335 - DNA, 50 bp, homo sapien
tattactccttacatccaatccatcrgaatatcctggttctacttcaaaa

SEQ ID NO: 114336 - DNA, 50 bp, homo sapien
gagagagacacagataaagagacackgacgtaggaagctatgataatcca

SEQ ID NO: 114337 - DNA, 50 bp, homo sapien
gactttttgcatcctaggtgcaagayagaatatacttttagtatctggaa

SEQ ID NO: 114338 - DNA, 50 bp, homo sapien
gttattctacatatttacctaaaaarcagtcttgagactgcgagatttta

SEQ ID NO: 114339 - DNA, 50 bp, homo sapien
gataaagaagagttagaaaatcacaygtgttgtaaatgctcatttgttta

SEQ ID NO: 114340 - DNA, 50 bp, homo sapien
tctatcattaataagacttgctcacrgtagattctaattagaaggctaat

SEQ ID NO: 114341 - DNA, 50 bp, homo sapien
tgattgggagttagtgatgccagaayggagaaagagggaagccaggagga

SEQ ID NO: 114342 - DNA, 50 bp, homo sapien
tgaagtatatttgaagcaactactasagaggacctatcgagtgcacacca

SEQ ID NO: 114343 - DNA, 50 bp, homo sapien
acccactcatctctgaggagctatgmactggttttggtccctctaatgat

SEQ ID NO: 114344 - DNA, 50 bp, homo sapien
agtgacctagtaaatgctgatacaaytgcaccacttgtccatagccacca

SEQ ID NO: 114345 - DNA, 50 bp, homo sapien
tcaggccagggctggtccacaggaaragaagggtaatcaacagcccttta

SEQ ID NO: 114346 - DNA, 50 bp, homo sapien
gagctccacagaacacttaattttaragcaggcttcattgctagcagcaa

SEQ ID NO: 114347 - DNA, 50 bp, homo sapien
aggataagggaaaatagcatcgaaawtgggacagatatatccatgtgatt

SEQ ID NO: 114348 - DNA, 50 bp, homo sapien
ggcacagagttcagagctcgataaamagttcctatcatcagctatggaga

SEQ ID NO: 114349 - DNA, 50 bp, homo sapien
atcagacttcaggacattaatagacygctgatcttaaagtgaggtgaaat

SEQ ID NO: 114350 - DNA, 50 bp, homo sapien
acaggggtagcgcatgtctaataaakggtcaaggtggagttacaaggatt

SEQ ID NO: 114351 - DNA, 50 bp, homo sapien
tataatgggaactattgaaatatgcrccagataattaaactgtctagcat

SEQ ID NO: 114352 - DNA, 50 bp, homo sapien
ccttcaggcagcaggatgtcctcacraaacagggccattgacaacacagg

SEQ ID NO: 114353 - DNA, 50 bp, homo sapien
tgtaagatactgggacaggctcacaytgagaaactgatcctgctggccta

SEQ ID NO: 114354 - DNA, 50 bp, homo sapien
caatagcctgtgacaagtagaagaayatgcaaagtgggaatcccaagcag

SEQ ID NO: 114355 - DNA, 50 bp, homo sapien
atgagcacataggtggactggccttrgctggccgaatcttcaaacacctg

SEQ ID NO: 114356 - DNA, 50 bp, homo sapien
ccccatgactaatgactcttccacaytggacagcctttttagcagcctcc

SEQ ID NO: 114357 - DNA, 50 bp, homo sapien
tggaccttaacactggggtttagtawacaaaggcatatgaagaacaagag

SEQ ID NO: 114358 - DNA, 50 bp, homo sapien
tttcttgattgtccattataattccrtatgttgtatcttctgctgtagta

SEQ ID NO: 114359 - DNA, 50 bp, homo sapien
tgtttcgtttatgaaacaaacaatgraatatttagttaaaccaggcaaca

SEQ ID NO: 114360 - DNA, 50 bp, homo sapien
attttagcctttcagcctagggatgytcacagtaatggaaagaattgtat

SEQ ID NO: 114361 - DNA, 50 bp, homo sapien
aaaatgcaattaaacatcctgttcamagccgagatataatctaatagatg

SEQ ID NO: 114362 - DNA, 50 bp, homo sapien
tttaaaaagcaacagaatggtaagcygaaaggtctggttattgtcagggg

SEQ ID NO: 114363 - DNA, 50 bp, homo sapien
taattcaatattcttgtaaagttcaygatagtctacacctcaaaactagt

SEQ ID NO: 114364 - DNA, 50 bp, homo sapien
aaattcaaataattattaaaggtcartattacaaagatagaaccatttta

SEQ ID NO: 114365 - DNA, 50 bp, homo sapien
acctgtcttcaaagacctaagattcwaaggaggaagacagataggcaaat

SEQ ID NO: 114366 - DNA, 50 bp, homo sapien
cactatctgattgcaaaacttatcayaaagtcacagtaatcaaaaactct

SEQ ID NO: 114367 - DNA, 50 bp, homo sapien
tagttactttagacatatctttttamaccatctgctttttatgataggag

SEQ ID NO: 114368 - DNA, 50 bp, homo sapien
tgtcccatgatagacataatataaargtgaaagataataggaacaatgaa

SEQ ID NO: 114369 - DNA, 50 bp, homo sapien
tgggatattcaaaagaaccacagagwattattgctgaactggaaagggaa

SEQ ID NO: 114370 - DNA, 50 bp, homo sapien
tagcttgcaatcagccacggtaggartatttatgccacagaaattggaaa

SEQ ID NO: 114371 - DNA, 50 bp, homo sapien
tttaggtggcacttgatataaaatasagcaccagggcggtatcatatttc

SEQ ID NO: 114372 - DNA, 50 bp, homo sapien
tgttatacttgaaagtgctttcttayacgttatcccgtatgatctacata

SEQ ID NO: 114373 - DNA, 50 bp, homo sapien
gagcagggactctaagcatcttcaarcaatcagtgccattttgtgggaac

SEQ ID NO: 114374 - DNA, 50 bp, homo sapien
atttgtgactaccaattagctctcaygtttccatagactgttaggacacc

SEQ ID NO: 114375 - DNA, 50 bp, homo sapien
gcttagaatgatgcactgccctgagragtttgacagacgtggcagaggag

SEQ ID NO: 114376 - DNA, 50 bp, homo sapien
aaaagaaaatagaccaattgttacayagagttgattcaaggaaaacacag

SEQ ID NO: 114377 - DNA, 50 bp, homo sapien
cctaggggtggtagcaacaagatgamtcagcatttgtcgaaactcataca

SEQ ID NO: 114378 - DNA, 50 bp, homo sapien
gatggtcttcctgatgggaaaggaamctgtctcaggctatgtgtgagtca

SEQ ID NO: 114379 - DNA, 50 bp, homo sapien
tcccagtacttcctcactactctcaraaatcagaaagttcctataaacat

SEQ ID NO: 114380 - DNA, 50 bp, homo sapien
agaactggatatgtattgttctgtakaatcggagctgtaatggtgtaact

SEQ ID NO: 114381 - DNA, 50 bp, homo sapien
ctagaggtcagaagtctgaaatcaakgtgtaaagagggccctactccctc

SEQ ID NO: 114382 - DNA, 50 bp, homo sapien
atctctcagcatattataactaagargacaatggcaggtttcagtatgga

SEQ ID NO: 114383 - DNA, 50 bp, homo sapien
tcctggaacttggattttaccattcrccagttctatgattatttgatgtt

SEQ ID NO: 114384 - DNA, 50 bp, homo sapien
aaaccctaatgatgcatcagaactamactttaatatttcaataattagca

SEQ ID NO: 114385 - DNA, 50 bp, homo sapien
acgcaggtactataggaggattggascatgttgatcaccagggaattgga

SEQ ID NO: 114386 - DNA, 50 bp, homo sapien
taaatcatgatcatgcgttagaagaytcaatattaagatatcagttgtct

SEQ ID NO: 114387 - DNA, 50 bp, homo sapien
gctattaggtatcagtcagtctcatmctttcaggttgttgcttcttttct

SEQ ID NO: 114388 - DNA, 50 bp, homo sapien
gttattttccacaaagtccctgtaaygtctcctaaaagcacaagcaaagc

SEQ ID NO: 114389 - DNA, 50 bp, homo sapien
ggtaatcagattttatacaacaataygttatctcccgtgattttatgaat

SEQ ID NO: 114390 - DNA, 50 bp, homo sapien
attttatgaataaaaatgctaaaaawtattgctacaattatccagccagg

SEQ ID NO: 114391 - DNA, 50 bp, homo sapien
tccctttgcaataactcacaaactayacagttttcctccaaatgtgtgta

SEQ ID NO: 114392 - DNA, 50 bp, homo sapien
attaccattgagtttattgtagaaaragattcaggacatcagttgatctg

SEQ ID NO: 114393 - DNA, 50 bp, homo sapien
gattccacagtttactataattaacwgtatccttagtaggcaattcacag

SEQ ID NO: 114394 - DNA, 50 bp, homo sapien
gatgagtagaatgcctaaactggaaygtcaataaacgtaaaaggcagtgc

SEQ ID NO: 114395 - DNA, 50 bp, homo sapien
agttgaacaacagtcttggtccaaartctctggaataaatacttagcaca

SEQ ID NO: 114396 - DNA, 50 bp, homo sapien
taatgttcattgtttcactcttagaygcactgctagttatatcacagttc

SEQ ID NO: 114397 - DNA, 50 bp, homo sapien
tagtgatgcttttgaatgtctaatawgctgattgtataaaaccacaaatg

SEQ ID NO: 114398 - DNA, 50 bp, homo sapien
acatcacagtgcaaacctgaaatcartctacagttgggtagctacatttt

SEQ ID NO: 114399 - DNA, 50 bp, homo sapien
tcaaatgagaactatatggagggccrattccctgcttacccatccatgcc

SEQ ID NO: 114400 - DNA, 50 bp, homo sapien
tatcatcgttgctttttattatcacygccacagtctctccctagctcagg

SEQ ID NO: 114401 - DNA, 50 bp, homo sapien
gtcctagccagtctcatgctgaggarcaatcgtatgaaaagaatgaatat

SEQ ID NO: 114402 - DNA, 50 bp, homo sapien
gatattttacttctcattgatgttcyatttaaactctgaaattatcttga

SEQ ID NO: 114403 - DNA, 50 bp, homo sapien
gagggccaactaagattccaagatargaccttcaatgtgcaaaagatatc

SEQ ID NO: 114404 - DNA, 50 bp, homo sapien
ttatcttttctccattgaacctagcyatatagaattggattaatcataag

SEQ ID NO: 114405 - DNA, 50 bp, homo sapien
actatactaactgtgagtaaagtacrttcttagggcacagaaccccttgc

SEQ ID NO: 114406 - DNA, 50 bp, homo sapien
catttttggactcctgacatccttgygaagtatttgtccatttttctgtg

SEQ ID NO: 114407 - DNA, 50 bp, homo sapien
tgtgcattacagtaatcttggagtgytatgtcttgttccaacgaactgca

SEQ ID NO: 114408 - DNA, 50 bp, homo sapien
atattggcttttcatcacttaggcamaactgattgagagaagaaaagtca

SEQ ID NO: 114409 - DNA, 50 bp, homo sapien
agctagccaagtgattttaatccaasggccaactgtgtgccattacctga

SEQ ID NO: 114410 - DNA, 50 bp, homo sapien
cctccttgactcagtttccctcagargtatgagctgtttgagccaggtga

SEQ ID NO: 114411 - DNA, 50 bp, homo sapien
gtctgtaatgccacacaggctctccrcgtggtaattctgggaaccatctc

SEQ ID NO: 114412 - DNA, 50 bp, homo sapien
gcttttttccagccagcacctaaacrgctctaagaacctggattgtcccc

SEQ ID NO: 114413 - DNA, 50 bp, homo sapien
tgcagatgtaattgttttcctggaargagctgataggaaaaattagaaga

SEQ ID NO: 114414 - DNA, 50 bp, homo sapien
ggaaaaaaatgccatcccaagcataytaagacaaagtgacagggggacta

SEQ ID NO: 114415 - DNA, 50 bp, homo sapien
cacattgccagagtggtatctttgayaattttcttttgggagagaatctc

SEQ ID NO: 114416 - DNA, 50 bp, homo sapien
gtaatttgcagcacatgtaactgacmaaggaccagtatctttaatatata

SEQ ID NO: 114417 - DNA, 50 bp, homo sapien
tttatgtcttaagaaatcatatccayctctgagaccatacaggtaaaaaa

SEQ ID NO: 114418 - DNA, 50 bp, homo sapien
gtgattctgatgcaggtggtcctagraatacactttggcaaataaacact

SEQ ID NO: 114419 - DNA, 50 bp, homo sapien
caaaaaagacttcaagttaagaaatkatggcatgacctgagtggaattct

SEQ ID NO: 114420 - DNA, 50 bp, homo sapien
gataatctccccatctcgaggtcttyaaccttaatcatatctgcaaagtc

SEQ ID NO: 114421 - DNA, 50 bp, homo sapien
caccatcagctcttgcctggaccacygcagtagtgttctaactggtctct

SEQ ID NO: 114422 - DNA, 50 bp, homo sapien
taccttcagccttaatgcttcctatstctcacacagcctataagcaaata

SEQ ID NO: 114423 - DNA, 50 bp, homo sapien
gtttataagctctggtaactgtatgyatttggaagcaaaatggctcacaa

SEQ ID NO: 114424 - DNA, 50 bp, homo sapien
gaatagaccatataatcaaagggcamgcttcaggatgttgtttttcttca

SEQ ID NO: 114425 - DNA, 50 bp, homo sapien
cataaacaaagtcacagacaataacmatacgatcctctcaatatatgcag

SEQ ID NO: 114426 - DNA, 50 bp, homo sapien
atgttggtctttttcttgcaattacrcttttctaatttgttttgcttttt

SEQ ID NO: 114427 - DNA, 50 bp, homo sapien
actctgggacagacaacgccaggcgrcactgcatgagtttcgtattgcaa

SEQ ID NO: 114428 - DNA, 50 bp, homo sapien
tggtggctgaagcagagattaccaasagattattagatcaaccttttcat

SEQ ID NO: 114429 - DNA, 50 bp, homo sapien
agatgctcttcatcactaagaaatcygaactctgtgtattctaggaacac

SEQ ID NO: 114430 - DNA, 50 bp, homo sapien
attaggtgagtgtcttggaatgagaytagaaaagcacactagggcccaat

SEQ ID NO: 114431 - DNA, 50 bp, homo sapien
taatcaaagacatttatatgcttaamtacgcttaatagcaaccaaaacaa

SEQ ID NO: 114432 - DNA, 50 bp, homo sapien
ggttccatatgcattttatgccttcyatgacctggtattcgcttacagca

SEQ ID NO: 114433 - DNA, 50 bp, homo sapien
ggggcttttcagtgtactagggaaamggaatttggataagaacatccgtt

SEQ ID NO: 114434 - DNA, 50 bp, homo sapien
ttccttggcctttcaggaacatctcracacaggtgaacaccttctctttc

SEQ ID NO: 114435 - DNA, 50 bp, homo sapien
ttgattaagtctatatcacaatacartacagtcaaatttctcttcttttt

SEQ ID NO: 114436 - DNA, 50 bp, homo sapien
atattgggttatgagaccaagcttasgttaactcagtaaactgcaacact

SEQ ID NO: 114437 - DNA, 50 bp, homo sapien
agaaacagggggatatgatacataakgtcctccttacagagtttgcattc

SEQ ID NO: 114438 - DNA, 50 bp, homo sapien
actgacataaatgactaagtaaatamatgagggagaagaaatgaatctcc

SEQ ID NO: 114439 - DNA, 50 bp, homo sapien
tctgagactgtcattttttattgcgyataattcctgtttgagcatggcaa

SEQ ID NO: 114440 - DNA, 50 bp, homo sapien
tttggtaattggcttttacacctgcraagccagtttttgaaatgctgggc

SEQ ID NO: 114441 - DNA, 50 bp, homo sapien
aggaagcaggcattctgctatcaatractacattttgcagtcttggaaaa

SEQ ID NO: 114442 - DNA, 50 bp, homo sapien
atacaagtgctttgactcatttattwaaaaaggcttcatgtaaaccttgc

SEQ ID NO: 114443 - DNA, 50 bp, homo sapien
gcagtttttggctattatgaataacscatctgtggacactggtataactg

SEQ ID NO: 114444 - DNA, 50 bp, homo sapien
ctgacttgctttatctaaaagaaacygattgctattaattctttttaaaa

SEQ ID NO: 114445 - DNA, 50 bp, homo sapien
gattaatgagcggccgcttgttttayacatgttttcaaggcacccattct

SEQ ID NO: 114446 - DNA, 50 bp, homo sapien
tcatagctatctgcactttgcagtcyaaaatcaagagtagttatttaagg

SEQ ID NO: 114447 - DNA, 50 bp, homo sapien
attatgcaatatttcaaatacacacratagtagcatagtaaaatataccc

SEQ ID NO: 114448 - DNA, 50 bp, homo sapien
atttatggaatcacgttaggacaacsgtcgtccagaatttaaaatctaga

SEQ ID NO: 114449 - DNA, 50 bp, homo sapien
atcatatttagtatattatttgatakgtatgataaagttcagaaaagctt

SEQ ID NO: 114450 - DNA, 50 bp, homo sapien
agtccagataaggcaagtaagctacsatcataaaaagtaaagtggaatga

SEQ ID NO: 114451 - DNA, 50 bp, homo sapien
tacatagaaaactattagctctccargatttaattctactcaactctaat

SEQ ID NO: 114452 - DNA, 50 bp, homo sapien
aatgttcatatgaataaacaaatackaaatcttaacaaagaaaaaccaaa

SEQ ID NO: 114453 - DNA, 50 bp, homo sapien
cacgttgaaagttactttgagtctgyaccatagaagcatggttcaccaat

SEQ ID NO: 114454 - DNA, 50 bp, homo sapien
ttgttagagtttcttcgtagttctayagtgatgaaacaaggacttggggt

SEQ ID NO: 114455 - DNA, 50 bp, homo sapien
aatgttttaatctttgccaattactraaatagtgattatttgctcaataa

SEQ ID NO: 114456 - DNA, 50 bp, homo sapien
agcacatttgcatcaacgcacttaamcctgacagccttgtgaggtatatg

SEQ ID NO: 114457 - DNA, 50 bp, homo sapien
tcccaaaacaaaggactcattttaamcacattagtacgttagtgctgacc

SEQ ID NO: 114458 - DNA, 50 bp, homo sapien
ctgctgtttattgcattttcagttayggatagtatgtgttgacttccttc

SEQ ID NO: 114459 - DNA, 50 bp, homo sapien
tagggctttggtggtgaagagtcaasagaaaaaggggaagagcggcaact

SEQ ID NO: 114460 - DNA, 50 bp, homo sapien
catgattaagtattgttccctattcrcaagtagacaattgattttgtaat

SEQ ID NO: 114461 - DNA, 50 bp, homo sapien
ccctccttgctctcagaaaaagaccrcctaagatcagggcaagcctacat

SEQ ID NO: 114462 - DNA, 50 bp, homo sapien
gcacatggttgctgagaaaaaaatawcagtgtgcatctcttccaccttaa

SEQ ID NO: 114463 - DNA, 50 bp, homo sapien
cttggccttcaaaaatggtcaactcragaataatttaccaaagagaattt

SEQ ID NO: 114464 - DNA, 50 bp, homo sapien
atgtgccatgctacatgtgtgctcartatcgctgaatacgcacagcaaca

SEQ ID NO: 114465 - DNA, 50 bp, homo sapien
tagttaaagaagctgaggcactgaawacctaaatttcctgcccaaggaat

SEQ ID NO: 114466 - DNA, 50 bp, homo sapien
gagaatgcagatgtggcaaaattcakgaacgaccaaagacaaggaaacta

SEQ ID NO: 114467 - DNA, 50 bp, homo sapien
cagtgtcaggaggcttgagctcagtsaattactagctgtgcaatgttggt

SEQ ID NO: 114468 - DNA, 50 bp, homo sapien
gtccttgtaggaagggtgattggtasaactttctattctgtcatcttgct

SEQ ID NO: 114469 - DNA, 50 bp, homo sapien
ggagtcattattcattaatttcagckgaggagattctgttttcaccatgt

SEQ ID NO: 114470 - DNA, 50 bp, homo sapien
gtagtgctttagtttcacaggtgtayatatggacagaaattgagttccag

SEQ ID NO: 114471 - DNA, 50 bp, homo sapien
aattacggcctacgagttcacaaaayttagcacagaatgctaaacagttg

SEQ ID NO: 114472 - DNA, 50 bp, homo sapien
ccaagcacaactgcaaccactgttayggaatgaatcaaagtaatctaaga

SEQ ID NO: 114473 - DNA, 50 bp, homo sapien
atattatagaaatagctaatgaatayggtaagatgaaactatcatggtct

SEQ ID NO: 114474 - DNA, 50 bp, homo sapien
tttgccacggtgatctgagtcacttytcagcaacatctcagggttaacaa

SEQ ID NO: 114475 - DNA, 50 bp, homo sapien
tgcattacctataatatttgcatcargaattacaccatctatagcatcaa

SEQ ID NO: 114476 - DNA, 50 bp, homo sapien
cgaaaactttcatttaatgaatgacragggtatagttttaaaataaaggg

SEQ ID NO: 114477 - DNA, 50 bp, homo sapien
cctgatcatttccctgatgacaacaytgaagcacacacatgccacagagc

SEQ ID NO: 114478 - DNA, 50 bp, homo sapien
tagttaaatttttgtctactacatcrctgcagctgcaaatgtgtgtcttg

SEQ ID NO: 114479 - DNA, 50 bp, homo sapien
caatgctaagtacagcttttatcatsaaactggcatttttgtatagttaa

SEQ ID NO: 114480 - DNA, 50 bp, homo sapien
gatgtttaatattcataattgaaccygattatcatttcctctcccataat

SEQ ID NO: 114481 - DNA, 50 bp, homo sapien
acaaacagaatttaagtgaatttggmaaaatggatatcaagaaaattgga

SEQ ID NO: 114482 - DNA, 50 bp, homo sapien
acacagtctactaatttgacctcagraatgtcttggggatccatctgtcc

SEQ ID NO: 114483 - DNA, 50 bp, homo sapien
gagagtggtatgaaaatacaatgaayatggtggcagataaacttctctac

SEQ ID NO: 114484 - DNA, 50 bp, homo sapien
catctcagttgacttttaatgggaargcctaatattagaccacttacagg

SEQ ID NO: 114485 - DNA, 50 bp, homo sapien
tgattactctggtacatagtaacaaygtggctatgtagctcctgtcacca

SEQ ID NO: 114486 - DNA, 50 bp, homo sapien
actggcaccttgacctgctgccattsaaactttagtcataggggaaaaaa

SEQ ID NO: 114487 - DNA, 50 bp, homo sapien
taccctcttagtctctgcctttctayacttactgtctagccatactgaat

SEQ ID NO: 114488 - DNA, 50 bp, homo sapien
tgccttgttctgccaaatattgttckcctttggattaaggcctcatttct

SEQ ID NO: 114489 - DNA, 50 bp, homo sapien
gggctttgaccaggatcaatactcaytcatgcattcagcaaaaatttatt

SEQ ID NO: 114490 - DNA, 50 bp, homo sapien
tccttgctctcaattcttttgtgcaygaggcattttaaactttattctcc

SEQ ID NO: 114491 - DNA, 50 bp, homo sapien
attgtccactggatttagtagcaagraggttactggtgccctgaactgga

SEQ ID NO: 114492 - DNA, 50 bp, homo sapien
tcttgcctctgatgacaggtagatgwcagaacggagcaaagtcacagaag

SEQ ID NO: 114493 - DNA, 50 bp, homo sapien
aaacaatagggactctctttagaagkcaaatgcttggtaagtgatgctct

SEQ ID NO: 114494 - DNA, 50 bp, homo sapien
atgataatactggttagcaaatcacrctgggttctgcaaccaactcactg

SEQ ID NO: 114495 - DNA, 50 bp, homo sapien
cttgtgatttaggttcaggaactccrccctacttcattcttgcaatccct

SEQ ID NO: 114496 - DNA, 50 bp, homo sapien
atttacccttctttttcaggtagcartctgcaaaaggtaagtctcaaaat

SEQ ID NO: 114497 - DNA, 50 bp, homo sapien
accacttgtattaattggataggccractgcagtaactaaggttcgtgag

SEQ ID NO: 114498 - DNA, 50 bp, homo sapien
aatgacatggcagcagctggtgcccraggatttgaatctatggaaacatg

SEQ ID NO: 114499 - DNA, 50 bp, homo sapien
agccccagcttgcttatattttctaycatgcatggctgagatcccagcat

SEQ ID NO: 114500 - DNA, 50 bp, homo sapien
aacttagattcaaaaccatgccagayatgctccttctccaattctctcca

SEQ ID NO: 114501 - DNA, 50 bp, homo sapien
tcccagaggaccaataagccatcaaygtaggaaggaattgtgaagggagg

SEQ ID NO: 114502 - DNA, 50 bp, homo sapien
aagaatacaagtcattatctaaatakcgctaccttttgaaaaatgatttt

SEQ ID NO: 114503 - DNA, 50 bp, homo sapien
aaaattaccataggacataaagtgaytaagatccagaagattcaagtgaa

SEQ ID NO: 114504 - DNA, 50 bp, homo sapien
atggtaaggtccatagaatccttaakctggtaaaagatctcttatgtcta

SEQ ID NO: 114505 - DNA, 50 bp, homo sapien
cctcagggattttagctcaactctaygaatgtgtactgattatcattagg

SEQ ID NO: 114506 - DNA, 50 bp, homo sapien
gaagcaaaggaagggcgtgcctcttratgcagtccagagaggtcagcttc

SEQ ID NO: 114507 - DNA, 50 bp, homo sapien
atgaactctatatctcattgaaatcrcacaagtcccctctcagatacttt

SEQ ID NO: 114508 - DNA, 50 bp, homo sapien
atgtccagtaactggggtctatcaaktacataggaagctaacttagctgt

SEQ ID NO: 114509 - DNA, 50 bp, homo sapien
aaatggaggaagctcttgccaaaaasctagatgcccaggataccttctcc

SEQ ID NO: 114510 - DNA, 50 bp, homo sapien
ttaggttttctttccaggtatttccyaaggcaaccttgaactccagacca

SEQ ID NO: 114511 - DNA, 50 bp, homo sapien
tgcttatgttttacttcatgagatcraagcattgtgtgcactctgttaga

SEQ ID NO: 114512 - DNA, 50 bp, homo sapien
catctactctaatgtataaacaaatsatcttcaacaacttagcttgatct

SEQ ID NO: 114513 - DNA, 50 bp, homo sapien
ttgcaggacaacttctgattataaayttgttgtggagcagaagaagccct

SEQ ID NO: 114514 - DNA, 50 bp, homo sapien
acaaactctacctcattggacttcarttatgcaactagtgagattcatca

SEQ ID NO: 114515 - DNA, 50 bp, homo sapien
atgctaatcactagcacttctaatcratccacttataaaattactaattc

SEQ ID NO: 114516 - DNA, 50 bp, homo sapien
agaaggttagcatatgttaaaagctwaatcttgttctgcatttgttggct

SEQ ID NO: 114517 - DNA, 50 bp, homo sapien
ggagggtttcacagactctagtttaygcctgaagcttagagaggttaagc

SEQ ID NO: 114518 - DNA, 32 bp, homo sapien
acctagttagctgcacrgccagaatataaacc

SEQ ID NO: 114519 - DNA, 50 bp, homo sapien
agtttaaaatgaagtaacatactccwctaacttctgttcaccctaattgt

SEQ ID NO: 114520 - DNA, 50 bp, homo sapien
agtgggagtccacagaataagtccarttgctttttcatatgacagaactt

SEQ ID NO: 114521 - DNA, 50 bp, homo sapien
cacagtttcagcagtaattggtaaaygaataagtgaaagacaagaaagac

SEQ ID NO: 114522 - DNA, 50 bp, homo sapien
acttgtaaaagattaatctaaactcrgagtgtacttgaaagccaggagaa

SEQ ID NO: 114523 - DNA, 50 bp, homo sapien
gtactctattctgcgttgttttgaaytacataaaattggaaaggaaaata

SEQ ID NO: 114524 - DNA, 50 bp, homo sapien
acaactgtgtatcaatttaacagtaygtatttagcatttttaacattagt

SEQ ID NO: 114525 - DNA, 50 bp, homo sapien
aaaaggtggaagggcctttgaaacaytgatttgtcataaaattatgggtt

SEQ ID NO: 114526 - DNA, 50 bp, homo sapien
aaaggctgtcacaaagtattttctgraggattacgcaagagaagtttctc

SEQ ID NO: 114527 - DNA, 50 bp, homo sapien
tattgacgattcctggatgtctaacyattccttgttgattcttttaacat

SEQ ID NO: 114528 - DNA, 50 bp, homo sapien
tgcttagattctatcattcactcttyaactcaaccctagacactctcacc

SEQ ID NO: 114529 - DNA, 50 bp, homo sapien
tcaccagtctgtctgtagtgtattgyagtggagtgtagtggttaagaata

SEQ ID NO: 114530 - DNA, 50 bp, homo sapien
tctgagaaagaatttgctaataaatsagccttaaaaattttgcttgataa

SEQ ID NO: 114531 - DNA, 50 bp, homo sapien
tataactttatgggttttttttcccrcatatcatcccatttaatcttcac

SEQ ID NO: 114532 - DNA, 50 bp, homo sapien
gcttagaaaggttaagtaatttatgmatccaaacttgagttttctgctct

SEQ ID NO: 114533 - DNA, 50 bp, homo sapien
ctttctgctaagactctctcctccaygttactttgattataactgcaatt

SEQ ID NO: 114534 - DNA, 50 bp, homo sapien
ttaggaaccaatctggcctatatgcmaacatttagataatttgggatttt

SEQ ID NO: 114535 - DNA, 50 bp, homo sapien
ttatctcctttgagcataataagccrgagtggcagatatttgtgtgatga

SEQ ID NO: 114536 - DNA, 50 bp, homo sapien
tatcatcctccttaatatcatcctcrttattatcattatcattacagagt

SEQ ID NO: 114537 - DNA, 50 bp, homo sapien
attaggtttgacatattagtcagggyatagcttacaattatatttttgag

SEQ ID NO: 114538 - DNA, 50 bp, homo sapien
gattatgtcactatcccttactctcygaaatatgttatggtgtgctggta

SEQ ID NO: 114539 - DNA, 50 bp, homo sapien
atagcatcttttcatttctttccaaktctgcataagctgcctatttgcta

SEQ ID NO: 114540 - DNA, 50 bp, homo sapien
ctacaaggcaaaaccaaaaactgggygcagtaatgagaagaataggggaa

SEQ ID NO: 114541 - DNA, 50 bp, homo sapien
atcagccttaaacatgaggcgatagragcggctcttgtatttctgtcttt

SEQ ID NO: 114542 - DNA, 50 bp, homo sapien
ccgaatcagaatcccttgagaggaakattttaacagtaaactagggaaag

SEQ ID NO: 114543 - DNA, 50 bp, homo sapien
tatggaatttttggcacaccttttaygatcaccctctcttaaaaactaca

SEQ ID NO: 114544 - DNA, 50 bp, homo sapien
agataaggctcattgaaccaggttawgataatagcattggcatgacactt

SEQ ID NO: 114545 - DNA, 50 bp, homo sapien
ggtgccatatagtcaatcacattacrgacatcaaggtttatcagcggcac

SEQ ID NO: 114546 - DNA, 50 bp, homo sapien
aaagagaaaaatctaaccattgaccrtattggacatgaacaagatgccaa

SEQ ID NO: 114547 - DNA, 50 bp, homo sapien
agtgtaggacatagaaaaagtgagtyagtgagacatatttgagcgttttc

SEQ ID NO: 114548 - DNA, 50 bp, homo sapien
tagaggtctagaagccaggggagaartcagagatgaagtctaaggggaaa

SEQ ID NO: 114549 - DNA, 50 bp, homo sapien
tccttgtcaggccaacttagggagayggcgccttttggtgcttcatgatt

SEQ ID NO: 114550 - DNA, 50 bp, homo sapien
ggcaaatggtatcaactccatattasagaagtgacatctgagacttgggt

SEQ ID NO: 114551 - DNA, 50 bp, homo sapien
gaaggcagacaagcagcttttcagawgcaaatggtaagtttggtttgatg

SEQ ID NO: 114552 - DNA, 50 bp, homo sapien
ttctgctttagtaaaactgcctagarccttcaggaaatgaatccctctag

SEQ ID NO: 114553 - DNA, 50 bp, homo sapien
gttaagtcagttatttgggactatgsaactcgtaagcaaggagccaggat

SEQ ID NO: 114554 - DNA, 50 bp, homo sapien
tcatacagttaatcagttttggaaaktgcttggttattatatttttatat

SEQ ID NO: 114555 - DNA, 50 bp, homo sapien
ggagttgtagctgcttaattataacraccttatggcaaatatccctttga

SEQ ID NO: 114556 - DNA, 50 bp, homo sapien
tcttactgtcattagcttccatcccrcgagctctctctggaattcactct

SEQ ID NO: 114557 - DNA, 50 bp, homo sapien
attaaatcccatttcttcaaaaagaycctgttattgctgtgtcaccctat

SEQ ID NO: 114558 - DNA, 50 bp, homo sapien
aagaaacatctacagggccgccgcasacgggtggtaagcgaaacttctag

SEQ ID NO: 114559 - DNA, 50 bp, homo sapien
ccactcagtacaggggcatgtggacrattgaattagaaacacagaacaag

SEQ ID NO: 114560 - DNA, 50 bp, homo sapien
atgcactacttctattataataagcrcttgatttcttttaatcccctgag

SEQ ID NO: 114561 - DNA, 50 bp, homo sapien
gctccaagaagctgcagggctttccrgagacagtgacggttggtactcca

SEQ ID NO: 114562 - DNA, 50 bp, homo sapien
gaggagttttattgctgtttttgtaygaagcatctgttctaaaaggaaaa

SEQ ID NO: 114563 - DNA, 50 bp, homo sapien
tgttattttttttctcctactggcaraacgttagacaatatttcaactta

SEQ ID NO: 114564 - DNA, 50 bp, homo sapien
cttgaaactaagagtttgaaggaaayataacttctcagataagaacctaa

SEQ ID NO: 114565 - DNA, 50 bp, homo sapien
gtgagtctctaagaaaattactcaarcttttatacttgaaatattaagat

SEQ ID NO: 114566 - DNA, 50 bp, homo sapien
attccacacctgttcattttcatgcraaggtatatcccactgttctactt

SEQ ID NO: 114567 - DNA, 50 bp, homo sapien
ggtaatttctgctgttatttaggtcrtatttatttcaaagcattctgggt

SEQ ID NO: 114568 - DNA, 50 bp, homo sapien
aaaacttaaaattgttgccaagctayactgaaagataagtgaattgcctt

SEQ ID NO: 114569 - DNA, 50 bp, homo sapien
tctagaactctaaggaggattaggtyaaaaccaacagcatagacagaatt

SEQ ID NO: 114570 - DNA, 32 bp, homo sapien
atgcttcaaattaggcraacgtgattccagat

SEQ ID NO: 114571 - DNA, 50 bp, homo sapien
atttaaaaacaaagacaacaactggstacatggcctgaacgtccctgcag

SEQ ID NO: 114572 - DNA, 50 bp, homo sapien
aaaaagttctgctaccatgttaaaaraatcatgcaatgctaagtatgata

SEQ ID NO: 114573 - DNA, 50 bp, homo sapien
atagcttccctgacttgagacaaagrctgttgactagaatctcttgattc

SEQ ID NO: 114574 - DNA, 50 bp, homo sapien
ctttcactccttgtctttctgtcctkaactataaccatccaggggtttac

SEQ ID NO: 114575 - DNA, 50 bp, homo sapien
tcaaatataaagccaaagtgttacayagctagaagaaaacacaaaataat

SEQ ID NO: 114576 - DNA, 50 bp, homo sapien
tccttaactgaaagcattatactaartgtcctcaatggaaggaagagttg

SEQ ID NO: 114577 - DNA, 50 bp, homo sapien
cctcttcacagaaacaggttgaaaamgacagcatgctttcaggagagtct

SEQ ID NO: 114578 - DNA, 50 bp, homo sapien
ttaggataatcagggagtaggaaatragagagatagctgttaatctttgt

SEQ ID NO: 114579 - DNA, 50 bp, homo sapien
cacctggaaaacaaaaatgcaaataytatcatcgtaaattataagatttc

SEQ ID NO: 114580 - DNA, 50 bp, homo sapien
atgttaaatttaaaggataagggaamcttgagtatgatatcaattatata

SEQ ID NO: 114581 - DNA, 50 bp, homo sapien
ctcagcaacaggcatagaactgttaycagatggctgaatttaggactgca

SEQ ID NO: 114582 - DNA, 50 bp, homo sapien
cagctagtttccttccttatctaaaytgtggtcaatagcaacagattatt

SEQ ID NO: 114583 - DNA, 50 bp, homo sapien
tactgtactatagagatattgccagratactttattgttatacttactta

SEQ ID NO: 114584 - DNA, 50 bp, homo sapien
ctttgaaatgcatacatgtgctctcyaacaagtgatctagtttccctttc

SEQ ID NO: 114585 - DNA, 50 bp, homo sapien
ggtccctgaggacagaaacctcatcyatcttcctcactactgtctcctac

SEQ ID NO: 114586 - DNA, 50 bp, homo sapien
ataacactctgactgacataatctcmttgcaatattgttgagccatagcc

SEQ ID NO: 114587 - DNA, 50 bp, homo sapien
gccatctattagcccttgtcttgacycttcagataagaggaacatcatgg

SEQ ID NO: 114588 - DNA, 50 bp, homo sapien
agtgttaaagaggaaaattgccttaygataggaattaatggaaaatggtg

SEQ ID NO: 114589 - DNA, 50 bp, homo sapien
agtttttaatatcagttttcagataytaaaatgagatgcataagttcaag

SEQ ID NO: 114590 - DNA, 50 bp, homo sapien
agctgcattctcttacataaatgggratgtatgggttgttaacatggatg

SEQ ID NO: 114591 - DNA, 50 bp, homo sapien
tcggactcagaagctgtcactaagayggataatagtaccaagtatttttg

SEQ ID NO: 114592 - DNA, 50 bp, homo sapien
tagaagcattctttgttctttacaargctatcatgaagtgctaatgacat

SEQ ID NO: 114593 - DNA, 50 bp, homo sapien
ttgaaatgaagagtgaagaacctacratttgaaaataatcacatccactg

SEQ ID NO: 114594 - DNA, 50 bp, homo sapien
aggacatatagggcaaaagatgatasaggcaataaaatggaacgcttaaa

SEQ ID NO: 114595 - DNA, 50 bp, homo sapien
gagcgacactgccttagtagtcttaygaaatccaatcaaggcaacttatg

SEQ ID NO: 114596 - DNA, 50 bp, homo sapien
tatagaagaatagatccaatgcataygaagttactgttttttaaaaaagt

SEQ ID NO: 114597 - DNA, 50 bp, homo sapien
ctgatgagaactacctataaagtgargccaggaataaaagggaaatggat

SEQ ID NO: 114598 - DNA, 50 bp, homo sapien
ggttaaaggtgctataagggaatagratgtgctgttaaatgcttatgtat

SEQ ID NO: 114599 - DNA, 50 bp, homo sapien
ttgggcctatgtagatgaattatcgrcatttatctaagaaaggttctcat

SEQ ID NO: 114600 - DNA, 50 bp, homo sapien
cctgcccatgcttttttctcaagaaytgccatttggacccttattaggtg

SEQ ID NO: 114601 - DNA, 50 bp, homo sapien
tctcctctgtggagtgattaagccamaaactccatagaggtcaggagtga

SEQ ID NO: 114602 - DNA, 50 bp, homo sapien
atgggtacagtttacaggaaaaataytatattcagcacccctgagagaaa

SEQ ID NO: 114603 - DNA, 50 bp, homo sapien
ttttcctgatgttcttgtttaggcarctgacaaatccctcaaactcatcg

SEQ ID NO: 114604 - DNA, 50 bp, homo sapien
atcaacaacatacagaatccataagygattaagtggtatttttaatatac

SEQ ID NO: 114605 - DNA, 50 bp, homo sapien
tcagtaaaaactcacataattaagakatttggtagactggcattgtctta

SEQ ID NO: 114606 - DNA, 50 bp, homo sapien
gaatgaatgacctcattcagaaaacrctgtcagtcatttgcccacctttt

SEQ ID NO: 114607 - DNA, 50 bp, homo sapien
tatagtttcacgttaatctccagatyctgttaagccactaaataccagtt

SEQ ID NO: 114608 - DNA, 50 bp, homo sapien
ggtgagatttatacagtaggtgccgmagtcacattttcgtgtcaggaagg

SEQ ID NO: 114609 - DNA, 50 bp, homo sapien
tttgtgatagctggtatttagtttaygatatttcccaggaagaacttttt

SEQ ID NO: 114610 - DNA, 50 bp, homo sapien
aagcttttaaaatcactgaaaacackcgtatgaataaatttcactatagg

SEQ ID NO: 114611 - DNA, 50 bp, homo sapien
cagtggagagctacttaagtggcaaragactgagtttcctcttgtgattg

SEQ ID NO: 114612 - DNA, 50 bp, homo sapien
ttttcccttgaagaaccatgtaaatraatcgtataaatactgtataaact

SEQ ID NO: 114613 - DNA, 50 bp, homo sapien
tataatcagggccatcactgaaatcyatgaaatctgctataggagtgagt

SEQ ID NO: 114614 - DNA, 50 bp, homo sapien
gccaatcaaacaaacatcaaacacartgctccgctctattcccactctca

SEQ ID NO: 114615 - DNA, 50 bp, homo sapien
tatggctactgtgaaaattcaataarttattactggtaaagcatatagga

SEQ ID NO: 114616 - DNA, 50 bp, homo sapien
ctctctctacaatctctccctgaaascaaatccattctcaagattttaac

SEQ ID NO: 114617 - DNA, 50 bp, homo sapien
actaaaatcaagcaattatgagacaktgatgattattattttgagcaaaa

SEQ ID NO: 114618 - DNA, 50 bp, homo sapien
tgggagaaaggacctgcagtgggatsatagaaatttttggctttggatag

SEQ ID NO: 114619 - DNA, 50 bp, homo sapien
tttcctttctagatcttgactgatayaccagcctttttgaatccaaataa

SEQ ID NO: 114620 - DNA, 50 bp, homo sapien
agaattcaacaaaattgtggatatasaagggcttttggggttgtacatac

SEQ ID NO: 114621 - DNA, 50 bp, homo sapien
gccagggcaagtcttaggaataaaaygaagaaacagaaggcactgttgcc

SEQ ID NO: 114622 - DNA, 50 bp, homo sapien
acgtcaacttttttctctattgaagracattttaaatttacagcccaaga

SEQ ID NO: 114623 - DNA, 50 bp, homo sapien
gagagtgtcagactctcaaacaatartatcagggatgcagtggaaaagtt

SEQ ID NO: 114624 - DNA, 50 bp, homo sapien
acttttcctaaacataaaccctcatraatagcttggaaatgaagttgatc

SEQ ID NO: 114625 - DNA, 50 bp, homo sapien
taattaaagtttatgaagtttgtaargaacctaacagatgatcttgtcta

SEQ ID NO: 114626 - DNA, 50 bp, homo sapien
catcaagatgcctcccttgtgcctayagaaagatagagttgcctctggct

SEQ ID NO: 114627 - DNA, 50 bp, homo sapien
gggaatcagtaataaggtcggtagtwaactcagatttccatgtatagaac

SEQ ID NO: 114628 - DNA, 50 bp, homo sapien
ggagagaatatgagaatatgcataamtgaagtctctaccacaaattttga

SEQ ID NO: 114629 - DNA, 50 bp, homo sapien
atagaggctgataaaccaatattacraagatccacataattttcttattt

SEQ ID NO: 114630 - DNA, 50 bp, homo sapien
aacctagactgtccatgaagcaccamgggttaataaataaagaacagagg

SEQ ID NO: 114631 - DNA, 50 bp, homo sapien
acctcagtgagtagagagagaactcyagcaaggtggattggtagtgttca

SEQ ID NO: 114632 - DNA, 50 bp, homo sapien
aaatcctcccaactgctttatcaaaycttttggaaacttccctgaaaaga

SEQ ID NO: 114633 - DNA, 50 bp, homo sapien
taggtccatgaatgacagtgttcgaygagaccaaaatggaagaaaacatt

SEQ ID NO: 114634 - DNA, 50 bp, homo sapien
cagatgctatgtcttatgtcatggaytccaatgcttctagctctctgtag

SEQ ID NO: 114635 - DNA, 50 bp, homo sapien
ctaaaaaaattaaactctgcaaaagragtttcaatccccaaacaattctg

SEQ ID NO: 114636 - DNA, 50 bp, homo sapien
gcactttgacctacccaggagtagcraaactggagatagaaagcctcttg

SEQ ID NO: 114637 - DNA, 50 bp, homo sapien
aaacttaatacagtatccttaacccraaaaacatatattttagcaccagt

SEQ ID NO: 114638 - DNA, 50 bp, homo sapien
gataccaagagataaccaggttaacragattttgaaatgcttcatctttt

SEQ ID NO: 114639 - DNA, 50 bp, homo sapien
ctttgttacctggagtatttgattarcctaaacagtttaagcattttgaa

SEQ ID NO: 114640 - DNA, 50 bp, homo sapien
gactagcatgtatgagtgaattaaaragactgtctgcaaagttcacacca

SEQ ID NO: 114641 - DNA, 50 bp, homo sapien
ggtctagaaatatcaacaggatccasagaggtaaaattaattcacagctt

SEQ ID NO: 114642 - DNA, 50 bp, homo sapien
ccttcttatgagcaatttctgaaaamgtggctaaaggtgacagtgaaccc

SEQ ID NO: 114643 - DNA, 50 bp, homo sapien
ctcatgattaaagaaactcaaatgcsacataatagcataaagttaagaat

SEQ ID NO: 114644 - DNA, 50 bp, homo sapien
tctcttatgtctaaaaacatctacarctctctacaaatgtgttattttgg

SEQ ID NO: 114645 - DNA, 50 bp, homo sapien
tctacccatttctagcaactgtggamgtgcaattagcaatgaaaagccaa

SEQ ID NO: 114646 - DNA, 50 bp, homo sapien
atgttcagatgaggagaggtaagagwagttgaaggaaggacaatttccat

SEQ ID NO: 114647 - DNA, 50 bp, homo sapien
tgactcacaggcatcaggcttctcaytcctcatacacgtgagcaatgttt

SEQ ID NO: 114648 - DNA, 50 bp, homo sapien
ccaactctgctggagagttcatttcrctttctttctgggatgctgagatg

SEQ ID NO: 114649 - DNA, 50 bp, homo sapien
cccgcccattaaaggccagcagctawccctagtcactgggacaattcaca

SEQ ID NO: 114650 - DNA, 50 bp, homo sapien
tggttttctagaaggttctgacaaayccttactctcatttatcttattgc

SEQ ID NO: 114651 - DNA, 50 bp, homo sapien
cttccttcccactgagcaaagaaacraaataaagttgctagagatataac

SEQ ID NO: 114652 - DNA, 50 bp, homo sapien
catatctagttattgtccttgaggarctactaaaccattctgagagacat

SEQ ID NO: 114653 - DNA, 50 bp, homo sapien
attattgactttaccaagtcctgaaytcctttaacacaatggtcaactaa

SEQ ID NO: 114654 - DNA, 50 bp, homo sapien
gatgtgcatgaatactgggagataayattgttggtagtaaaactaagggc

SEQ ID NO: 114655 - DNA, 50 bp, homo sapien
attagtcttttttccacctatgttayaaatacagatttaaggctattttg

SEQ ID NO: 114656 - DNA, 50 bp, homo sapien
accttcaaagaacacaagaaaacaargaatagagttttataaagaaataa

SEQ ID NO: 114657 - DNA, 50 bp, homo sapien
gaaatgtgttggtaggtatggtctaygtgttatggtgtccagaagaggag

SEQ ID NO: 114658 - DNA, 50 bp, homo sapien
gtggtttatgtaatagcattttgagraagttagaatatcgcacatgtgta

SEQ ID NO: 114659 - DNA, 50 bp, homo sapien
gcttttggccagtgatcacttacacrcccttgctggagtgggtgtctgtc

SEQ ID NO: 114660 - DNA, 50 bp, homo sapien
ttaaaaaataacagaatataataaascacttaataccaacaaatttgaca

SEQ ID NO: 114661 - DNA, 50 bp, homo sapien
gaaaagaccaatttgactttccatgsattatgtcttcacctttgttaggc

SEQ ID NO: 114662 - DNA, 50 bp, homo sapien
atgtatgatttactttggattctackcctaaaacaaagtttgcaatcatc

SEQ ID NO: 114663 - DNA, 50 bp, homo sapien
atttatgtctctcatgggcagtctcwttttctagaacatccaagatgtgt

SEQ ID NO: 114664 - DNA, 50 bp, homo sapien
caccatccattccattatcattaaaytcatcttcctggagagcagatgtg

SEQ ID NO: 114665 - DNA, 50 bp, homo sapien
catgtataaccatcacagtttacaayagaatggctttggctgaattgcga

SEQ ID NO: 114666 - DNA, 50 bp, homo sapien
tagagagaagtaaataatggatagcragactgggataagttaggactttg

SEQ ID NO: 114667 - DNA, 50 bp, homo sapien
cctgtgacacgttatagcacagactrgtttttcagtttatgtttcttaaa

SEQ ID NO: 114668 - DNA, 50 bp, homo sapien
acccattgttgatcttcaggtttagsccatgttctactgttaactgctgc

SEQ ID NO: 114669 - DNA, 50 bp, homo sapien
aaaatcctgcttagaagggcatatgkatcatgacaggtagtatgatacag

SEQ ID NO: 114670 - DNA, 50 bp, homo sapien
aaatttgggtccacttctgaaatgcractttctggaacaaaaaaatatgc

SEQ ID NO: 114671 - DNA, 50 bp, homo sapien
atcagtttcttaatctttcaaaaggragcaacagtacttacagatttttc

SEQ ID NO: 114672 - DNA, 50 bp, homo sapien
tgcagcatacaagatcctcaacagtycttatccaaacttgccttcctagc

SEQ ID NO: 114673 - DNA, 50 bp, homo sapien
ccttagctcctaggccttacaggtayattggccctttgagctaaaatgtt

SEQ ID NO: 114674 - DNA, 50 bp, homo sapien
ccaagtcctattctttttcttagctrctaaaatctgtttctccctcattc

SEQ ID NO: 114675 - DNA, 50 bp, homo sapien
ctgcaaacagccagcttagtttgggmagtcatgcatcagtgcagaagccc

SEQ ID NO: 114676 - DNA, 50 bp, homo sapien
gagccacagagtcactgtcaagacckgagtttcagtgtagtaggtggaga

SEQ ID NO: 114677 - DNA, 50 bp, homo sapien
gagggcagtagataagacagatttarctgacaatgaaaggggtagtcaga

SEQ ID NO: 114678 - DNA, 50 bp, homo sapien
ccagaatttcagttaattccagatgkatgttgttaccagtgttatgtggt

SEQ ID NO: 114679 - DNA, 50 bp, homo sapien
gatggcctagtaaatactgaatacasaaccaacgttattcccctactcct

SEQ ID NO: 114680 - DNA, 50 bp, homo sapien
agaatgagactatttggagggaagayaaaatggataggagacaacaaaaa

SEQ ID NO: 114681 - DNA, 50 bp, homo sapien
aaggtttgcaccacacacgtaaatasagtccagtggttgagaaatgctga

SEQ ID NO: 114682 - DNA, 50 bp, homo sapien
ttatttgctccatatacatgcattgsagataggttggtagacagacaaac

SEQ ID NO: 114683 - DNA, 50 bp, homo sapien
tctaattttgtgtctgttaaccaatytctgactattcacacccccgccca

SEQ ID NO: 114684 - DNA, 50 bp, homo sapien
cttcataacaaccctgtgaggtccarattattatttccatcttcctaatg

SEQ ID NO: 114685 - DNA, 50 bp, homo sapien
ctataattgtttcttatctatgctaygaggatatttattgagcaaatatt

SEQ ID NO: 114686 - DNA, 50 bp, homo sapien
ggaggagaaaagaatgagaagagaaygtctatgccacatttgccattgta

SEQ ID NO: 114687 - DNA, 50 bp, homo sapien
gttatcggaagatttgggctttccakgtctgccttctttcttgctcttga

SEQ ID NO: 114688 - DNA, 50 bp, homo sapien
tttctctgggattacaaatcttaacractatttaagcctagaattattga

SEQ ID NO: 114689 - DNA, 50 bp, homo sapien
tataattcaccccaaatcatgcaatyagtaaaaggcaatatagagactga

SEQ ID NO: 114690 - DNA, 50 bp, homo sapien
ctgggcagaaggcccaattatgaaargagagtagtttcttctaaattaac

SEQ ID NO: 114691 - DNA, 50 bp, homo sapien
acacaactacaattacagtcagggaytcatatctcattctctttcagcct

SEQ ID NO: 114692 - DNA, 50 bp, homo sapien
agtgcacaatttatttttggccttgmtatttttctgtctgaattatttcc

SEQ ID NO: 114693 - DNA, 50 bp, homo sapien
tctgtagtgccaatttttatggttckatggtgtatttacagacatgacaa

SEQ ID NO: 114694 - DNA, 50 bp, homo sapien
aatcggaaacctttggcccagatttygtttctggtgctaatcccagggtg

SEQ ID NO: 114695 - DNA, 50 bp, homo sapien
tgctatggatgcagcagtaaattaartattgccttgccttcagagagctc

SEQ ID NO: 114696 - DNA, 50 bp, homo sapien
gtgagtgaaacaataacatggaatcrgaaacctttggcccagatttcgtt

SEQ ID NO: 114697 - DNA, 50 bp, homo sapien
gttttagtcattttatgcttagaaargtctcgtatctacagtcacagcct

SEQ ID NO: 114698 - DNA, 50 bp, homo sapien
acaaaataaactctttgttaatggtsaatagcataatccaaaagagaatt

SEQ ID NO: 114699 - DNA, 50 bp, homo sapien
cttccaatgtacttctttatctgcayatataaagctgatgtaaattgctc

SEQ ID NO: 114700 - DNA, 50 bp, homo sapien
gatctggggctgaaaacaaagtttcrgcatcacttatctagcattctttc

SEQ ID NO: 114701 - DNA, 50 bp, homo sapien
ttgggaggtgagagcgcagagataaytagcaaatcttgccctagggttag

SEQ ID NO: 114702 - DNA, 50 bp, homo sapien
aattaaataatttattcaaagccaayctgcacattagcatcagatctggg

SEQ ID NO: 114703 - DNA, 50 bp, homo sapien
tctatagggccatgcaaatgtactarctcttatcaccgtcaccattatca

SEQ ID NO: 114704 - DNA, 50 bp, homo sapien
cattggtgttagtccagtgaaaataktaactatgctctccttgagtcatc

SEQ ID NO: 114705 - DNA, 50 bp, homo sapien
aaaacacattttggagtagctatgayggactatggttaatctaaagaaac

SEQ ID NO: 114706 - DNA, 50 bp, homo sapien
gtgtaggtagtttttttgggaggtartgcaagaaaacagcagtgatgaag

SEQ ID NO: 114707 - DNA, 50 bp, homo sapien
gaaggaaatcagttcaaattctaaamaaaacctacatggcacagccaatt

SEQ ID NO: 114708 - DNA, 50 bp, homo sapien
tacctgaaatctggcttatcctatcractaaagcctagatttcacttttt

SEQ ID NO: 114709 - DNA, 50 bp, homo sapien
cttgttatggtgatgagtgtgaaacrgtgatcaataaaagactttcaagc

SEQ ID NO: 114710 - DNA, 50 bp, homo sapien
attttatgtggaatacagtagtgaaygaagtaaaagaggaagaaaggaaa

SEQ ID NO: 114711 - DNA, 50 bp, homo sapien
taaagacacttgtcactgtattaagygtccagtcagataatctagaatga

SEQ ID NO: 114712 - DNA, 50 bp, homo sapien
gagagaggtgggtttcattgagcaartcatcaaactccccaagcctgcat

SEQ ID NO: 114713 - DNA, 50 bp, homo sapien
ctatagtaaaatagtaaaatagaacraccataacaaataccatcctcatt

SEQ ID NO: 114714 - DNA, 50 bp, homo sapien
tgatgtgaggatttgaaacttaggcrgaatagtaagtaccaggcatgggc

SEQ ID NO: 114715 - DNA, 50 bp, homo sapien
ttatttctaccatggcaagccttgaygggagagccaattcggaaggaatg

SEQ ID NO: 114716 - DNA, 50 bp, homo sapien
acaaaggaagttcctgatgaggccawtgacccacactgacctccaaacca

SEQ ID NO: 114717 - DNA, 50 bp, homo sapien
gctcagctgactcacagaagtgtgasctaaaccggtgatggttagacagt

SEQ ID NO: 114718 - DNA, 50 bp, homo sapien
atttttccctagaatgtttgggctcratgtaagaaaaacaatgaaactac

SEQ ID NO: 114719 - DNA, 50 bp, homo sapien
atcagagctcttgaatgaccaggtaygctgtcaatgagcagtaatatttt

SEQ ID NO: 114720 - DNA, 50 bp, homo sapien
ttcttgaactggcacactcccagacrcaaattagtcttcacttccggagt

SEQ ID NO: 114721 - DNA, 50 bp, homo sapien
gacgtagagtgtatgagtcttttgaygaacacttacaacatgccttgtat

SEQ ID NO: 114722 - DNA, 50 bp, homo sapien
ttcttcctctggtattaggtacaaawccataatgactgattctttctcag

SEQ ID NO: 114723 - DNA, 50 bp, homo sapien
ccacaaatagatatttgcatttctgmagccagactagaagaccaaaatcc

SEQ ID NO: 114724 - DNA, 50 bp, homo sapien
aattagatgcactggaaagcatccgrcttcttaaaggtagacttagttaa

SEQ ID NO: 114725 - DNA, 50 bp, homo sapien
atgccatgagttttcctttctgtacyaagactctagcacagttctgagag

SEQ ID NO: 114726 - DNA, 50 bp, homo sapien
cctttctcttctactcattgataaaytctgaagccatagggaaggcaact

SEQ ID NO: 114727 - DNA, 50 bp, homo sapien
aggtactatctcatctaatccttacycaaagcacaagggggaatagctga

SEQ ID NO: 114728 - DNA, 50 bp, homo sapien
atgaatagaaaatcttggaagctgaracttattttgtgtaatccaggcca

SEQ ID NO: 114729 - DNA, 50 bp, homo sapien
ttcttcttagcttggaaaaggcatamagttgaaggattctgagctcattg

SEQ ID NO: 114730 - DNA, 50 bp, homo sapien
taacacgcaatattaccattttcaawctgtgttttcagaacagaattgtt

SEQ ID NO: 114731 - DNA, 50 bp, homo sapien
atcaataagtgcaataggtgaagaaygacttttatgttctagacatgctg

SEQ ID NO: 114732 - DNA, 50 bp, homo sapien
tacagttgttaccaaataaaccacartgaacagtgatatgttctttcagt

SEQ ID NO: 114733 - DNA, 50 bp, homo sapien
ttccacaaaagagtccatctctggcmaaagaagtaccagatctatgtttt

SEQ ID NO: 114734 - DNA, 50 bp, homo sapien
ccagaaagaacaagttattgacaaargaaagggagttagaccatcgctgg

SEQ ID NO: 114735 - DNA, 50 bp, homo sapien
ttagtccttgagcctaccatatctayggcaaaatattattaaattactta

SEQ ID NO: 114736 - DNA, 50 bp, homo sapien
tactccttggcttgtggctccatcckccatatttagagctcatcagttta

SEQ ID NO: 114737 - DNA, 50 bp, homo sapien
atgaattatttctttctacaataatytgaactgtaagtggcttctagaac

SEQ ID NO: 114738 - DNA, 50 bp, homo sapien
cctctgaatatagttatgaatttgtycactttcactgatgtcccgttgat

SEQ ID NO: 114739 - DNA, 50 bp, homo sapien
ggtcacaaattaattacattggactrcttctatcatggaaaaggcagtat

SEQ ID NO: 114740 - DNA, 50 bp, homo sapien
gacaaaacattattttctcaatcttyaaatgagtctgatgaaggctcgat

SEQ ID NO: 114741 - DNA, 50 bp, homo sapien
tcatttccagctactttgtatttaaytaatgtttctgtaatggcttgttt

SEQ ID NO: 114742 - DNA, 50 bp, homo sapien
attagagcataaaaaaatgaaattayggtactgaaaagtatgatttctaa

SEQ ID NO: 114743 - DNA, 50 bp, homo sapien
gcacgtattgatcacttactgagtayggaatgccaaatgaattgtgttgg

SEQ ID NO: 114744 - DNA, 50 bp, homo sapien
tacatttttgcttacttaggtacaaytgatgaaagagaaatgactttcaa

SEQ ID NO: 114745 - DNA, 50 bp, homo sapien
tgcacactctgaaagaattgtagackcagttcagaagggactttattctt

SEQ ID NO: 114746 - DNA, 50 bp, homo sapien
aatgatattgtctgatgccttctcayaattcaattcttctagatcctatc

SEQ ID NO: 114747 - DNA, 50 bp, homo sapien
gatgtttagtaacctattcaagatcrccatgctcttttttctataccagg

SEQ ID NO: 114748 - DNA, 50 bp, homo sapien
ccaccctacgaagtaggtactattawttatccactttataatgtcgatac

SEQ ID NO: 114749 - DNA, 50 bp, homo sapien
atgctttcaaatattttgctttaackctggaaacaagatttttaaaaatc

SEQ ID NO: 114750 - DNA, 50 bp, homo sapien
gtgatgaagtgtcttttctgtaagcrgatacctacaaagaattatattac

SEQ ID NO: 114751 - DNA, 50 bp, homo sapien
gggtggttttaaatgatgtggatctmaagtatggccatgcaagtaagtgg

SEQ ID NO: 114752 - DNA, 50 bp, homo sapien
agggccatgatttggctttataaccrccattccctctaattgtttagtca

SEQ ID NO: 114753 - DNA, 50 bp, homo sapien
atttagcctttggacaggtaaactamcacctccattgtgtaggtagggaa

SEQ ID NO: 114754 - DNA, 50 bp, homo sapien
catctagatctaaaaacaacactcaytgaggtaggaaataaaaagtaaca

SEQ ID NO: 114755 - DNA, 50 bp, homo sapien
ataagatatagaagtagataaattgyatatttgatgccaagaaaaatcag

SEQ ID NO: 114756 - DNA, 50 bp, homo sapien
aaaaaggtgacacattccttgtctcragtatatttatgaaagagaaaata

SEQ ID NO: 114757 - DNA, 50 bp, homo sapien
tatattaatctacactccaaatagargatgtatttctgtttttatccgta

SEQ ID NO: 114758 - DNA, 50 bp, homo sapien
ccactaacacatacagtgctataagrcagtggaaagaatgctgacagtga

SEQ ID NO: 114759 - DNA, 50 bp, homo sapien
aacaaggaagacacgatgcatcgcamaaagagcacctgaattctggtcat

SEQ ID NO: 114760 - DNA, 50 bp, homo sapien
cctctagagagccctaatacactaarccactaatattttagcatttgttc

SEQ ID NO: 114761 - DNA, 50 bp, homo sapien
agtctccattagagcagagaccttgrtttttgttaagagtgatatactca

SEQ ID NO: 114762 - DNA, 50 bp, homo sapien
tgggcaacatagaaagactctctttraaaaatgaaaattaaaaaagataa

SEQ ID NO: 114763 - DNA, 50 bp, homo sapien
tccttttattaatatcaagcaagtcycacaagtaataggagttatccagg

SEQ ID NO: 114764 - DNA, 50 bp, homo sapien
tagcaggtgtcagaagatctggaaaytggtcattagaaattgtacaacct

SEQ ID NO: 114765 - DNA, 50 bp, homo sapien
aaaatgatggtggttatttgattgtrttgtcttagatggcaggttttagc

SEQ ID NO: 114766 - DNA, 50 bp, homo sapien
tataccagcaaatccagccagatccrccttcaaagtatgtccagaatcca

SEQ ID NO: 114767 - DNA, 50 bp, homo sapien
taacaggctcctgccctgttagaackccaaatctgccctctaattaattc

SEQ ID NO: 114768 - DNA, 50 bp, homo sapien
caaatggtattcatgaagccctaacrgtacatttaataaagatatgctca

SEQ ID NO: 114769 - DNA, 50 bp, homo sapien
tgggctgagcttataaaatagaaagsgtaggttgattgattctttatctt

SEQ ID NO: 114770 - DNA, 50 bp, homo sapien
tgttgtgtttggcgatgcagacggargagagtagtgcactcagacattag

SEQ ID NO: 114771 - DNA, 50 bp, homo sapien
gacaatgataactatgattcgatgaygatttcaatcaaagaactactcca

SEQ ID NO: 114772 - DNA, 50 bp, homo sapien
ttactttacaagtggatggttgaagraggatttacatttacaaacattgt

SEQ ID NO: 114773 - DNA, 50 bp, homo sapien
tacttctctataaaattagcatgatsaccagcacagagtaagcactaata

SEQ ID NO: 114774 - DNA, 50 bp, homo sapien
atgcccacacatgcaagaaaagaagycttcaggtgattttagccaccagc

SEQ ID NO: 114775 - DNA, 50 bp, homo sapien
aaagagatgaaaccacatgagcagargagttaaagcttgtatgatatcta

SEQ ID NO: 114776 - DNA, 50 bp, homo sapien
agatgaagaaattttggttatcttcraaatggagaagggtaactaaagcc

SEQ ID NO: 114777 - DNA, 50 bp, homo sapien
ctttaactaaaactcctagggtatcygacaagcccttagaagcctatagc

SEQ ID NO: 114778 - DNA, 50 bp, homo sapien
taccattaaccatacagcttataaasattatctccaatgctcacaaaact

SEQ ID NO: 114779 - DNA, 50 bp, homo sapien
tacctgatttcatttaatacttaaamatgcaaacaggacatataattatt

SEQ ID NO: 114780 - DNA, 50 bp, homo sapien
aatattagatgagattcatccactcyggttgatcagaatgcctgttttct

SEQ ID NO: 114781 - DNA, 50 bp, homo sapien
atcacaaaaggtgatgcagcaaggargtactctgaacctagtccagaaag

SEQ ID NO: 114782 - DNA, 50 bp, homo sapien
ggcatttcctctgtgtatatgtctaygcattcttgtaaagccatctgtca

SEQ ID NO: 114783 - DNA, 50 bp, homo sapien
caataaagctggagaagaaaaaatayaccatgagatgctgatcatgctgg

SEQ ID NO: 114784 - DNA, 50 bp, homo sapien
atccctttaagacaacaactcagaarggttccacaggaagttattataac

SEQ ID NO: 114785 - DNA, 50 bp, homo sapien
atcatctcaattccccaaaagccackctaatacttggcaaaacccaaatg

SEQ ID NO: 114786 - DNA, 50 bp, homo sapien
gacctccttcctgtttttgttaatgragtgttattggaatgtagtcacta

SEQ ID NO: 114787 - DNA, 50 bp, homo sapien
ctgtattcacaataactcttttccartatcccataagaaaattcctcacc

SEQ ID NO: 114788 - DNA, 50 bp, homo sapien
cctgatttaaaacaggaatattatgyatgctaagtcctagatagttctac

SEQ ID NO: 114789 - DNA, 50 bp, homo sapien
tggccaactttgtatcatgggcaagsctcttttgtttgcagttctctgaa

SEQ ID NO: 114790 - DNA, 50 bp, homo sapien
cttttggaaacattttgcaatatcargataagtggattgatcatgatcta

SEQ ID NO: 114791 - DNA, 50 bp, homo sapien
tcttagacttcctaagcttgtcccartgaaatgactccgtggcttgtttg

SEQ ID NO: 114792 - DNA, 50 bp, homo sapien
atagctttgtgcatttccatttttaygtgttatctgttttccttttgctt

SEQ ID NO: 114793 - DNA, 50 bp, homo sapien
tcacagcaactttttatcatgggaargataggaaaagctttttgtttccc

SEQ ID NO: 114794 - DNA, 50 bp, homo sapien
agttattggtctgggagaagattaarcagatcaagataaaattaacatgg

SEQ ID NO: 114795 - DNA, 50 bp, homo sapien
ctaattctagataacttaaaggaaargaagcctcattataagcataaaag

SEQ ID NO: 114796 - DNA, 50 bp, homo sapien
ttctgtgcttcatagccataaagaargaaattgacctgctcttccaaata

SEQ ID NO: 114797 - DNA, 50 bp, homo sapien
tccttaaacttctcaatgtctccatktttctttttgttacaaggagttaa

SEQ ID NO: 114798 - DNA, 50 bp, homo sapien
tggacttcagcttggaaaactcaaarcatccacgggtaacagatggcaga

SEQ ID NO: 114799 - DNA, 50 bp, homo sapien
caaattatcccatgttataaaatacraaaaacactatgattagcaagttt

SEQ ID NO: 114800 - DNA, 50 bp, homo sapien
tccaccctcgcctgaattcagtctgyagccaaagttggggtatgaaatgc

SEQ ID NO: 114801 - DNA, 50 bp, homo sapien
attactcctctctatggacagattamaaaggtgaattaatctggaaaagc

SEQ ID NO: 114802 - DNA, 50 bp, homo sapien
cccttagaaaagtgaagaattaaacygcatgtatctggaagaccccagtg

SEQ ID NO: 114803 - DNA, 50 bp, homo sapien
catgtggtttcctcccaaatatgcaragctgcctgtgacaagggaccagg

SEQ ID NO: 114804 - DNA, 50 bp, homo sapien
aggatgtcccagtaacaatactcaamgtaatgccatcattagcacttgag

SEQ ID NO: 114805 - DNA, 50 bp, homo sapien
aggaggaatcttcgcaaagccacagrcactgtaaccttggtgagatcccg

SEQ ID NO: 114806 - DNA, 50 bp, homo sapien
ttctttgatctggactaggttcctamgagcaaggaagttatgagattttc

SEQ ID NO: 114807 - DNA, 50 bp, homo sapien
agcgctgctgcttcccaaaatcttayagttttttcataaacatgattcct

SEQ ID NO: 114808 - DNA, 50 bp, homo sapien
aaaaacaacaacaatatggattttgwtaaggattgtgtttaatctagatg

SEQ ID NO: 114809 - DNA, 50 bp, homo sapien
ggcacaggacggacatatagatcaawggaatacaactggaaatatagaaa

SEQ ID NO: 114810 - DNA, 50 bp, homo sapien
ctggtcagaacgagtgtgggtatgcmgacagacaaagagcattatgtgag

SEQ ID NO: 114811 - DNA, 50 bp, homo sapien
ggggatgcataaaaagcatacttgawgaaataacaattgagactgtccta

SEQ ID NO: 114812 - DNA, 50 bp, homo sapien
gaatgtcatatttttcaagaactgakatataaaagttgataagtaagaca

SEQ ID NO: 114813 - DNA, 32 bp, homo sapien
gacgcttttcaaagagragtagaagttaaaat

SEQ ID NO: 114814 - DNA, 50 bp, homo sapien
atattacagaatacaggaaaatcacytgatgaagcatttatagatcagga

SEQ ID NO: 114815 - DNA, 50 bp, homo sapien
cttgcagaagacatgtgcaggtatayaaagggcaagaaaaatctttctat

SEQ ID NO: 114816 - DNA, 50 bp, homo sapien
agcttaacttttaaaagcaggttaaygaataatttcctattgggtaatat

SEQ ID NO: 114817 - DNA, 50 bp, homo sapien
aagagattagtgtaagggtttataastgttgcattatggtgcaaatcagc

SEQ ID NO: 114818 - DNA, 50 bp, homo sapien
tagtttctagcaaccaccaagtttayctgttatataagagcaaggaaaac

SEQ ID NO: 114819 - DNA, 50 bp, homo sapien
ttgtgaggaaagccatgaataaaacygttctcaggatgcagtgctaatta

SEQ ID NO: 114820 - DNA, 50 bp, homo sapien
gcatttctaataagctcccaagtgaygtctatgctgtgggatgttaccac

SEQ ID NO: 114821 - DNA, 50 bp, homo sapien
ctgcataggatagcacagagaaatargaaccaggatgaaatggagagtcg

SEQ ID NO: 114822 - DNA, 50 bp, homo sapien
gtgagactaatgactccaaaattacrccctatgctgtgatgggcaaagca

SEQ ID NO: 114823 - DNA, 50 bp, homo sapien
gcagttggagaaaccatttattgagraaaggaagactcaggattttggag

SEQ ID NO: 114824 - DNA, 50 bp, homo sapien
cctacgagttgattcatgttctacayatcagtggtttcatccaactgtga

SEQ ID NO: 114825 - DNA, 50 bp, homo sapien
gatgaatgaagagtgagagctggacrctggtaaaagaatgaatataaaca

SEQ ID NO: 114826 - DNA, 50 bp, homo sapien
cagtacctgtcattcaccctgctcaygttaagtatcatcattacaaagtg

SEQ ID NO: 114827 - DNA, 50 bp, homo sapien
caccccgaggctgccaggaactgacrgaactgagcgcaagtggacaatgc

SEQ ID NO: 114828 - DNA, 50 bp, homo sapien
ggctctgtgtaggcgagatgcgcacsgaaaattaaatccacgttggaaat

SEQ ID NO: 114829 - DNA, 50 bp, homo sapien
acaggaattcagacttgatacagaayggaaatagaggcgtccttcaagta

SEQ ID NO: 114830 - DNA, 50 bp, homo sapien
gcaggtatgcagggagagcttaaaaygccacatggataatatactcatgt

SEQ ID NO: 114831 - DNA, 50 bp, homo sapien
aagactactttcgtaatgacacaaakatgttatctggctttttcactctc

SEQ ID NO: 114832 - DNA, 50 bp, homo sapien
gtttcttagcttactgttttaaaacsctgagtcatagcacttagaattgg

SEQ ID NO: 114833 - DNA, 50 bp, homo sapien
tcctggtatatttaaacttcaaagayatgtgtctgcattatgagagctta

SEQ ID NO: 114834 - DNA, 50 bp, homo sapien
cataccaaatatttaggcttggttcratgtacaacacctgttcttccttc

SEQ ID NO: 114835 - DNA, 50 bp, homo sapien
gctccccattggtggtcctaaagcawatcaattttatttctctgtaaact

SEQ ID NO: 114836 - DNA, 50 bp, homo sapien
ggtggtataaggattaaataaaatamgtaaagtgcccactatcgtgctag

SEQ ID NO: 114837 - DNA, 50 bp, homo sapien
taaaaaccaatctatacagtataaartattgttccctaaatgcttatcac

SEQ ID NO: 114838 - DNA, 50 bp, homo sapien
gagaaatatgtctctgatttcaaaarctttcagaaaggacaggggtagat

SEQ ID NO: 114839 - DNA, 50 bp, homo sapien
tgtcctcatctttcaagtgggaatarcaatgcccatcatccagttattgt

SEQ ID NO: 114840 - DNA, 50 bp, homo sapien
gagaggagaatagcaattatgtatgyatcaccaggtggctcaaactagca

SEQ ID NO: 114841 - DNA, 50 bp, homo sapien
gaggccagtctttcgacttttcttcycagcaagctcgggaatgacagcaa

SEQ ID NO: 114842 - DNA, 50 bp, homo sapien
ttacctggactatactgttccattcytgttacacttgggagtttagggaa

SEQ ID NO: 114843 - DNA, 50 bp, homo sapien
tctgttgaataaacatgagtataaayaagtgacctaatccttgtactctt

SEQ ID NO: 114844 - DNA, 50 bp, homo sapien
gggggagtgatgaaaatataaaatcrattgtggtgatggtttcacatctc

SEQ ID NO: 114845 - DNA, 50 bp, homo sapien
tggagttaggcacacctggtaggaayagcattggaatgtataattcaaaa

SEQ ID NO: 114846 - DNA, 50 bp, homo sapien
atgacaaaattaatctctgaaaggarctaagtcacacataaggctcactt

SEQ ID NO: 114847 - DNA, 50 bp, homo sapien
gagacccacaccacaaggctatgacrtaattcttggttgcctgccaaaat

SEQ ID NO: 114848 - DNA, 50 bp, homo sapien
gactgccatctcttacaggtacatarcactttacaatgtacagagcacct

SEQ ID NO: 114849 - DNA, 50 bp, homo sapien
tgagccatcacgcccagccacttaasgtgattgtttgcatgagtttaatg

SEQ ID NO: 114850 - DNA, 50 bp, homo sapien
ttcaagagtgtattgttcttaggacsaggaagagaaaacaggcctaaatg

SEQ ID NO: 114851 - DNA, 50 bp, homo sapien
tttgtatcattagctgtttcttcacratgtgcctaaagaccaatgcttaa

SEQ ID NO: 114852 - DNA, 50 bp, homo sapien
aaaaaaaaaatcactttagaacttaycaattttaatggaatttcaagaaa

SEQ ID NO: 114853 - DNA, 50 bp, homo sapien
tataggaagctgagtatgggcacaaraactatatccgaagatcctgactt

SEQ ID NO: 114854 - DNA, 50 bp, homo sapien
ataaaaatcacttgagcagtttgttyaaaacccgtgttctgatttggcat

SEQ ID NO: 114855 - DNA, 50 bp, homo sapien
ctactcacactcctctctttcttcckctatatgggaaatcacggggtaaa

SEQ ID NO: 114856 - DNA, 50 bp, homo sapien
tgtataatatttaaaaatttaaaaascatagcgacactaaaaatcagtgg

SEQ ID NO: 114857 - DNA, 50 bp, homo sapien
taattttatattgctcagtttcaagyagtttaacttaaggctttacgatt

SEQ ID NO: 114858 - DNA, 50 bp, homo sapien
gtgctataatccctgagtcctctaasaaatgagacacaaaggaaagatcc

SEQ ID NO: 114859 - DNA, 50 bp, homo sapien
ggggctctgagttaagggctttccakagactcactcctgccgtttcttct

SEQ ID NO: 114860 - DNA, 50 bp, homo sapien
ttctagtctagaatcagaatatgtgyaatgggctggatctgaagctccca

SEQ ID NO: 114861 - DNA, 50 bp, homo sapien
aactttttttttttatagatttggartcctgttatgttgcccaggcttgt

SEQ ID NO: 114862 - DNA, 50 bp, homo sapien
gccttgctttctagactgttttgccyaatggaaaatagtgtttgtatctt

SEQ ID NO: 114863 - DNA, 50 bp, homo sapien
ccctggagtagaatcagttgagttaygacaggaaatgagggcatccaatg

SEQ ID NO: 114864 - DNA, 50 bp, homo sapien
cctccaagaaagctgtcaagctgaakaatcaatcagataatgtctatttc

SEQ ID NO: 114865 - DNA, 50 bp, homo sapien
ggctatgtaaattagtggcttaaaaygcatgaaaagtgttctgactttca

SEQ ID NO: 114866 - DNA, 50 bp, homo sapien
ctactattggagccaataaataagaygtatgttgcaggtgatgtgaaagt

SEQ ID NO: 114867 - DNA, 50 bp, homo sapien
ccttctggaggctctaggagagaaasggtttgcttgacatttccagcttc

SEQ ID NO: 114868 - DNA, 50 bp, homo sapien
actgcacaaatatagaagctttcgawctctcaattcccacagttattgtt

SEQ ID NO: 114869 - DNA, 50 bp, homo sapien
ttgttttattcctgttgcttgaaacwacttctatacaatttaatgataat

SEQ ID NO: 114870 - DNA, 50 bp, homo sapien
tggaaagagagacaggaaatcatacrgagattacggagattgcttcctgg

SEQ ID NO: 114871 - DNA, 50 bp, homo sapien
tgtctgctttcttgttcattcaatawtgcctgtttttgaccactccatca

SEQ ID NO: 114872 - DNA, 50 bp, homo sapien
cctgcctcccagctttgtaatatctsaattttctcctgtatttgctttgg

SEQ ID NO: 114873 - DNA, 50 bp, homo sapien
atatatagatatgatagatagatacratagctagatggagatgatagata

SEQ ID NO: 114874 - DNA, 50 bp, homo sapien
agaaaacaaataggatgttgagttasagaatagcagaggaaggaactaat

SEQ ID NO: 114875 - DNA, 50 bp, homo sapien
ggatctatgatctggaaataggtcartacatatgtctgttataaagaaga

SEQ ID NO: 114876 - DNA, 50 bp, homo sapien
tcaccgccccaagtacctccatgaawcaaaggacaatgatcaaatacatg

SEQ ID NO: 114877 - DNA, 50 bp, homo sapien
gagcaggtatgagcatctctgtaccygctggcaagaaattagatgcaatg

SEQ ID NO: 114878 - DNA, 50 bp, homo sapien
gggaactttgccacaagtttcttcaygctatggcaactactactgctccc

SEQ ID NO: 114879 - DNA, 50 bp, homo sapien
ctggatgaactggtgtgcagctttcmatttctacacttcacacaagatac

SEQ ID NO: 114880 - DNA, 50 bp, homo sapien
gatgtccacagagatccttagaaagkccaggacagatgtctgggtcatca

SEQ ID NO: 114881 - DNA, 50 bp, homo sapien
gatttcccaccaacagtctctcttaygggttctttctgggtagaggccca

SEQ ID NO: 114882 - DNA, 32 bp, homo sapien
cgtgagaccagacccgmtaaggatgctcaatc

SEQ ID NO: 114883 - DNA, 50 bp, homo sapien
cttaaaagtctgatatacatccacargctaaagagattaacccctttctc

SEQ ID NO: 114884 - DNA, 32 bp, homo sapien
ctattggtaaaaaaaawgaatgtctcataggt

SEQ ID NO: 114885 - DNA, 50 bp, homo sapien
ttcagagaaaagatttgaaagcttakaccttatgggagctaggatattaa

SEQ ID NO: 114886 - DNA, 50 bp, homo sapien
gacaagctttcaaccctcatgaagcygaagattttcctctcttcctcctc

SEQ ID NO: 114887 - DNA, 50 bp, homo sapien
agggcttgcacaatatggggactcaragtgcaaccagtgcgagaagagcg

SEQ ID NO: 114888 - DNA, 50 bp, homo sapien
ttttcaaaatccttcctttgattccyagtggtctgccaggggctgttctc

SEQ ID NO: 114889 - DNA, 50 bp, homo sapien
caacaagtttcctgaagtcataaaamaggtagaagaaagagagaagtcta

SEQ ID NO: 114890 - DNA, 50 bp, homo sapien
ctcccaagtttagagttaattacacrgatcccaaccataatcacagccgg

SEQ ID NO: 114891 - DNA, 50 bp, homo sapien
ccgtgaggaatgtagaactatatcaycataatggcagacttctcccattt

SEQ ID NO: 114892 - DNA, 50 bp, homo sapien
cggtgctgccaatgtacagttgcgaycaataaagaagtgttattatcaaa

SEQ ID NO: 114893 - DNA, 50 bp, homo sapien
aacagcacatctctcttttttgatayaaatgcatgctgaaggttctggcc

SEQ ID NO: 114894 - DNA, 50 bp, homo sapien
ttccttataaaatcagacagttctgygtaggcggccaggtttattaacag

SEQ ID NO: 114895 - DNA, 50 bp, homo sapien
gtggcctagctctgccttaatagacyacgccagctgatcagggtgacaca

SEQ ID NO: 114896 - DNA, 50 bp, homo sapien
agaactgttgttccagaatttactayggcaatccctccaactggactgaa

SEQ ID NO: 114897 - DNA, 50 bp, homo sapien
attttgcagatgtccatgagtaaaamcgattttattctatttattctaag

SEQ ID NO: 114898 - DNA, 50 bp, homo sapien
gggtagcagattttttaaacctaacratatatcctggccttctctcgtgc

SEQ ID NO: 114899 - DNA, 50 bp, homo sapien
ccattataccctgcaaattatcaacmgtaatctcccagttctctacttcc

SEQ ID NO: 114900 - DNA, 50 bp, homo sapien
aaaattagccagatgtactagggcaygtttgtagttccagctactcagga

SEQ ID NO: 114901 - DNA, 50 bp, homo sapien
ctttcaaaaatctctgctttcaagaygcttcggtagccaaggcaaaaagg

SEQ ID NO: 114902 - DNA, 50 bp, homo sapien
cctgggaccaagccgtgtgagcctascaggtttcagatgcctacacagaa

SEQ ID NO: 114903 - DNA, 50 bp, homo sapien
tatagtgatgataatgagaaccctamagcttaatgaatttgtcaaagtta

SEQ ID NO: 114904 - DNA, 50 bp, homo sapien
agattttgattgatatgattaaaacwgtgtgatcataaaagactgactca

SEQ ID NO: 114905 - DNA, 50 bp, homo sapien
atgtgtttggtgaccaacttcaatastacagaatatgtatcagagagggg

SEQ ID NO: 114906 - DNA, 50 bp, homo sapien
ttgtttactctctgtgtcttcctaargtagaagagatttgaggactagga

SEQ ID NO: 114907 - DNA, 50 bp, homo sapien
gttttcaatttcttatgtactcttcraagtaagttgaaaatcagtttcta

SEQ ID NO: 114908 - DNA, 50 bp, homo sapien
cctatagctaaactatcttacagccyactttgagtttgctaagctgctac

SEQ ID NO: 114909 - DNA, 50 bp, homo sapien
cctcgtcctgcacaagataatgcaawctcttccacttagaccgctacaca

SEQ ID NO: 114910 - DNA, 50 bp, homo sapien
acctggagtcagggaccacggtatargccaccacagcggttaagggcaaa

SEQ ID NO: 114911 - DNA, 50 bp, homo sapien
aaccccaccacgggtataaagagaasagtcagggactggggagggagctg

SEQ ID NO: 114912 - DNA, 50 bp, homo sapien
tactaaaattattgatgtagctaaaytgtgaggatttttggaggaaagag

SEQ ID NO: 114913 - DNA, 50 bp, homo sapien
tgggagataggcaagtcagtatttaygaagttacttgaaaagcaaaaaat

SEQ ID NO: 114914 - DNA, 50 bp, homo sapien
aggatgtcataaaaactaattaacaygctagaccaagctgtgaaagcctc

SEQ ID NO: 114915 - DNA, 50 bp, homo sapien
aaaacatagaaggcatcatgaaatargcccagaaagactggagttaacag

SEQ ID NO: 114916 - DNA, 50 bp, homo sapien
cagagtctgaggtagctgccctggcrtatttaacaacatcagccgagacg

SEQ ID NO: 114917 - DNA, 50 bp, homo sapien
gagaatctggctgccttcagccaaaycttattcgggagcatttgcaaaac

SEQ ID NO: 114918 - DNA, 50 bp, homo sapien
tatgttctttcatcacatccatttcrctcttcaaaggcattcttctcaac

SEQ ID NO: 114919 - DNA, 50 bp, homo sapien
gtgctgggtgccggcaccctcaaacmggtaaagcaaaacacaaaaccaat

SEQ ID NO: 114920 - DNA, 50 bp, homo sapien
ataacttccctggcattatgtgagamatccaaaggtttagttagggagac

SEQ ID NO: 114921 - DNA, 50 bp, homo sapien
accacaaaaaaaaaatttgaggtaaygcatgttaatatattagcttgact

SEQ ID NO: 114922 - DNA, 50 bp, homo sapien
cctcagttatagactacatgcatcaytattgagtactgattattaagcta

SEQ ID NO: 114923 - DNA, 50 bp, homo sapien
gcaaaacaaaacaaaagggcacttayacgatgttgatctatgttttatct

SEQ ID NO: 114924 - DNA, 50 bp, homo sapien
cccctgttcaagtgtacattttagcyactctaatttttctgacaattgtt

SEQ ID NO: 114925 - DNA, 50 bp, homo sapien
ccagctctgcctttggtgaccttaaktgagttgctcaccttccctgagcc

SEQ ID NO: 114926 - DNA, 50 bp, homo sapien
tgcgggcacactattttttccagacragatcatcacagcagatgatggta

SEQ ID NO: 114927 - DNA, 50 bp, homo sapien
aacaaaaatattagcctaaatttaaygaataccagatgtatgcagtgaga

SEQ ID NO: 114928 - DNA, 50 bp, homo sapien
tcaggacttgcaaaaacgggtctcarcatgccttcccagagccatgaggt

SEQ ID NO: 114929 - DNA, 50 bp, homo sapien
cctgctgctatggatatgcgtttacrtcgaagggcttgatttctgggagt

SEQ ID NO: 114930 - DNA, 50 bp, homo sapien
accggaacagatcctagaaaaaagayatggttactgtgatgtctgttatc

SEQ ID NO: 114931 - DNA, 50 bp, homo sapien
cagggctttcagctcttagaataaaratatttgagaaaaaatgtttatgg

SEQ ID NO: 114932 - DNA, 50 bp, homo sapien
gacagaccaggtgatgctgctataayaaacaatcccagaatctcagcagc

SEQ ID NO: 114933 - DNA, 50 bp, homo sapien
gttcttggttttctccctgaaccatragcaaagatacggcagaacctgag

SEQ ID NO: 114934 - DNA, 50 bp, homo sapien
gagaggtgcatatgtttgtatcttcrccctgaaactcaagtgtttgactc

SEQ ID NO: 114935 - DNA, 50 bp, homo sapien
aatacctaattctgcatgacctttamaactaggcagcattattcagtgat

SEQ ID NO: 114936 - DNA, 50 bp, homo sapien
tattttgctttgccatatacaaaaawttctttacctataaataggacaaa

SEQ ID NO: 114937 - DNA, 50 bp, homo sapien
gtccatggcagggctacgacaagaayatggaggtcaacctggtttcatta

SEQ ID NO: 114938 - DNA, 50 bp, homo sapien
ctgggcattgctgttcatgggtgtgragcaaccagaacacctacagatat

SEQ ID NO: 114939 - DNA, 50 bp, homo sapien
gcccaatgtactgtggatcagaaagratgtttttggctgtaagcagtgga

SEQ ID NO: 114940 - DNA, 50 bp, homo sapien
ttacatatctagagatgagaccttcratggtacagagattcctcaattat

SEQ ID NO: 114941 - DNA, 50 bp, homo sapien
cactgctctacaacaacataacgtaytaatccactcctggaactgcacaa

SEQ ID NO: 114942 - DNA, 50 bp, homo sapien
cctcgactcccagccagttctcctaygtggtcagagccgcctttccacat

SEQ ID NO: 114943 - DNA, 50 bp, homo sapien
gaggaccccagagttttattcgctgyttcatctcccctgtgacaaactga

SEQ ID NO: 114944 - DNA, 50 bp, homo sapien
ttattttgaaccccacatgtcttcgytgtgcagataaggaactcaagttt

SEQ ID NO: 114945 - DNA, 50 bp, homo sapien
aaccttcctcatcctttattttcatyacccgtgtgctagtctatcttccc

SEQ ID NO: 114946 - DNA, 50 bp, homo sapien
ggtactgaaaacacagtgactcataktagatcatttgtaacaatggagag

SEQ ID NO: 114947 - DNA, 50 bp, homo sapien
attaagttataccctatcagggaaartataaaggatggtgttggtatttc

SEQ ID NO: 114948 - DNA, 50 bp, homo sapien
taacaatggagagatgcaatatatayctgtaatcatatattacatattgt

SEQ ID NO: 114949 - DNA, 50 bp, homo sapien
tacctctttcattctttagacatcawctctacctgggaggcttctattca

SEQ ID NO: 114950 - DNA, 50 bp, homo sapien
aaatttcagttagacaagagaaataygtttgagatctattgtataccata

SEQ ID NO: 114951 - DNA, 50 bp, homo sapien
atgtgtcaatgaacgcatttctgacsgcatgcatgaaataccgattgttg

SEQ ID NO: 114952 - DNA, 50 bp, homo sapien
acatgcagaaatgtgaggtgctttaygtactgaaagtagtctgataattt

SEQ ID NO: 114953 - DNA, 50 bp, homo sapien
aaaccctgcttacaattacattacartctatttgagtgaagctgcatctc

SEQ ID NO: 114954 - DNA, 50 bp, homo sapien
ccgtctcaaaaaaaagtgagaaaaaygaagtctgacattttattgtctaa

SEQ ID NO: 114955 - DNA, 50 bp, homo sapien
acccatatgcatggctcccatgacaytgtaccattgctgtcctctaatgt

SEQ ID NO: 114956 - DNA, 50 bp, homo sapien
aacaacatgtacttcaagggttccartgagattttctgagctaatgtgcc

SEQ ID NO: 114957 - DNA, 50 bp, homo sapien
agtaacaccgtctgggtaattcacaraagaagtttattttgtaaagtcct

SEQ ID NO: 114958 - DNA, 50 bp, homo sapien
tcaagggttaactccaagcaagtaamttattctttctgtgcctcatgggg

SEQ ID NO: 114959 - DNA, 50 bp, homo sapien
ccctgcataaactcactacagaaaaygacctgggctagaaatggtagcag

SEQ ID NO: 114960 - DNA, 50 bp, homo sapien
tatggtccatggatgagcagtatcamcattgcccaggacttagacacata

SEQ ID NO: 114961 - DNA, 50 bp, homo sapien
ccagcagctataggtgtatatagtayggttgacccttaaacaatgtgggg

SEQ ID NO: 114962 - DNA, 50 bp, homo sapien
attactgagaatattacccacatacrctaagtacaaattttttggtttgt

SEQ ID NO: 114963 - DNA, 50 bp, homo sapien
tgtgcctcttggttcattagcagcamgctctaccctcaacaccagtagcc

SEQ ID NO: 114964 - DNA, 50 bp, homo sapien
catccccttatgaatcaccatgtaasactcccataaagggagtttctcca

SEQ ID NO: 114965 - DNA, 50 bp, homo sapien
gatagcaaatacacagaccacatcayggatatcaagtaaatacagaaagt

SEQ ID NO: 114966 - DNA, 50 bp, homo sapien
tgggtgtgacttctctgacgcctcasatgagaaactctaaagagcaatga

SEQ ID NO: 114967 - DNA, 50 bp, homo sapien
agcaaagtagaagagggttcagagargatatttgaaggcctccaaaacaa

SEQ ID NO: 114968 - DNA, 50 bp, homo sapien
caatgacaactgctgaatggctcaarctgcaatcatttttggtcccgatc

SEQ ID NO: 114969 - DNA, 50 bp, homo sapien
cagaggctgtgtttgaaattcacaayggacagggcctggtgctgatgagg

SEQ ID NO: 114970 - DNA, 50 bp, homo sapien
gaccacagggaggtggactaggaccyactgtaatggagaattttctagag

SEQ ID NO: 114971 - DNA, 50 bp, homo sapien
tcgattttgggtactctcttctactkaaattcattagtcatggaattcat

SEQ ID NO: 114972 - DNA, 50 bp, homo sapien
ggatacaaatcttgtctgattctaayacctatactctttccactatacct

SEQ ID NO: 114973 - DNA, 50 bp, homo sapien
ctagaaaggtgaaaatgttttaaaaycagttatggcttaaatatggaaaa

SEQ ID NO: 114974 - DNA, 50 bp, homo sapien
gttagataacatctcaaacataagayacgggttataacatctaaagtaaa

SEQ ID NO: 114975 - DNA, 50 bp, homo sapien
tggaaaagtctcttggtgtggttacygaagggttaaagacaaggtttcta

SEQ ID NO: 114976 - DNA, 50 bp, homo sapien
tccattgtaacacttacggtcaatayaagttccgatcaccatgaccacca

SEQ ID NO: 114977 - DNA, 50 bp, homo sapien
tagacttcattatggatggttgagcygaaacttctcctcaccttccaact

SEQ ID NO: 114978 - DNA, 50 bp, homo sapien
cagacttaattgctgctattccacasgctaaataagagctggaaattaat

SEQ ID NO: 114979 - DNA, 50 bp, homo sapien
gtcgtggtgggaagcgactgccataygcctgacgtacatgtgaggttttc

SEQ ID NO: 114980 - DNA, 50 bp, homo sapien
taaaatgaatataaatcaatcattawgacagaagaacttatttgagagtc

SEQ ID NO: 114981 - DNA, 50 bp, homo sapien
ctcctctattagcagtttacctatamcttagtttcaattaacagcacaag

SEQ ID NO: 114982 - DNA, 50 bp, homo sapien
tcaggagaagaagaaagactgtcacrgcagaaagtgtcatcaggtgctgg

SEQ ID NO: 114983 - DNA, 50 bp, homo sapien
acagtgcagccttcagtctgtattcmaaggtctgactcccaaagttgaag

SEQ ID NO: 114984 - DNA, 50 bp, homo sapien
agattcccgaataaccgggtctgaaytaatgagtttttactctgctttga

SEQ ID NO: 114985 - DNA, 50 bp, homo sapien
caaaagcatatggaaaaatgcttaayatcactgtcaggggaatgcaaata

SEQ ID NO: 114986 - DNA, 50 bp, homo sapien
gggaatgatgctgtgaaaaggtaaaytggaacaagattgtggaggctgca

SEQ ID NO: 114987 - DNA, 50 bp, homo sapien
caatcctccaaggacttatgattgcyctcattacgtagatggagaaggag

SEQ ID NO: 114988 - DNA, 50 bp, homo sapien
caatatccttcatctagattcgagtyctttcctgatacttaatatttgtc

SEQ ID NO: 114989 - DNA, 50 bp, homo sapien
gatcctcttgagccctggctttctcrcaggtgcaggggcttatgaggatg

SEQ ID NO: 114990 - DNA, 50 bp, homo sapien
aaatacatgtaatgtaaagttgatcrttttaaacaccttacagcgtgcaa

SEQ ID NO: 114991 - DNA, 50 bp, homo sapien
actgcatataactggttatctgaaayctcaaagcagtgccatctctctcc

SEQ ID NO: 114992 - DNA, 50 bp, homo sapien
gattgttttccattcacatgcctaayacaaaggagatgcaaatttctttt

SEQ ID NO: 114993 - DNA, 50 bp, homo sapien
cactagatagaggtgatggttgtgcracattgtgaatctactcaatacca

SEQ ID NO: 114994 - DNA, 50 bp, homo sapien
agcctgcatggtctgaaagtgcaacrgccaaagggagagaggagtaagag

SEQ ID NO: 114995 - DNA, 50 bp, homo sapien
tcagaaagtgacctgctttaaaaaargaaagacggcgatttgctgaaggt

SEQ ID NO: 114996 - DNA, 50 bp, homo sapien
cataaatttaggaaaactcaaggcayggtataaataaagtactataaaaa

SEQ ID NO: 114997 - DNA, 50 bp, homo sapien
acctgccagaggaaaaaggctctagstattattaacagcagttgtactat

SEQ ID NO: 114998 - DNA, 50 bp, homo sapien
aaaagaggagggcagggagaatattktcacacactcattcagtttcatac

SEQ ID NO: 114999 - DNA, 50 bp, homo sapien
accaaccccttcaggacaatacagaygaagagcaatgacagcagacaacc

SEQ ID NO: 115000 - DNA, 50 bp, homo sapien
tggcctctaaggtaagatccaaaccraataacatgtgatgtacaagatcc

SEQ ID NO: 115001 - DNA, 50 bp, homo sapien
cttggaagatctttcctgctctcccrcaaaagctgtattatgtaagaaat

SEQ ID NO: 115002 - DNA, 50 bp, homo sapien
taactaattttatccagagttaatamgtggtggtactggtatgtgaacca

SEQ ID NO: 115003 - DNA, 50 bp, homo sapien
aacttggtttttatctcaattctggycatatcctcttgtcctttatttct

SEQ ID NO: 115004 - DNA, 50 bp, homo sapien
tgatagctttagatggtgatgggacrctttaatcaaagatgccacattga

SEQ ID NO: 115005 - DNA, 50 bp, homo sapien
taaaaataaaagaccaagaacacatragctggaatgattaatatgttaaa

SEQ ID NO: 115006 - DNA, 50 bp, homo sapien
agctgaggagtgttctgaaagcccayagaaatcacacatgaaaacccaac

SEQ ID NO: 115007 - DNA, 50 bp, homo sapien
aaaggacacacagcttccctaagaaytcagctaaaacgcaattgccattt

SEQ ID NO: 115008 - DNA, 50 bp, homo sapien
cacaagtgaattcagagagcattaaygggaaagttctaaacagaacctct

SEQ ID NO: 115009 - DNA, 50 bp, homo sapien
gtgatctaccctaaaacaccaagcartccttcttacagtttgttccctcc

SEQ ID NO: 115010 - DNA, 50 bp, homo sapien
ctgttgattagtatgtctgcaatcartctacaacatagcaataacgctag

SEQ ID NO: 115011 - DNA, 32 bp, homo sapien
tcattatttttcattayaaaacttgttctaat

SEQ ID NO: 115012 - DNA, 50 bp, homo sapien
tgaagcagggctgtggcgtgggtgarctacagtatttgacatctttatac

SEQ ID NO: 115013 - DNA, 50 bp, homo sapien
ccagatcatttgacacattaaatttyagtcttggcttcaacttaagaata

SEQ ID NO: 115014 - DNA, 50 bp, homo sapien
gagcccgaaggcagttccaaaccaargcaaggattaaaacctaactcaac

SEQ ID NO: 115015 - DNA, 50 bp, homo sapien
atacgagggtgctaaaaaagaatgayatcctaagtatgtgtttatatata

SEQ ID NO: 115016 - DNA, 50 bp, homo sapien
tggtgtacctccttctgtggaagaamaagaggataaaaagcacatctttc

SEQ ID NO: 115017 - DNA, 50 bp, homo sapien
ccaataactggagtagccttttaacragtaggcaagatgttgatatcaat

SEQ ID NO: 115018 - DNA, 50 bp, homo sapien
agctataatatttaagctgaagccaraatggtaaaatgaaatttcctatg

SEQ ID NO: 115019 - DNA, 50 bp, homo sapien
tatcaggaagaacaacacatgacgaygacctaaagctaaagacaaaagca

SEQ ID NO: 115020 - DNA, 50 bp, homo sapien
aagacatggagaaatcttaaacacaytctaagtgaaagaagccaatctga

SEQ ID NO: 115021 - DNA, 50 bp, homo sapien
ttgctgggtattatcattttcagtaygatgtaaacaataatgaaagtcat

SEQ ID NO: 115022 - DNA, 50 bp, homo sapien
gagttatttgagaatctgtgtatcayaagccttgagaaattaagaattaa

SEQ ID NO: 115023 - DNA, 50 bp, homo sapien
ctgcatgagccaattccttgaggtasatatctttatatataaatagactg

SEQ ID NO: 115024 - DNA, 50 bp, homo sapien
tgactcacaggctggataatgctgtmaagaagtggtgagagtatacatca

SEQ ID NO: 115025 - DNA, 50 bp, homo sapien
gaagagaggaataatgagacaactarggaaaccagacaagaccatcttag

SEQ ID NO: 115026 - DNA, 50 bp, homo sapien
cccaaaggcctcctggatgcttccaygatgtgaatttagactgggtgtct

SEQ ID NO: 115027 - DNA, 50 bp, homo sapien
aaagacacaacacagatgagaagaasaactgagaggaaatgtaagcccag

SEQ ID NO: 115028 - DNA, 50 bp, homo sapien
ggatctttccgaatttgtttccttargctcttaactactaagtgattctg

SEQ ID NO: 115029 - DNA, 50 bp, homo sapien
atgtgaaagttatgatgatggtaatrataacagccaacatttactaagct

SEQ ID NO: 115030 - DNA, 50 bp, homo sapien
tgtttagcctttgggtgctaagtaaygatagctctaatgagtcttatgct

SEQ ID NO: 115031 - DNA, 50 bp, homo sapien
tactgatgccaggtggtctgaaggayaccacaagaagctaactcaccaaa

SEQ ID NO: 115032 - DNA, 50 bp, homo sapien
ccagccccacgcctgtgatttcagasagaagcttaacagagatctcacca

SEQ ID NO: 115033 - DNA, 50 bp, homo sapien
atggaaactaggtggctttggctgaygattcaagtggctgtttcttgaga

SEQ ID NO: 115034 - DNA, 50 bp, homo sapien
cttattttccttcatccacggacaasctttttaataggatcattgaaatc

SEQ ID NO: 115035 - DNA, 50 bp, homo sapien
aacatgctgccattattattcaaatkagtgattccctctgtcagattttg

SEQ ID NO: 115036 - DNA, 50 bp, homo sapien
ctagaaaggcatatgagtgcagttayacggccaggctgcctctccactta

SEQ ID NO: 115037 - DNA, 50 bp, homo sapien
ctttggggaagaattaatttgattckagtgaaaaagtgtatagagctgct

SEQ ID NO: 115038 - DNA, 50 bp, homo sapien
caagcatgcgactgaggttgagaagraaagcttaaagctacggataaggt

SEQ ID NO: 115039 - DNA, 50 bp, homo sapien
caattcatggtgatcatcttgggcckatgagttaatgcatccgtgcatac

SEQ ID NO: 115040 - DNA, 50 bp, homo sapien
aaactttgtagagctttcatcatcartattaaacctttcacattcaaagg

SEQ ID NO: 115041 - DNA, 50 bp, homo sapien
gccttattatcttctgttttcataakgttcgtgttttcctgactcttact

SEQ ID NO: 115042 - DNA, 50 bp, homo sapien
aaatctgtgtttcctctagttttcayatttcacaatgcagaatctcttga

SEQ ID NO: 115043 - DNA, 50 bp, homo sapien
ctgattagtgaaaatctagtaacaayggatgtctgcttaattcatggaaa

SEQ ID NO: 115044 - DNA, 50 bp, homo sapien
atgaggagttgaggctccccaaatcsacgtaacttggagctcagaggcca

SEQ ID NO: 115045 - DNA, 50 bp, homo sapien
gcgagctgtaacccgtttctctagckctttatttgtgtgatttggccaga

SEQ ID NO: 115046 - DNA, 50 bp, homo sapien
gtgattagtcacacacattcgagcasctataataacagacagctttgact

SEQ ID NO: 115047 - DNA, 50 bp, homo sapien
atttaaaaatctggattcttgatgtyaaatctcttcgactccagatacac

SEQ ID NO: 115048 - DNA, 50 bp, homo sapien
cttttatagaaactacctagcttcayattagcaaacagattggattagtg

SEQ ID NO: 115049 - DNA, 50 bp, homo sapien
tgccaatgtttaaagactgagcttcrcgctaatgacattcagagatggcc

SEQ ID NO: 115050 - DNA, 50 bp, homo sapien
aaaatttcagaagtctacatagccaytgaagggcatactaattttctaga

SEQ ID NO: 115051 - DNA, 50 bp, homo sapien
attctgagttgttcccagaaaaacayactttgggcacatgaataattcaa

SEQ ID NO: 115052 - DNA, 50 bp, homo sapien
taaagagaatgccctaggcacaggakataatagtggtgaaccacagacct

SEQ ID NO: 115053 - DNA, 50 bp, homo sapien
tccacccaatggagcacttatgagaycattaatcttaccatccattggag

SEQ ID NO: 115054 - DNA, 50 bp, homo sapien
ctccctttccttcgctgctctctccrctttgttgttgtcgttgagggtct

SEQ ID NO: 115055 - DNA, 50 bp, homo sapien
gccctcaagtatcggaccctgagtawgtcttcagcacacacattttgagg

SEQ ID NO: 115056 - DNA, 50 bp, homo sapien
tcagttatgtgccgcaacggtacgaygagctttctagttcacagagctat

SEQ ID NO: 115057 - DNA, 50 bp, homo sapien
cacacacagacacattaaaaactacrgaaatgagatcatatactggcatg

SEQ ID NO: 115058 - DNA, 50 bp, homo sapien
ttgtatacattcagctgcttaggaastatctgcaaatgtgacattctgat

SEQ ID NO: 115059 - DNA, 50 bp, homo sapien
ccagaagaaatcaatgccaaggagartctaatgcactgactatgtgcaaa

SEQ ID NO: 115060 - DNA, 50 bp, homo sapien
aatccaggtaaaacaatttcaacacratgatttcaaactatgtatactat

SEQ ID NO: 115061 - DNA, 50 bp, homo sapien
tatctaagatggtgtaaaagtttgayctcaattttctgtgtgtgcatgtg

SEQ ID NO: 115062 - DNA, 50 bp, homo sapien
agctcacatcttaccatttcacaaayttcatcaatagcacatctatctcc

SEQ ID NO: 115063 - DNA, 50 bp, homo sapien
tttaatattttgatatattcagtaaygttggtttgaccatataccctggt

SEQ ID NO: 115064 - DNA, 50 bp, homo sapien
ttttggcccctgttggcagactcaarcatataggaagcaagttttcctgc

SEQ ID NO: 115065 - DNA, 50 bp, homo sapien
ttcctgagcttgaagcatgagaacasgcacctattcaaaaactaagggag

SEQ ID NO: 115066 - DNA, 50 bp, homo sapien
tcatcaaatcctcatgagagtccaaytgcattgccgaagagtatttacat

SEQ ID NO: 115067 - DNA, 50 bp, homo sapien
aattccctcaggctccagcacactayaagatcaaatggcatcatattaaa

SEQ ID NO: 115068 - DNA, 50 bp, homo sapien
aagacagtagattaatagggaactcygactactgttctcataccaggcat

SEQ ID NO: 115069 - DNA, 50 bp, homo sapien
tatttgtatatggggccaatagatcrctatgtaaaggcagttcactaaac

SEQ ID NO: 115070 - DNA, 50 bp, homo sapien
cccgtggctctcaattgcagaaaggwatcgagctaaagagcagcttgggt

SEQ ID NO: 115071 - DNA, 50 bp, homo sapien
taaacaatcctaatttatcgttttcrgaacatctctgtctacaagtattt

SEQ ID NO: 115072 - DNA, 50 bp, homo sapien
aatattatatttgaaattctattccraatcaacttttgaggcactatctt

SEQ ID NO: 115073 - DNA, 50 bp, homo sapien
ttctatctaatgggattcggttccayagtagagccagtgcccatgttgca

SEQ ID NO: 115074 - DNA, 50 bp, homo sapien
aatgaaataaagtatttgaatacgtmaatgagagaaactgatgccacaac

SEQ ID NO: 115075 - DNA, 50 bp, homo sapien
gcctgccccctctagctctctataarccacttactgccattgaagattaa

SEQ ID NO: 115076 - DNA, 50 bp, homo sapien
cattgtttatggattcacttttgcaycttactcaaactattaacatgtta

SEQ ID NO: 115077 - DNA, 50 bp, homo sapien
aatacttagtacagcaatcaataaaygagaggacctgttggaatatgagt

SEQ ID NO: 115078 - DNA, 50 bp, homo sapien
agccagctgtatagctacattgtccrctattttttttggagcctgagtaa

SEQ ID NO: 115079 - DNA, 50 bp, homo sapien
tcaacaacaacacagttgtggacacrgtgaacgaatttctaactgaatat

SEQ ID NO: 115080 - DNA, 50 bp, homo sapien
ttctattggaggtcagtgagatgcgractaaaagggctcactgagttttg

SEQ ID NO: 115081 - DNA, 50 bp, homo sapien
attatagatttcgtatggctggaaastaacttgaacaataagctgaccca

SEQ ID NO: 115082 - DNA, 50 bp, homo sapien
gttcatactcagaggataaattattkttttcattagctttatgtaaccta

SEQ ID NO: 115083 - DNA, 50 bp, homo sapien
gcagtatgagatatttggatcttcartattgtactttgtccctctatatt

SEQ ID NO: 115084 - DNA, 50 bp, homo sapien
taggttgttagttgatagtgttgccraagtctcgtaaattcttattagtt

SEQ ID NO: 115085 - DNA, 50 bp, homo sapien
caaggacaggtattgttaagtacaastgtagtccaccaatagaggagcag

SEQ ID NO: 115086 - DNA, 50 bp, homo sapien
atagatgaatagttgccaacaaatartagtcttttcagcatccaagtcct

SEQ ID NO: 115087 - DNA, 50 bp, homo sapien
ttcctacaccctttttgttgcataaygatctcaggaaataactaacagga

SEQ ID NO: 115088 - DNA, 50 bp, homo sapien
gaagaactctaatattcatctcttaygaggaaatcatcattgaggctctt

SEQ ID NO: 115089 - DNA, 50 bp, homo sapien
aaaaataagacatcttttatgggcgmattcttagtcctagaagtcttggg

SEQ ID NO: 115090 - DNA, 50 bp, homo sapien
aatcactactgtgacacagattatayacgcactttgttgcttattgttag

SEQ ID NO: 115091 - DNA, 50 bp, homo sapien
tgtttctgagcctcatctcttgaatkaataagtttcatcatgcccacttc

SEQ ID NO: 115092 - DNA, 50 bp, homo sapien
tgactgtgaactcaatacacttgatsaaattgctgacatagttacctcag

SEQ ID NO: 115093 - DNA, 50 bp, homo sapien
aaaatgaacataactccttgaaaaamaatagcaattcacaccgtctatca

SEQ ID NO: 115094 - DNA, 50 bp, homo sapien
tctccaagttgataacaatggaagcragtttaatataaaacaattcccta

SEQ ID NO: 115095 - DNA, 50 bp, homo sapien
gtttcaatttttttataattaagccsatctcttctggattaagatatagc

SEQ ID NO: 115096 - DNA, 50 bp, homo sapien
ggaaagatgcatgtctaattcaacaytataaactccacaacctttagcat

SEQ ID NO: 115097 - DNA, 50 bp, homo sapien
aaacaataacttatgacactctccawgcagggaaaaaagtcttcatgcct

SEQ ID NO: 115098 - DNA, 50 bp, homo sapien
aaatagaaatgtttaatgtgttggasaaatggttctgtctgaagaaaagt

SEQ ID NO: 115099 - DNA, 50 bp, homo sapien
cttggataaacagaactctgggaaastgtgcatgaacccagcctcactat

SEQ ID NO: 115100 - DNA, 50 bp, homo sapien
tcagaactcctggcatgatgacgtargatttaaaatgctatttggggcag

SEQ ID NO: 115101 - DNA, 50 bp, homo sapien
tttgggttttgattgcatttgttcayagaaagttttgacaacccgaagct

SEQ ID NO: 115102 - DNA, 50 bp, homo sapien
ccacaatgctggactgagaaaccaasggatgaactggaagcttcgggttg

SEQ ID NO: 115103 - DNA, 50 bp, homo sapien
tgatcaaaaagaagagtgatcattaygcagattatgcaactttgactcaa

SEQ ID NO: 115104 - DNA, 50 bp, homo sapien
tttaacttaataatcagaagtctggmatacaagaataggcagtcaatgaa

SEQ ID NO: 115105 - DNA, 50 bp, homo sapien
taaattacttctttcagggctttaayagccaaaaatatctcattaattca

SEQ ID NO: 115106 - DNA, 50 bp, homo sapien
tgaatttaacttacttgaagggtaaygaaagctctgctggcaagagaaga

SEQ ID NO: 115107 - DNA, 50 bp, homo sapien
tgaatgattattctaaatgacatgasagtggttatttttataaggaagga

SEQ ID NO: 115108 - DNA, 50 bp, homo sapien
ttcctggtcccttcctcttgccttcmtctttcattgtaacatgaattgtg

SEQ ID NO: 115109 - DNA, 50 bp, homo sapien
atcagagagaggctagtaactttcartctcaccaaaacaatgaacagtgt

SEQ ID NO: 115110 - DNA, 50 bp, homo sapien
caactatacataccaaagagtatccygacaggcaacatttatcaggtcat

SEQ ID NO: 115111 - DNA, 50 bp, homo sapien
agagagagagagagaaatcttcaacrgaatattacattactaaacataat

SEQ ID NO: 115112 - DNA, 50 bp, homo sapien
cctcctcctttgtttctcattaatayaacaatggaaaaagctgctccctt

SEQ ID NO: 115113 - DNA, 50 bp, homo sapien
atttctagatgaccaactgtaggacratagaaaagaaggaaattacctgg

SEQ ID NO: 115114 - DNA, 50 bp, homo sapien
aaatgaggcagtaaatccatctttakcatttctaccttcctcattttaaa

SEQ ID NO: 115115 - DNA, 50 bp, homo sapien
tattgttggaagtagcacttctgtaytaacacaaaataagtttccctgct

SEQ ID NO: 115116 - DNA, 50 bp, homo sapien
ccagtcttttaatacagggaccttarctcttagcagctttcctttcctgc

SEQ ID NO: 115117 - DNA, 50 bp, homo sapien
agtgtatctttttaaacgagcattartaaaatcccatagggcacaaaaag

SEQ ID NO: 115118 - DNA, 50 bp, homo sapien
agaggacttgacattcacacaaggargaaattatttgtaatacctagtac

SEQ ID NO: 115119 - DNA, 50 bp, homo sapien
gctcaaaaataaatagtatgtttaaygtggaaaggatatcattaactcca

SEQ ID NO: 115120 - DNA, 50 bp, homo sapien
ggaactgaagataaaaatctgagaaytaaggaacaactcagggacaatgg

SEQ ID NO: 115121 - DNA, 50 bp, homo sapien
acatcagtatcataccactcaaagarcaaacggctgaaaagcaatatgac

SEQ ID NO: 115122 - DNA, 50 bp, homo sapien
cagttgtgtatgttaagaggcagtaygttcagaagtcttgcctactgggt

SEQ ID NO: 115123 - DNA, 50 bp, homo sapien
gatgtctggaggaagtgacaagagaygaagttggacaggatgttggatcc

SEQ ID NO: 115124 - DNA, 50 bp, homo sapien
gttacacttttactcacacctattcsaaacgcaatgtaacttgcagagtt

SEQ ID NO: 115125 - DNA, 50 bp, homo sapien
gaaattgcactgacttggctgaatcmagtattatgtttagtaatgtaata

SEQ ID NO: 115126 - DNA, 50 bp, homo sapien
agtgtattctctgattagtaaaataygtgcattttcgagtaaatgtggta

SEQ ID NO: 115127 - DNA, 50 bp, homo sapien
atactctccagattatcagctccgaygaatgtaagagacatagtgttagg

SEQ ID NO: 115128 - DNA, 50 bp, homo sapien
tgaggcagagagctaatttctatccrtctttgcttcaaggtgtcaccagt

SEQ ID NO: 115129 - DNA, 50 bp, homo sapien
attcgctcactctcacttcatttaaygcgttactcttcagtcacagtggc

SEQ ID NO: 115130 - DNA, 50 bp, homo sapien
attaccattgcttttctgttctaaakaaattaaacattagacagatagaa

SEQ ID NO: 115131 - DNA, 50 bp, homo sapien
tatgtttcagaatgtaggcatttttrtacttttgaaaagtaaaacagcat

SEQ ID NO: 115132 - DNA, 50 bp, homo sapien
atagcatttgctgcaactcttgtgaygtgataaaatattttgtgtcttca

SEQ ID NO: 115133 - DNA, 50 bp, homo sapien
gacaaaagagaaggtattacaagtcrtgccacagaaataaaaaggataag

SEQ ID NO: 115134 - DNA, 50 bp, homo sapien
actgtatggtatttatcatattataygtaggagcaatcacagaaataaca

SEQ ID NO: 115135 - DNA, 50 bp, homo sapien
aataaaatttaccgagcacctatcasgttaggcacaatactgggtgctgc

SEQ ID NO: 115136 - DNA, 50 bp, homo sapien
aagctgaggacggggtgagatattgrtgtattagtagacctttcttatcc

SEQ ID NO: 115137 - DNA, 50 bp, homo sapien
atttctggagcaaagtgcgtatagcratgagggcccttccagcaaaacat

SEQ ID NO: 115138 - DNA, 50 bp, homo sapien
aagccatgcttcatatcctggtagtraaatgacaatgacagagccactga

SEQ ID NO: 115139 - DNA, 50 bp, homo sapien
aagagagaggacaggatgaagtgaaktgcaaaactaaagtacatggtgta

SEQ ID NO: 115140 - DNA, 50 bp, homo sapien
gtagagtgtgcaggtgacaactcaaygactttggagcctacaaatggctc

SEQ ID NO: 115141 - DNA, 50 bp, homo sapien
cgcccattcaaaagcaattgggttascaagaagaaacaggtcaacaatag

SEQ ID NO: 115142 - DNA, 50 bp, homo sapien
ttgttttgctggatgttacttgaccraagattgcataaatgagctgtcac

SEQ ID NO: 115143 - DNA, 50 bp, homo sapien
gaaaaagtaactcactgattactgargaagagaataggagtttatttttc

SEQ ID NO: 115144 - DNA, 50 bp, homo sapien
ttggtctgtaaaattaaatgacttasatctggatttgcttaccttattta

SEQ ID NO: 115145 - DNA, 50 bp, homo sapien
caagttcctctggtaacaaagttcartactgcagaggaaatgacaactgt

SEQ ID NO: 115146 - DNA, 50 bp, homo sapien
taagagcacacccttatatggtttcyaaagttacaatgaggcttttggat

SEQ ID NO: 115147 - DNA, 50 bp, homo sapien
catgaagaatacttaatgttgtaaargctacatggatggttttgacatca

SEQ ID NO: 115148 - DNA, 50 bp, homo sapien
tggacatcgattaagaaggaaacgamgtagactaggatgacacccgagtt

SEQ ID NO: 115149 - DNA, 50 bp, homo sapien
tgttgattatcatattgatgatagcsaaatcacatggtcactcctcagtt

SEQ ID NO: 115150 - DNA, 50 bp, homo sapien
ggatcaccaggaagaaataagtccarattccccatcagttcagtggtatg

SEQ ID NO: 115151 - DNA, 50 bp, homo sapien
ggtatatttgactttaagacagataragcttcttaactagattcacaaaa

SEQ ID NO: 115152 - DNA, 50 bp, homo sapien
ccttgtacacggtatagctcaatacrtcagtgcaagctgaaatggactgc

SEQ ID NO: 115153 - DNA, 50 bp, homo sapien
tgtaaattagctcaagagagatcacyggatggagaggatacagttcttct

SEQ ID NO: 115154 - DNA, 50 bp, homo sapien
attccagtgggcagagctttgagcartacacatgctcatcaacttgtatg

SEQ ID NO: 115155 - DNA, 50 bp, homo sapien
gtaagcttcaactgttttagtactaygtgcatgggtttttcttaatttgt

SEQ ID NO: 115156 - DNA, 50 bp, homo sapien
gcgacgtggatacctcgtgccaatcyatcatgtcaggcataaaattagca

SEQ ID NO: 115157 - DNA, 50 bp, homo sapien
taatacaattattacatctactggcygtaagtcgggcttgatttaaaggt

SEQ ID NO: 115158 - DNA, 50 bp, homo sapien
cctggcaatggcaaggaagatcatargtgtggaacagcagatggcaactg

SEQ ID NO: 115159 - DNA, 50 bp, homo sapien
tagttccgaggctctatcactaacartcgggacactcacactatattaat

SEQ ID NO: 115160 - DNA, 50 bp, homo sapien
actatccgtatgaattcctggatatyacaagtgcacttttctgaagttac

SEQ ID NO: 115161 - DNA, 50 bp, homo sapien
atgtgtcatgagttttatactcttgyggttttgtgaatctagttaagaag

SEQ ID NO: 115162 - DNA, 50 bp, homo sapien
ccctttagtccagccatgaggctaaratgaatggcccctcataaattgct

SEQ ID NO: 115163 - DNA, 50 bp, homo sapien
tcattcctataatacacgattaataygacactgcacaaaaagaatactta

SEQ ID NO: 115164 - DNA, 50 bp, homo sapien
caattcactccacattctgccatcakagtcatttctccaagacacagatc

SEQ ID NO: 115165 - DNA, 50 bp, homo sapien
tcttactgagattggaattgcactartaatgactttttaaaaacagagat

SEQ ID NO: 115166 - DNA, 50 bp, homo sapien
aaccaaggctgttcagttggacacaygaatttttaatgcaaactttaaag

SEQ ID NO: 115167 - DNA, 50 bp, homo sapien
agctcaatgaatagcattggagttaygtcttcatcaactggaattttcaa

SEQ ID NO: 115168 - DNA, 50 bp, homo sapien
ctatgaaaatattccaagatgaaaaytgtttgtgcatttaagcctcctcc

SEQ ID NO: 115169 - DNA, 50 bp, homo sapien
aagcaagcagtgagtgtctttgaaayttggtactcctgggttttgggtca

SEQ ID NO: 115170 - DNA, 50 bp, homo sapien
tcgtacgagtaaaataatgtaaaacrtctccataatttttgaatatcaat

SEQ ID NO: 115171 - DNA, 50 bp, homo sapien
ttttcctcaaaaagtattcttttcartatgtcagtcttgtgttccagtta

SEQ ID NO: 115172 - DNA, 50 bp, homo sapien
agcaatacaaaggctcaatgaggacyggtttattaatagctcagtgaggg

SEQ ID NO: 115173 - DNA, 50 bp, homo sapien
taaaaacctaacaagatttaggacartacaggcactttgaaaattacaaa

SEQ ID NO: 115174 - DNA, 50 bp, homo sapien
tgaagggatggtctgtggttcatgamatattgaaatcattatctggagac

SEQ ID NO: 115175 - DNA, 50 bp, homo sapien
tcttattttagccaagatctaatatraaaaacgtgtggccaatgtgaaag

SEQ ID NO: 115176 - DNA, 50 bp, homo sapien
acttagtgcaataataaaaatgtcamgctctgctatacacaagcctaccg

SEQ ID NO: 115177 - DNA, 50 bp, homo sapien
gtttcctaggtatagaacatatcatyactgaagagagatagtttgacttc

SEQ ID NO: 115178 - DNA, 50 bp, homo sapien
taatctttctagatcaaaatccagamtaccaaagacagccaaaagaaaga

SEQ ID NO: 115179 - DNA, 50 bp, homo sapien
gcataatgctctttagattcatctayggtattgcctgcgttgatagttta

SEQ ID NO: 115180 - DNA, 50 bp, homo sapien
tttagtctttcccataaatgccacayggttcttttggcagaattagctcc

SEQ ID NO: 115181 - DNA, 50 bp, homo sapien
atttgtggacacgtggacttcttaaygcatatctctacaataaatcagac

SEQ ID NO: 115182 - DNA, 50 bp, homo sapien
tactatcccaccttcttctactttaycactatttcagtaccaatatccca

SEQ ID NO: 115183 - DNA, 50 bp, homo sapien
atgtttcttcgcttatattatcatcsgagccataactggaatttgccacc

SEQ ID NO: 115184 - DNA, 50 bp, homo sapien
ggccattatacttaagtatcataacyatattattgagttaagtaatacct

SEQ ID NO: 115185 - DNA, 50 bp, homo sapien
cttaccatagttgattagcaatgtaycaatgaggaatttaatatagtcag

SEQ ID NO: 115186 - DNA, 50 bp, homo sapien
ttaatgaattaaattgacatggtgaracttaagttctcttagaatgttcc

SEQ ID NO: 115187 - DNA, 50 bp, homo sapien
aatgttaattactgttagttcaactyactacttttcatgatatagaggtg

SEQ ID NO: 115188 - DNA, 50 bp, homo sapien
caattgtaacacctgcccattaacaytaactgaaaaaagggatcttatca

SEQ ID NO: 115189 - DNA, 50 bp, homo sapien
aaatccttatttggataagcattacyagagtatggtagagggagaagagg

SEQ ID NO: 115190 - DNA, 50 bp, homo sapien
ttgtaggaatctctgagaagtatgawctgtatttttttaaacttctctag

SEQ ID NO: 115191 - DNA, 50 bp, homo sapien
tcagattgctttccacttagctgaawccaccatatagagaaaaggaagct

SEQ ID NO: 115192 - DNA, 50 bp, homo sapien
caaggtctggcaatgcaagttgggawtacgtacaaatgtcctcatctgct

SEQ ID NO: 115193 - DNA, 50 bp, homo sapien
tgaaccctttccttccaaatatgaamtccattaaacaaagcagggactcc

SEQ ID NO: 115194 - DNA, 50 bp, homo sapien
ggacaaccgctattgttttgaacgcycgcttttccttgagaaagggattt

SEQ ID NO: 115195 - DNA, 50 bp, homo sapien
ggtaatacagacataaccaatatcaygctacagaaacaaccaggatatgg

SEQ ID NO: 115196 - DNA, 50 bp, homo sapien
caagcattagacatgaaacagaataygtaacacgtgtgggaatgtggtac

SEQ ID NO: 115197 - DNA, 50 bp, homo sapien
gcccagattttacttagcaattttargaacctggctttccatatgagtga

SEQ ID NO: 115198 - DNA, 50 bp, homo sapien
aatgtattgcaccaggtactatgctrtatcttatatgatggttctttatg

SEQ ID NO: 115199 - DNA, 50 bp, homo sapien
tctctctctctgacccctgtttccawctttctatctccttctctgactct

SEQ ID NO: 115200 - DNA, 50 bp, homo sapien
actgcaagtactgctgcttcttatayaatttctgtttggggaatatccaa

SEQ ID NO: 115201 - DNA, 50 bp, homo sapien
gtgaaatgtctacagttattttgtaraagtcttgaaataatattcccttc

SEQ ID NO: 115202 - DNA, 50 bp, homo sapien
tagttttattccatgcagttccaacygggtactgttcatatacattcatg

SEQ ID NO: 115203 - DNA, 50 bp, homo sapien
caatagaaatctgagtgagtaggtaraatagctacataaataaaatgcac

SEQ ID NO: 115204 - DNA, 50 bp, homo sapien
aagagcagttgaaatatggcattgaragctaggacccctggaaagactaa

SEQ ID NO: 115205 - DNA, 50 bp, homo sapien
gaagaaataaacctaaatcaaatatrataggtagcttctgtgttttattt

SEQ ID NO: 115206 - DNA, 50 bp, homo sapien
tgttcttgaggaattaacttttatgwaaaggacagcctagtctctgaaag

SEQ ID NO: 115207 - DNA, 50 bp, homo sapien
agatattatctacaaaggaagaagcrattgacaataaataacaacaaatc

SEQ ID NO: 115208 - DNA, 50 bp, homo sapien
aattcacttccttagtcatttcaccyagtactgtggttttaaatatcatt

SEQ ID NO: 115209 - DNA, 50 bp, homo sapien
atagtagaaggtaagaattgcaataygtcctttattccccaatttgtgga

SEQ ID NO: 115210 - DNA, 50 bp, homo sapien
agaatctacactgtcccacttttccrctggtagagtttccaagatatggt

SEQ ID NO: 115211 - DNA, 50 bp, homo sapien
taaatgaagtagagagcatggaattraagaacatgataaagtttaaaatt

SEQ ID NO: 115212 - DNA, 50 bp, homo sapien
ccactgactgcatgatggtatataartctcccatatatttgatgcaactc

SEQ ID NO: 115213 - DNA, 50 bp, homo sapien
aatacacaaagtatctccatgttacrcttttaacttttaagttcagggtt

SEQ ID NO: 115214 - DNA, 50 bp, homo sapien
acctataaagtgtgtgaacttcaccractcattcagtctcttagtgcctt

SEQ ID NO: 115215 - DNA, 50 bp, homo sapien
atagacatgggaaatgacttttaacrcaaagatgaagctatgctgtgtaa

SEQ ID NO: 115216 - DNA, 50 bp, homo sapien
aggcaatctctttagtacaaggcacygaactcaaatataaaccagagggg

SEQ ID NO: 115217 - DNA, 50 bp, homo sapien
tttgatttagatgtaaggttctaaaraagtgtcacttgtcccacccattt

SEQ ID NO: 115218 - DNA, 50 bp, homo sapien
agaaaagcctaggcagtctcttttaraatatgctaaataaatctaagata

SEQ ID NO: 115219 - DNA, 50 bp, homo sapien
gcccagcatagaattcaggagtcccratgaacagctgaaacaaagccctc

SEQ ID NO: 115220 - DNA, 50 bp, homo sapien
caagtccagtgaacaaaactggtacratagttcagacagggatagtgcca

SEQ ID NO: 115221 - DNA, 50 bp, homo sapien
tggatatgatgtatacgagtatgccrcccaggttatgctgcagctgtcac

SEQ ID NO: 115222 - DNA, 50 bp, homo sapien
gcttttttgattgatgtatttcaacrgattgaacacccagttacccttag

SEQ ID NO: 115223 - DNA, 50 bp, homo sapien
tctcattgtcctttctcttggatacmgattgctaagataaacagacactg

SEQ ID NO: 115224 - DNA, 50 bp, homo sapien
ttttaaaaaatgtaatatgtctttcrctacccttctccttagttcccatt

SEQ ID NO: 115225 - DNA, 50 bp, homo sapien
aattgtaggtaggatgtccattactmaaacaaagcagaacaaaacaacaa

SEQ ID NO: 115226 - DNA, 50 bp, homo sapien
agtcaacagttacatccacttggggmaaagttaataacagagatgtaatt

SEQ ID NO: 115227 - DNA, 50 bp, homo sapien
caaccagatttgaatggttttgactrgccatgactgacttaggctttgac

SEQ ID NO: 115228 - DNA, 50 bp, homo sapien
actggtttagagagattttgaacagmactgacctgtttagccacaactgg

SEQ ID NO: 115229 - DNA, 50 bp, homo sapien
gggaatccaggctctttctatgaccrctgctgatactgtcacactgtgta

SEQ ID NO: 115230 - DNA, 50 bp, homo sapien
atcctggccttgcaagaatttagcarctacgtgacttactttgttttagt

SEQ ID NO: 115231 - DNA, 50 bp, homo sapien
gtactgttatcctaaagcaaggaaargtaacagaaatattgtcatcattg

SEQ ID NO: 115232 - DNA, 50 bp, homo sapien
aaaggcaccaaaataaaattcatgaygtaacggaaatgatatgaatataa

SEQ ID NO: 115233 - DNA, 50 bp, homo sapien
attggtttttcatgtatttatagtcytgcaattatcagcagaattataga

SEQ ID NO: 115234 - DNA, 50 bp, homo sapien
atgtacttggcttagcattttagcckatcaagatggtttagaaattctat

SEQ ID NO: 115235 - DNA, 50 bp, homo sapien
ctgctctttagtcttagaataaatgragccttttcctagtaacaaaaatg

SEQ ID NO: 115236 - DNA, 50 bp, homo sapien
ctattctgaacagagaggcactacaytgaccatatttgggaggcctcaga

SEQ ID NO: 115237 - DNA, 50 bp, homo sapien
gacatctccaacaactaggagatcayctacttcaattccagactcctatt

SEQ ID NO: 115238 - DNA, 50 bp, homo sapien
ctgcattgctcaaatatgtacaactrggaagtatgagggaaataatctct

SEQ ID NO: 115239 - DNA, 50 bp, homo sapien
tgcacgtagaatcacctagggaacaytgtaaattttcagtgctcaggcca

SEQ ID NO: 115240 - DNA, 50 bp, homo sapien
gatggttgaatgatgcttaatcacaracctggatataagaggaatggcct

SEQ ID NO: 115241 - DNA, 50 bp, homo sapien
tatttagctttaaatgttataattayatctctgcttcttgttcaatcatc

SEQ ID NO: 115242 - DNA, 50 bp, homo sapien
tgagaaattggaaaggtttacataastacatgcagggtgacctgaagtgg

SEQ ID NO: 115243 - DNA, 50 bp, homo sapien
gacaaaaaggaagagaaacattagcrcgtagttttttcatggaattcacc

SEQ ID NO: 115244 - DNA, 50 bp, homo sapien
ctacattatcagataaatgtcaacayctgtaaatattgctcagaatcacc

SEQ ID NO: 115245 - DNA, 50 bp, homo sapien
acctctatacatgcacctaaacctayggctatgtcaatgcccacagctac

SEQ ID NO: 115246 - DNA, 50 bp, homo sapien
ataaaatggtgatgagcttataaaastaatgtgaattctaaaatatgagc

SEQ ID NO: 115247 - DNA, 50 bp, homo sapien
tttctgaaaatacagcattaggtaayacagcagacaacaaaaacaatata

SEQ ID NO: 115248 - DNA, 50 bp, homo sapien
aaaatattcttttgattttctttcarataacataataataagcaatgtgc

SEQ ID NO: 115249 - DNA, 50 bp, homo sapien
tcattctggtctttatttttggacaygtagcatgttttaacaaatcagtt

SEQ ID NO: 115250 - DNA, 50 bp, homo sapien
tttgactacccattttgctgcctccrattcacaaatacctattctttaat

SEQ ID NO: 115251 - DNA, 50 bp, homo sapien
gctgctaagggcttgttcaaagacarggtgtgactgaacttcagctgcag

SEQ ID NO: 115252 - DNA, 50 bp, homo sapien
catgctgcacagattggaaagtctcycttcaaggatctgttcacttttaa

SEQ ID NO: 115253 - DNA, 50 bp, homo sapien
tgtcttttaaatttgtagttctatayggaaagaattgatgtccactctat

SEQ ID NO: 115254 - DNA, 50 bp, homo sapien
ggtggctgtggaggcagtgagagtargtttcctgacatctgggttatagc

SEQ ID NO: 115255 - DNA, 50 bp, homo sapien
tagttgattgttgtggagttgaagawagggagtttcccacccatgagctt

SEQ ID NO: 115256 - DNA, 50 bp, homo sapien
tacaatgcaattacagttaatgaatyaccgttaataggtgttctgggcaa

SEQ ID NO: 115257 - DNA, 50 bp, homo sapien
tgccgtgctagttgtgtgggcactamtccctttagatctttagaggaggc

SEQ ID NO: 115258 - DNA, 50 bp, homo sapien
attcagaaacaattactcattcctaycatgcattttactaaaccctgccg

SEQ ID NO: 115259 - DNA, 50 bp, homo sapien
ggaaaattggagcttttagggcgaarcatctttagttgaacaggttgtga

SEQ ID NO: 115260 - DNA, 50 bp, homo sapien
acaattgactttcccaagttcatagktagtaacaaagaatgagcaataat

SEQ ID NO: 115261 - DNA, 50 bp, homo sapien
tgattcttcactatcttgttagctcrctggctctttaatgctttaaagat

SEQ ID NO: 115262 - DNA, 50 bp, homo sapien
atctccaaagctccagaaaagactgrtgagtactgtgatttagttatttc

SEQ ID NO: 115263 - DNA, 50 bp, homo sapien
tctttttctcctccttccagttaccrctcctccaaggcagacagttgcag

SEQ ID NO: 115264 - DNA, 50 bp, homo sapien
tattacctaaaatagaaaatgggtcraacataggaacaacccaaagtctt

SEQ ID NO: 115265 - DNA, 50 bp, homo sapien
gttttcatgttacattagaatgtgaratgggcttcataaagtcatgtaga

SEQ ID NO: 115266 - DNA, 50 bp, homo sapien
gtattaattgcctcccttcaggtccraacagagaaactaggcaaaatgat

SEQ ID NO: 115267 - DNA, 50 bp, homo sapien
taccacaacctaataacatcactcarattaattccattctccccatacca

SEQ ID NO: 115268 - DNA, 50 bp, homo sapien
ggtgtttaaaatggcattgtatagaratagctgaaggcttttgagcttct

SEQ ID NO: 115269 - DNA, 50 bp, homo sapien
ttctcccttatatactgtactatcaycactacttaattagtttttgtatt

SEQ ID NO: 115270 - DNA, 50 bp, homo sapien
agagacctgcgtgtttcagtggactrtataatgtagttgatggaggagag

SEQ ID NO: 115271 - DNA, 50 bp, homo sapien
aataaacattccccaggttgctgaaygcttttagttaatttctagagtcc

SEQ ID NO: 115272 - DNA, 50 bp, homo sapien
gtgcttaaagcagcaacagcttaaawgagggacacttcagacaaggcccc

SEQ ID NO: 115273 - DNA, 50 bp, homo sapien
attattcaatctcaagaatctatgargtagcttgcaaagaaaacggtttt

SEQ ID NO: 115274 - DNA, 50 bp, homo sapien
agaatcaggagtccgtaagggaatasagatagttcaggtcttctgattaa

SEQ ID NO: 115275 - DNA, 50 bp, homo sapien
tctaatttctctagtccacgtatacygcttaagtgtgggttaccctgaaa

SEQ ID NO: 115276 - DNA, 50 bp, homo sapien
ttacttgtactaccttttcagaaacyggatacctgagtgtgtgagggtaa

SEQ ID NO: 115277 - DNA, 50 bp, homo sapien
cagggaattattttcataatcttcartctttctgtctccccagacacact

SEQ ID NO: 115278 - DNA, 50 bp, homo sapien
aaagaaactacttttcagtcctcctracgaatatgattatatgtaagctt

SEQ ID NO: 115279 - DNA, 50 bp, homo sapien
tgtgtggtgagtataaatgtctgtayaataccttcccaagcgaagtggtg

SEQ ID NO: 115280 - DNA, 50 bp, homo sapien
aaacagtaggttaggaaatgctgatrataaagtgatctgaagtcatttgt

SEQ ID NO: 115281 - DNA, 50 bp, homo sapien
ttgtgtgcaattttgtgcatatgtayattctcaagggagctctactcagc

SEQ ID NO: 115282 - DNA, 50 bp, homo sapien
tttgcaaatataaagttgatattagycctggaaaccctaaatgatgggcc

SEQ ID NO: 115283 - DNA, 50 bp, homo sapien
gggacctatggcattttaccagagasattgtacacagaggaaatagaaat

SEQ ID NO: 115284 - DNA, 50 bp, homo sapien
gcttgagaagggccaggctaatggaycagaaggagtagtaccatgagaaa

SEQ ID NO: 115285 - DNA, 50 bp, homo sapien
tgaaaggccctgtcacatcacagagraaccggaaatccagtgcagcttga

SEQ ID NO: 115286 - DNA, 50 bp, homo sapien
ccctctgatttcccacaatcaggacrgtaatttggtaggttaataagtta

SEQ ID NO: 115287 - DNA, 50 bp, homo sapien
tgacctctcagacaatgaccactgarattaagatattcattctccttatc

SEQ ID NO: 115288 - DNA, 50 bp, homo sapien
aattaattgtttatttcaaattaacyggaggagtagacttggaatgttcc

SEQ ID NO: 115289 - DNA, 50 bp, homo sapien
tgattcatccatagacggattttaarcccataaggcggctggcacattag

SEQ ID NO: 115290 - DNA, 50 bp, homo sapien
cttcacccaggtcttctttgactgcraatcttgccatgttcacacgtgct

SEQ ID NO: 115291 - DNA, 50 bp, homo sapien
ttgtttctaaattgtgtgctatccamcttatcacagtccttactattccc

SEQ ID NO: 115292 - DNA, 50 bp, homo sapien
atgggcaagattaactgatagacacrgagcatttatttgttcaaatgttg

SEQ ID NO: 115293 - DNA, 50 bp, homo sapien
tatgcctgtttttttatttgtagaaytgaggtaataatatctattgtcta

SEQ ID NO: 115294 - DNA, 50 bp, homo sapien
tacagcaagggggttacagttcacartattgtttagtggaaatttttaaa

SEQ ID NO: 115295 - DNA, 50 bp, homo sapien
agcactgttcctttaatgcttaccamtgagtcatatttttttacacactc

SEQ ID NO: 115296 - DNA, 50 bp, homo sapien
cacttaagatcttcactctttaaaawtttccactaaacaatattgtgaac

SEQ ID NO: 115297 - DNA, 50 bp, homo sapien
caacttgtctctcaatgttctctagkcataccctaaatcttttagggctt

SEQ ID NO: 115298 - DNA, 50 bp, homo sapien
atctcgttttaaatgtgacaactccrgaaactaaacagtagctttgccag

SEQ ID NO: 115299 - DNA, 50 bp, homo sapien
aactagaccttacactttgcattggracattacatccaaatcgggaagaa

SEQ ID NO: 115300 - DNA, 50 bp, homo sapien
tgcttgccacttcacatagtatcaasaaaacgaatgtattacccccaaat

SEQ ID NO: 115301 - DNA, 50 bp, homo sapien
ccttctgctccaggtactcattcagmactgcattagaaataggattctgc

SEQ ID NO: 115302 - DNA, 50 bp, homo sapien
agtacaagatgcttcaggcattaatygaaagtttgaaagtgttggagcaa

SEQ ID NO: 115303 - DNA, 50 bp, homo sapien
attgtgagttttattgtgaagtaaaytgaattagcagaagaagcaaaaag

SEQ ID NO: 115304 - DNA, 50 bp, homo sapien
agaatcaagagcaatgctttggtcaygtcaaatgtgagatgtctgtcaga

SEQ ID NO: 115305 - DNA, 50 bp, homo sapien
ttccagtaactgaccacaatgttaartatattcgataggccaaatgtgtt

SEQ ID NO: 115306 - DNA, 50 bp, homo sapien
acttacatacttttatactggcttargaggaatttcagaaggatattctg

SEQ ID NO: 115307 - DNA, 50 bp, homo sapien
caccaaggtaggactgcacttgttaygggaacatttgtgtgtgtgcattc

SEQ ID NO: 115308 - DNA, 50 bp, homo sapien
tggtctacactatgagtaaaccacayggtgagaagttagagagttaaagg

SEQ ID NO: 115309 - DNA, 50 bp, homo sapien
tgtagtttagcttgcatctttgttgrtctaccaatctccatccaattgta

SEQ ID NO: 115310 - DNA, 50 bp, homo sapien
ttgatggggctatactttgaaatacrgaaaatcagagaagaagcaaagtt

SEQ ID NO: 115311 - DNA, 50 bp, homo sapien
agatagatgatttgagactgttttawatatctatcccattaaaacaaagg

SEQ ID NO: 115312 - DNA, 50 bp, homo sapien
aaaagaaggattggagagttcccttmaacgtcaggccttacagcacacag

SEQ ID NO: 115313 - DNA, 50 bp, homo sapien
actcttggaggtaatggatatgatgkttatcttgattttggtgatagttc

SEQ ID NO: 115314 - DNA, 50 bp, homo sapien
tatgttattgaacaatattgaagaasactgcaagaaaaactcaacaaaag

SEQ ID NO: 115315 - DNA, 50 bp, homo sapien
gacaggtgcatgggggtccataatayactgttctctttacttatatatgt

SEQ ID NO: 115316 - DNA, 50 bp, homo sapien
gtttatcttctttttcgtaaagctayaccatccaatattacatactatga

SEQ ID NO: 115317 - DNA, 50 bp, homo sapien
ttaattgagagtgaattcaaggttayactccctgaatgtatctaaagtac

SEQ ID NO: 115318 - DNA, 50 bp, homo sapien
aaggctgagcccagtcatggatatayactcagatacctgtgagttgggtg

SEQ ID NO: 115319 - DNA, 50 bp, homo sapien
ttgaaccaagtttgaaaacgattgtyaaagaaagaggtattactgtaatt

SEQ ID NO: 115320 - DNA, 50 bp, homo sapien
ggatatgcttcatttggctaacatcraaaattctaataacagatttgccc

SEQ ID NO: 115321 - DNA, 50 bp, homo sapien
ttgacttacttttgatactgaaaaaygttaactgttctctaagtggttga

SEQ ID NO: 115322 - DNA, 50 bp, homo sapien
acagaaataatctcctcatataacartattctatgctttcaacagctttt

SEQ ID NO: 115323 - DNA, 50 bp, homo sapien
cagtgctatgctggtaaatgtctaasaatcagatcccctgagaggaagga

SEQ ID NO: 115324 - DNA, 50 bp, homo sapien
agctgtagtcccaccatatgcaccartacttttaacggagcctgcctagt

SEQ ID NO: 115325 - DNA, 50 bp, homo sapien
ccttacttcatcataaatatctcackctttcctattacccttccttgagt

SEQ ID NO: 115326 - DNA, 50 bp, homo sapien
ccagagacatacacatgacagtccarataaaaaatactctaaagtcatgg

SEQ ID NO: 115327 - DNA, 50 bp, homo sapien
taccctgctcatatctccttagttcyacctttacattctgaagcttgctt

SEQ ID NO: 115328 - DNA, 50 bp, homo sapien
aatctatcatctgaatgagtattgayataaagcataggtttataggttta

SEQ ID NO: 115329 - DNA, 50 bp, homo sapien
gcttggactttggtaacgcagtatawcctgggcctacaagacaaaaagct

SEQ ID NO: 115330 - DNA, 50 bp, homo sapien
aaaacatcttatttcataaaatctayctgctactatatggttcctacttt

SEQ ID NO: 115331 - DNA, 50 bp, homo sapien
tacatatgagtttgcctttccaatayggttaggactcaagtaagcttttt

SEQ ID NO: 115332 - DNA, 50 bp, homo sapien
gaaacttaagtgtttaaaattagaasagtaacattaaatcacccactctt

SEQ ID NO: 115333 - DNA, 50 bp, homo sapien
gaacccattcctagcagtatacatcrcttgttaactaaagagctcttggg

SEQ ID NO: 115334 - DNA, 50 bp, homo sapien
tagtcataataataagtaacacttaygttgcaggcattgttccagatacc

SEQ ID NO: 115335 - DNA, 50 bp, homo sapien
agattgtacacatgtattccaacackgagtataatagcctccaaagtcct

SEQ ID NO: 115336 - DNA, 50 bp, homo sapien
tcctaacttcaggctttcatcttaascaatagtttccaacacccccaaaa

SEQ ID NO: 115337 - DNA, 50 bp, homo sapien
tataaaataaatatataataatcaaytcctcttatctgcattggcaataa

SEQ ID NO: 115338 - DNA, 50 bp, homo sapien
ctgaaacatagatacagcaataatamcgctctgaatcagaagagcttgac

SEQ ID NO: 115339 - DNA, 50 bp, homo sapien
tgtattctcttgctattttctccaaytatctgtctctgataaaagtaggc

SEQ ID NO: 115340 - DNA, 50 bp, homo sapien
tatgaatgggaatatatcaaccttawcctcaggctacatcattgctcaat

SEQ ID NO: 115341 - DNA, 50 bp, homo sapien
ctttgaaattatcgccttgatttacyaggaaattacaggaaaagaatcat

SEQ ID NO: 115342 - DNA, 50 bp, homo sapien
atcaatatgttgaatctggagataaygatgaactgatcacacaagcttaa

SEQ ID NO: 115343 - DNA, 50 bp, homo sapien
ctctacagtttacatccagttaccaygctagaggctcaaggcaggcaagt

SEQ ID NO: 115344 - DNA, 50 bp, homo sapien
gccgtacaatagaacaccagatagaygttttagatttttgactctggtcc

SEQ ID NO: 115345 - DNA, 50 bp, homo sapien
aaatatggttctatgtgtggaaaatwattaagcagtgatttaattatttt

SEQ ID NO: 115346 - DNA, 50 bp, homo sapien
gtttttgtcaaaaatgcagtcattgmagtatgaataaaagagttggttga

SEQ ID NO: 115347 - DNA, 50 bp, homo sapien
gagatttttctccatgcaacatgtargatgggatctgtaacttcataata

SEQ ID NO: 115348 - DNA, 50 bp, homo sapien
aacaaacacagcagataggagagaarcaacgaagatataagaaacatggg

SEQ ID NO: 115349 - DNA, 50 bp, homo sapien
agggctctttgaagaatttccttaarcatgtggattcatcttgacaaagg

SEQ ID NO: 115350 - DNA, 50 bp, homo sapien
aagtaaagtatacagaagctaaaaarggcatcagtaaatcaatgtatcag

SEQ ID NO: 115351 - DNA, 50 bp, homo sapien
gtatcacgcagaggctttgctaaaasgttcaggaaaatcagaatacctca

SEQ ID NO: 115352 - DNA, 50 bp, homo sapien
gttaataaatttttgcaaagctcaasgtcattaagataaaagtttttaaa

SEQ ID NO: 115353 - DNA, 50 bp, homo sapien
taaagaagaaatgataatagttacakacaagaactttctactttctaaaa

SEQ ID NO: 115354 - DNA, 50 bp, homo sapien
tcatgtaatttagattctaataaaakagtaaagcacattaatattaactg

SEQ ID NO: 115355 - DNA, 50 bp, homo sapien
cagttcctgtggctgcaccaaactgragtgtcaccagcattacaacaaaa

SEQ ID NO: 115356 - DNA, 50 bp, homo sapien
caccttcttttataccttttctccasaatgtgattcaagatgtctggttt

SEQ ID NO: 115357 - DNA, 50 bp, homo sapien
tcagtgagaaggagcaatgtaaataraaagttaaatagcatgaggtaaat

SEQ ID NO: 115358 - DNA, 50 bp, homo sapien
taagattttatttactgctttctgayagttgttcaatcctagttccaatt

SEQ ID NO: 115359 - DNA, 50 bp, homo sapien
accatttcaactttattttgataaartcagatctttgcttacctggtggc

SEQ ID NO: 115360 - DNA, 50 bp, homo sapien
aatgtagcttgacatttttccatgtwaacaccagtagcctgatccaacat

SEQ ID NO: 115361 - DNA, 50 bp, homo sapien
ttttttttcctgaataattcataaayggagatggactaaagaaaatataa

SEQ ID NO: 115362 - DNA, 50 bp, homo sapien
atgccacaaggttatcaatatacacyagtttcgaggctttttgaaaattt

SEQ ID NO: 115363 - DNA, 50 bp, homo sapien
gaggaagtcttaagccaaggaatatyaatgtgttattgtaagacatgtag

SEQ ID NO: 115364 - DNA, 50 bp, homo sapien
gaatcaggaaccaggtcatttatttstcagcctgatgatagattcataaa

SEQ ID NO: 115365 - DNA, 50 bp, homo sapien
accattctcccctcagtaggattccrgctatgctaatggtaaagggattt

SEQ ID NO: 115366 - DNA, 50 bp, homo sapien
ccccatttttgtgccccgaatggtcrctcagaacgttcatacctccatca

SEQ ID NO: 115367 - DNA, 50 bp, homo sapien
tatcttgactgcttttggccatttcratctccatatgaattttaagaaca

SEQ ID NO: 115368 - DNA, 50 bp, homo sapien
atcttttttgccttttggctgtcaayatcataaccagcttttacatccat

SEQ ID NO: 115369 - DNA, 50 bp, homo sapien
cccttaaacataatcttctgactcayagtaaatatattctttatttatat

SEQ ID NO: 115370 - DNA, 50 bp, homo sapien
cttacatgatcctgggtcctggcaartataaaatcttctgggcaggctga

SEQ ID NO: 115371 - DNA, 50 bp, homo sapien
ttttgtttttataattgtcttcgaawaaattatcagttcaacattatgaa

SEQ ID NO: 115372 - DNA, 50 bp, homo sapien
ttcccttttgatctttcataccatcmatatgagtctcaaaagtgttcatt

SEQ ID NO: 115373 - DNA, 50 bp, homo sapien
ctatgcttgtcatctgtctattataygatgtcaataacatctagaatgcc

SEQ ID NO: 115374 - DNA, 50 bp, homo sapien
ttttttccaaaaaatggaatcacacygtaacctgatttatcactaacatg

SEQ ID NO: 115375 - DNA, 50 bp, homo sapien
tgaaactttcagtgttcaggtgagakgtattttatcccttcatgaaccac

SEQ ID NO: 115376 - DNA, 50 bp, homo sapien
ctcaactgctgaacctaagtaatgtycattttacctattcctttgtattc

SEQ ID NO: 115377 - DNA, 50 bp, homo sapien
tgactgcaaatagcattctgatgaartgaaacactctgatcaatgggatg

SEQ ID NO: 115378 - DNA, 50 bp, homo sapien
aaacttaaagcagtctatgttacatrtattcatagactgaggagtcatga

SEQ ID NO: 115379 - DNA, 50 bp, homo sapien
atgtgacttttatgaaagtgttagaygagaaatttaatgacttaaaatca

SEQ ID NO: 115380 - DNA, 50 bp, homo sapien
acaagtaatcaaggtcttatattacygatgtcaacttactgtctgctgaa

SEQ ID NO: 115381 - DNA, 50 bp, homo sapien
cataggattttaatggtgataagcartaaggagaaatgtaaggtgtggaa

SEQ ID NO: 115382 - DNA, 50 bp, homo sapien
tctggcaacacctgtaaagggcaackgactgttccaagagggtagcttaa

SEQ ID NO: 115383 - DNA, 50 bp, homo sapien
attactttttaattttcttgtgctcraagctattatttgaatgctaattt

SEQ ID NO: 115384 - DNA, 50 bp, homo sapien
ttttcagtgtcacatacaagttttaygatcaattggaagatactttttat

SEQ ID NO: 115385 - DNA, 50 bp, homo sapien
tgggtgtttttctaaacctagactasagcgtcagattctgggcattgaaa

SEQ ID NO: 115386 - DNA, 50 bp, homo sapien
caagcaacagctttgtgatttattasctatctcacatgaaataactcatt

SEQ ID NO: 115387 - DNA, 50 bp, homo sapien
ttcacagccaaattctatcagatgcmgaaagaaaagctggtaccatttct

SEQ ID NO: 115388 - DNA, 50 bp, homo sapien
ggtaactctacccattcagaatttgwattcctagttcagggaaaggagga

SEQ ID NO: 115389 - DNA, 50 bp, homo sapien
tttcaccaagtaaacacacatgtaartaatatccagatcaagaaagagaa

SEQ ID NO: 115390 - DNA, 50 bp, homo sapien
taaatttgaaattttcactgaacgasatatctgttgttaacattttaaac

SEQ ID NO: 115391 - DNA, 50 bp, homo sapien
atcgatgaatagggcacaatcattayctttcatggcactttagcaaccat

SEQ ID NO: 115392 - DNA, 50 bp, homo sapien
aggtgataggagatatagtggccatrgtaagaagaaggaaactactatag

SEQ ID NO: 115393 - DNA, 50 bp, homo sapien
ccacctcaggcttatggattttcacrctaataaaatgcaaataacccagg

SEQ ID NO: 115394 - DNA, 50 bp, homo sapien
atggcaaatgctagcatcccaataayggtgtgcccttcatgaaaccccat

SEQ ID NO: 115395 - DNA, 50 bp, homo sapien
aatgtcccctcttcatgttaatgcaracttcctgagaaagtgttggtaac

SEQ ID NO: 115396 - DNA, 50 bp, homo sapien
agccttctgggcctacttctgtcccrtcccaaatcacactacggtgtcat

SEQ ID NO: 115397 - DNA, 50 bp, homo sapien
tctaatcaccagttgtactttgggakgttgatctattacagaggttctca

SEQ ID NO: 115398 - DNA, 50 bp, homo sapien
acacttaatcactgccctgtccataytaacgctattaatttgcttcttta

SEQ ID NO: 115399 - DNA, 50 bp, homo sapien
ttgtaagtatataatagcaataccaygtttatccgcagttgaaaaacaaa

SEQ ID NO: 115400 - DNA, 50 bp, homo sapien
agtagtcagatataaaaatataaaaygtgatatgtaagtgtagattatga

SEQ ID NO: 115401 - DNA, 50 bp, homo sapien
aaatacagtaagtgaaaaataagaaytaagtgcatgggtttaacagcaaa

SEQ ID NO: 115402 - DNA, 50 bp, homo sapien
gcaaacagttctgttattacttttcytgtacatctctgcttaaatttaag

SEQ ID NO: 115403 - DNA, 50 bp, homo sapien
tgtgttattgttttcaagagccatckataacatccttgaaacttacacaa

SEQ ID NO: 115404 - DNA, 50 bp, homo sapien
tctagaatctggaatcggggcttcayattggaaacacaggctaccatctt

SEQ ID NO: 115405 - DNA, 50 bp, homo sapien
ccagtgaagtggaaccagctcaggayggcctactgttatattgccaggca

SEQ ID NO: 115406 - DNA, 50 bp, homo sapien
tttgacataagtatgtatacatgtargaatccaacacttcaatcaacata

SEQ ID NO: 115407 - DNA, 50 bp, homo sapien
ggaaatatttgatgtccaaagctaastaataactgaatgggactagctta

SEQ ID NO: 115408 - DNA, 50 bp, homo sapien
aaacaaaataactatagcaaatcccrattagtgaggagaattttatatac

SEQ ID NO: 115409 - DNA, 50 bp, homo sapien
tgatggtaaggatgtggaaaaactamagcgttcatacattgctggtggga

SEQ ID NO: 115410 - DNA, 50 bp, homo sapien
aggtggccctgaaggtcaatataacrgagttcactgcagaaaagagaaac

SEQ ID NO: 115411 - DNA, 50 bp, homo sapien
ctaaagtataaaagctcttctcttamgattccacaatggaaaacacttca

SEQ ID NO: 115412 - DNA, 50 bp, homo sapien
tccagaatttttagacatttctccartaagcatctatattaactaaacta

SEQ ID NO: 115413 - DNA, 50 bp, homo sapien
aagcatctagatcgtatatgtataamtgaattaattaaaaatgtgtcgca

SEQ ID NO: 115414 - DNA, 50 bp, homo sapien
actgtcagttacacaaaaagaaataygctgtagtcaactgtactggaaat

SEQ ID NO: 115415 - DNA, 50 bp, homo sapien
tacgtgactaattaatacttgccagwcggattatgtggtaagttctatga

SEQ ID NO: 115416 - DNA, 50 bp, homo sapien
ggggataaagatcttgaacattcaargtaatataaggattcaggtgataa

SEQ ID NO: 115417 - DNA, 50 bp, homo sapien
tgggaaaatttgttttccagtcagaygtttgtcaaggttaaagaaattca

SEQ ID NO: 115418 - DNA, 50 bp, homo sapien
aactgggagacactctgagagtctamagatttacctaagagagagttagt

SEQ ID NO: 115419 - DNA, 50 bp, homo sapien
gaaagtatatgttcacacagacttawatgtgactgttcatagcagcttta

SEQ ID NO: 115420 - DNA, 50 bp, homo sapien
cttttatttctatattacatttgtcrcacccctcagaaaatgtggacact

SEQ ID NO: 115421 - DNA, 50 bp, homo sapien
cagaccaatgaaaatgatccttatascagcaatggagaaaatcttttcta

SEQ ID NO: 115422 - DNA, 50 bp, homo sapien
taacagaccagtggttggagattgarataaatttggaaacttgagaagta

SEQ ID NO: 115423 - DNA, 50 bp, homo sapien
tgaatgaagtatgtgactcacagggraccttttagagagaggaattaaca

SEQ ID NO: 115424 - DNA, 50 bp, homo sapien
ttcaggtgtacatttcatattaaagyatttttcggtatatgtgttctacc

SEQ ID NO: 115425 - DNA, 50 bp, homo sapien
aaaataattttaagtgatcaaaataygaaatgtaattatcaaaccccatt

SEQ ID NO: 115426 - DNA, 50 bp, homo sapien
acatggttcagtctcttgagatttasaggtagccaattatggcccacagg

SEQ ID NO: 115427 - DNA, 50 bp, homo sapien
caataaactcatcatttaaagactamacctcagactcaggtagcacaaaa

SEQ ID NO: 115428 - DNA, 50 bp, homo sapien
agcccagcaatcttctttattcactrcaggttgttcttggtccctcaggt

SEQ ID NO: 115429 - DNA, 50 bp, homo sapien
aaaggtttgattatatgtttacgtayagatctctttgaatttaccttaca

SEQ ID NO: 115430 - DNA, 50 bp, homo sapien
ctagaatgccctacttttcttagctyagactggttgagttatatgtttac

SEQ ID NO: 115431 - DNA, 50 bp, homo sapien
acttttcttgcagaaacatacatccrtcatgctagtctctacaaaaagga

SEQ ID NO: 115432 - DNA, 50 bp, homo sapien
tcaatgactccttatatacttatcartagaaaaagcattaaaacatcagc

SEQ ID NO: 115433 - DNA, 50 bp, homo sapien
cactagtaagtaaataatctctctcratcttgtttggtgtccttggggga

SEQ ID NO: 115434 - DNA, 50 bp, homo sapien
cagaatgataagagtgtcttttgctkgttaatgagatgactggtggctgg

SEQ ID NO: 115435 - DNA, 50 bp, homo sapien
ttgattcagttgtcttttcactactmcacagtgcatcttgggataaaaag

SEQ ID NO: 115436 - DNA, 50 bp, homo sapien
atgggacgtacacaaacttaggaacrtattttatgagaaacaaatttaag

SEQ ID NO: 115437 - DNA, 50 bp, homo sapien
gtacacatcagaactcagaaggatawaattattcaaggcagagttaatga

SEQ ID NO: 115438 - DNA, 50 bp, homo sapien
ttggaacccaagctgtataactcaartctttgatcttcaccacacattat

SEQ ID NO: 115439 - DNA, 50 bp, homo sapien
agtcatcacagataacagacactaastggtacagatcagctgactagaga

SEQ ID NO: 115440 - DNA, 50 bp, homo sapien
acctatgggcaacagttcagctataygttataaagtctaaaaggttaatg

SEQ ID NO: 115441 - DNA, 50 bp, homo sapien
agcatcaattttcttttaaattcaayagttattcaaattgatcgaaaatt

SEQ ID NO: 115442 - DNA, 50 bp, homo sapien
gtatatttcagttctttggagcaaaragattgcataaatagacacttact

SEQ ID NO: 115443 - DNA, 50 bp, homo sapien
gcacacataaaatattttagttatgyaatgctaccacacatcagcatctt

SEQ ID NO: 115444 - DNA, 50 bp, homo sapien
gtcttgaaatctattttgtcttatakaaccacatctattcctcctctttt

SEQ ID NO: 115445 - DNA, 50 bp, homo sapien
aaagactgatttctgatgaaaaaaasaactaatttaagcaatgtaacaga

SEQ ID NO: 115446 - DNA, 50 bp, homo sapien
cattgatatcaactgtcactctcaakagaactgatgcctcatcttcttct

SEQ ID NO: 115447 - DNA, 50 bp, homo sapien
tcaaaatagggaccttcctgaataaycattgttgaaacagttgcccaaga

SEQ ID NO: 115448 - DNA, 50 bp, homo sapien
attgctgtaggtttcgtggcactaasaaaaacacaaggatggatgaacta

SEQ ID NO: 115449 - DNA, 50 bp, homo sapien
atgcctatctattagctagaaagaayaataatgacctcattaactttatg

SEQ ID NO: 115450 - DNA, 50 bp, homo sapien
gaaacatgcaatacaaatttggataygtattatgcgtgtaaactatctat

SEQ ID NO: 115451 - DNA, 50 bp, homo sapien
gtacctacaacacataagtacaagawgccctattaatcagggtttagttt

SEQ ID NO: 115452 - DNA, 50 bp, homo sapien
agaagggaaggcaatgaaaacactckatgtctcttctattagaggtgctg

SEQ ID NO: 115453 - DNA, 50 bp, homo sapien
ctaagcaagttaatatatattgaccygataatttgatcaacggagtaagt

SEQ ID NO: 115454 - DNA, 50 bp, homo sapien
gggatttcttggtgactttacttgarggctttctacaaaggtgagctaga

SEQ ID NO: 115455 - DNA, 50 bp, homo sapien
ctgcactctagtcttagcaaactgaktattggctatcttgacaactatcc

SEQ ID NO: 115456 - DNA, 50 bp, homo sapien
atcattgcacagaccaacaagctttsacattgaatcagtaataaatagat

SEQ ID NO: 115457 - DNA, 50 bp, homo sapien
tagttttctaacttcatttctaatawgtatcaactggtgtaggtacactt

SEQ ID NO: 115458 - DNA, 50 bp, homo sapien
cagttgtgggggacatagcaagggaytcctactgcttgaggaaaggagta

SEQ ID NO: 115459 - DNA, 50 bp, homo sapien
ttagaggggatttttaacaatttcamttatgcaagtgcttttaagaacag

SEQ ID NO: 115460 - DNA, 50 bp, homo sapien
tgttattcaatgacagtttttatgamgattaagtgagaggaggaggctga

SEQ ID NO: 115461 - DNA, 50 bp, homo sapien
taggattgtctatcttcttgttaccygaaggcatttgaagaaaactagaa

SEQ ID NO: 115462 - DNA, 50 bp, homo sapien
tagaagtcagaacctcttgttgaccrggaatagactgtagaagtgtgctg

SEQ ID NO: 115463 - DNA, 50 bp, homo sapien
gtatgttgcaaattaggactcatttrtctatttatatatactatacacac

SEQ ID NO: 115464 - DNA, 50 bp, homo sapien
ctcctactgcaataaccatggatttyattcccactgcttcctccatattc

SEQ ID NO: 115465 - DNA, 50 bp, homo sapien
ggagcatttacattcaacgttagtakcgagatgtttggtatttcatttat

SEQ ID NO: 115466 - DNA, 50 bp, homo sapien
aattgcacgtgtgtagtaggtacaaytcttattccataaagtcacattat

SEQ ID NO: 115467 - DNA, 50 bp, homo sapien
caacagtgagttatacttctggaaayagagtaagttagatatgtcagacc

SEQ ID NO: 115468 - DNA, 50 bp, homo sapien
atcgaggccataataagtatttcacrctagattacataaaataaacctag

SEQ ID NO: 115469 - DNA, 50 bp, homo sapien
tgaatactttgtatttggaaagcaaytcttcatggttgttaccactgtgg

SEQ ID NO: 115470 - DNA, 50 bp, homo sapien
ttccatttaaaatatagattggtggmataaataaaagaaaatcaatctat

SEQ ID NO: 115471 - DNA, 50 bp, homo sapien
taaatgtcactgtttcatgactgagyattcatttgttaggtctagatgtg

SEQ ID NO: 115472 - DNA, 50 bp, homo sapien
tagctaagcaggagtctcaaacacayggttagtttcaactcttagaaaag

SEQ ID NO: 115473 - DNA, 50 bp, homo sapien
aatgacccctaaagtagatacagttwaaattacagcactcaagtcctttc

SEQ ID NO: 115474 - DNA, 50 bp, homo sapien
atgaactatgtttcaatagtatttaygctttgcagtatgtcagcttccag

SEQ ID NO: 115475 - DNA, 50 bp, homo sapien
agcttgtctgtatgctttggagtggygaggttaaagtgatcttacttgac

SEQ ID NO: 115476 - DNA, 50 bp, homo sapien
aatatttcatgctcatcaattagagraatcaatattgttaaaatagccat

SEQ ID NO: 115477 - DNA, 50 bp, homo sapien
ggtcagggacttccaaggaacataawtggaaatttgcgtacaaggagata

SEQ ID NO: 115478 - DNA, 50 bp, homo sapien
aagaaaaaacactgttatatttaggyccgtgagagcatatacatgtataa

SEQ ID NO: 115479 - DNA, 50 bp, homo sapien
atgtgacaaaattgaatcaataataraaagtatctcttcaaagaaaagcc

SEQ ID NO: 115480 - DNA, 50 bp, homo sapien
tgtaaagtctatgtgattttaaacamctacgtagcatttttccctgctaa

SEQ ID NO: 115481 - DNA, 50 bp, homo sapien
tctagatggatatgcagctcctagckcatgtgaacagagttttagacagt

SEQ ID NO: 115482 - DNA, 50 bp, homo sapien
aatgttttatgctgggatttcccaaygtatattgcccaaaacattagctc

SEQ ID NO: 115483 - DNA, 50 bp, homo sapien
ttttctggcagaatgggcaaagcgcratgtaatttgagctctcatgtatg

SEQ ID NO: 115484 - DNA, 50 bp, homo sapien
atttcaggcaagcaaatgcttatgcrgaacttaggtctttgactctacct

SEQ ID NO: 115485 - DNA, 50 bp, homo sapien
ctgctcagattttatatcccaggaakttgaaagtaatgattgagagaaaa

SEQ ID NO: 115486 - DNA, 50 bp, homo sapien
tattcacagacaacatggttcagtaygtaaaaatctttaaaaatatgcat

SEQ ID NO: 115487 - DNA, 50 bp, homo sapien
aatcagagagttaatgtacgggaacrgacaagattttaagagtcagttta

SEQ ID NO: 115488 - DNA, 50 bp, homo sapien
tcttccccattggcaaaaaggcctasagagtgatacacttgatttcagtt

SEQ ID NO: 115489 - DNA, 50 bp, homo sapien
ctagaaaacattctgagtagccgagraaatcctaaacaaaaagaacaaag

SEQ ID NO: 115490 - DNA, 50 bp, homo sapien
accagtcaactttgccagattccctsagagatgattctgcacacagccgc

SEQ ID NO: 115491 - DNA, 50 bp, homo sapien
aagacaacctagtctggtctaaactkcaagtgacttataatggcaagaaa

SEQ ID NO: 115492 - DNA, 50 bp, homo sapien
tgtgttatctctgagttctttgacamgtgttttgtagttctctttgtaga

SEQ ID NO: 115493 - DNA, 50 bp, homo sapien
gatgcaatcctttctcatttgcctawcctctgaaaacaacttctcagtgt

SEQ ID NO: 115494 - DNA, 50 bp, homo sapien
tttcccacctaggaaataaacaagaratggaaccaggtatcaggcaatta

SEQ ID NO: 115495 - DNA, 50 bp, homo sapien
agctattgtgcattatttgagttgayagtattgagacaggtttagtgaaa

SEQ ID NO: 115496 - DNA, 50 bp, homo sapien
gtgtgctgtatgtataggtcatagtsatttgcttcaggtggctgtgtgtt

SEQ ID NO: 115497 - DNA, 50 bp, homo sapien
actctctcactggtcatcagtgcgayaaatgggttaaggaacaaagacag

SEQ ID NO: 115498 - DNA, 50 bp, homo sapien
caaaaggaacagaatgtctgcttcaytatacactatacatctgattactc

SEQ ID NO: 115499 - DNA, 50 bp, homo sapien
actaggagagaaggattataaatacyatgtcggaaaagatggaaatagcc

SEQ ID NO: 115500 - DNA, 50 bp, homo sapien
tgtgagtgctcacctggtttatggawcttattaagatgttttcttttatg

SEQ ID NO: 115501 - DNA, 50 bp, homo sapien
gccagtttgcagtgatctttcagaarggacgctggcatgtagtaggtgtt

SEQ ID NO: 115502 - DNA, 50 bp, homo sapien
accctaagattgcggtggcccactayctatgcaagcaactcgagggctcc

SEQ ID NO: 115503 - DNA, 50 bp, homo sapien
aggtttatactgtctgtcactaagayacagttattaaagaaccagtatat

SEQ ID NO: 115504 - DNA, 50 bp, homo sapien
agtgttaccttttttctgcaattaargctgttattaactcaacaatgtat

SEQ ID NO: 115505 - DNA, 50 bp, homo sapien
tttaatgcatataattgtattgcctwaccatatcaaaaattattatagtg

SEQ ID NO: 115506 - DNA, 50 bp, homo sapien
agctttctactttttttaatgttcartaatgtttgattattatctatggt

SEQ ID NO: 115507 - DNA, 50 bp, homo sapien
caggatcttaacaagggctggctacrgtaaaatggactttaaatgggaaa

SEQ ID NO: 115508 - DNA, 50 bp, homo sapien
acattacctgacttcaaacgatactrtaaggcactagttactaaaacagt

SEQ ID NO: 115509 - DNA, 50 bp, homo sapien
ttaacaaatgattagctcttagtaaytagattttgtttttcatgctcggg

SEQ ID NO: 115510 - DNA, 50 bp, homo sapien
tcaatcagacagttggttcccttaaygtatgaactaatgtctgacacatc

SEQ ID NO: 115511 - DNA, 50 bp, homo sapien
atctgagtcccctaacctaagaacastgcaaataagcaggacctgggaat

SEQ ID NO: 115512 - DNA, 50 bp, homo sapien
ctaccgtgtcgctcagttagttaaarccaggtgctaatgaaaccaggaca

SEQ ID NO: 115513 - DNA, 50 bp, homo sapien
aaataccgggatcataaatgtgaagsatacctttttagatagtgcatttt

SEQ ID NO: 115514 - DNA, 50 bp, homo sapien
tttgacatatataggcacaacaaatkacatacagccagtcttgacataac

SEQ ID NO: 115515 - DNA, 50 bp, homo sapien
agaccccaaaccacagccagacttayatttagtagaattttcagaaactt

SEQ ID NO: 115516 - DNA, 50 bp, homo sapien
aacaaaacccgacatgagatttgccrgatggtttggtaccggattgtaaa

SEQ ID NO: 115517 - DNA, 50 bp, homo sapien
atgctctagatcaataactggagccyaatagcttcattggggttcctttt

SEQ ID NO: 115518 - DNA, 50 bp, homo sapien
gactatagtagccaagtatatgttayattaatcattaccctcatttccta

SEQ ID NO: 115519 - DNA, 50 bp, homo sapien
gttggcactgattagtcttttctaarggtaaacattgaagataaagtcta

SEQ ID NO: 115520 - DNA, 50 bp, homo sapien
tcattagtttccaatcaagtgaattytagccacttattactggttctaga

SEQ ID NO: 115521 - DNA, 50 bp, homo sapien
agccctgagatgtcctatggttacaygtccttccctggatactttctgtg

SEQ ID NO: 115522 - DNA, 50 bp, homo sapien
aggaccacagcgtcatatgaggtttrggtcctctttcaaacttacatggt

SEQ ID NO: 115523 - DNA, 50 bp, homo sapien
agaaatacatttcctgaactaaaaartttattggaggctctcaacagcag

SEQ ID NO: 115524 - DNA, 50 bp, homo sapien
gtgtaagcacttagattaagataaastgtttcctaatcctttgtgatcag

SEQ ID NO: 115525 - DNA, 50 bp, homo sapien
tggtttgactttatacataggataargcccttcctggacctcaaatgaag

SEQ ID NO: 115526 - DNA, 50 bp, homo sapien
ctcactggcaagtagtgtaggaatgrataattttgatgcataaaatattg

SEQ ID NO: 115527 - DNA, 50 bp, homo sapien
gagctgctaccagttgaatgctgtargtttgagtcctgcattgccaagtg

SEQ ID NO: 115528 - DNA, 50 bp, homo sapien
tacaggaaagagaacacatgtgtctratcttagctatctgaattgcctgc

SEQ ID NO: 115529 - DNA, 50 bp, homo sapien
tgaattttgtaccaagttactctcasgtgcatctggcccagtcactaccc

SEQ ID NO: 115530 - DNA, 50 bp, homo sapien
actacttgttagccaaacttattaaycataatgtgtacaatttagaatct

SEQ ID NO: 115531 - DNA, 50 bp, homo sapien
tcaactgatatttcacaaagggtcamagtaaatttagtggagaaaattca

SEQ ID NO: 115532 - DNA, 50 bp, homo sapien
gttaaagtacttggaaggacccttasaggccatcaagtctgactcctttg

SEQ ID NO: 115533 - DNA, 50 bp, homo sapien
catttcccataagactcaaggaacaytcattatccattcttaagagaaaa

SEQ ID NO: 115534 - DNA, 50 bp, homo sapien
gctttatattattttaatctttgacrcttaatgatatcagaaataaactg

SEQ ID NO: 115535 - DNA, 50 bp, homo sapien
atgagctcttactgtttacaaaccartgaattactaactcatccatgact

SEQ ID NO: 115536 - DNA, 50 bp, homo sapien
caccctggtgtaaattgtgaaattamgtctgccttttgagggtccccaac

SEQ ID NO: 115537 - DNA, 50 bp, homo sapien
caacaaatgtttattcaaactaagcyaaaagttatggaaatttaacatct

SEQ ID NO: 115538 - DNA, 50 bp, homo sapien
ggatattttatccagaccatctctayctgttaacaacactttctaggaac

SEQ ID NO: 115539 - DNA, 50 bp, homo sapien
taccttaaatttgaaaatttacagayaagagcaagccctgatattatgat

SEQ ID NO: 115540 - DNA, 50 bp, homo sapien
gcgggtcgggggacataaaatgaaarcgttgaacctagcaggagagggag

SEQ ID NO: 115541 - DNA, 50 bp, homo sapien
ctaaatgaaatgttttcttccaatayagtattctgtgcaccgcagaagtt

SEQ ID NO: 115542 - DNA, 50 bp, homo sapien
gaaacatcaaaaaataaccagaaackgtcatattcaaatatcagaaatat

SEQ ID NO: 115543 - DNA, 50 bp, homo sapien
attgggtccatttatatataaattgwaatatcttcttgtcatattaatac

SEQ ID NO: 115544 - DNA, 50 bp, homo sapien
agctttttgccattatttccatttaycaagttttagggaatagggatctc

SEQ ID NO: 115545 - DNA, 50 bp, homo sapien
tcaagatcagaatccttggaagtcasataagagatacagggaagcaattt

SEQ ID NO: 115546 - DNA, 50 bp, homo sapien
gaggaggtagaacattgcgggtggaktcagacacattcatatattttaca

SEQ ID NO: 115547 - DNA, 50 bp, homo sapien
gcattgcttcttgaaaacgttcacartatgattctctatgcactactttg

SEQ ID NO: 115548 - DNA, 50 bp, homo sapien
actttcttgcttcaaatatttcttawgttcctttctctctttcttctcct

SEQ ID NO: 115549 - DNA, 50 bp, homo sapien
gaaataccgaggtcaagagatagaarggacattcccaaggtcacaccact

SEQ ID NO: 115550 - DNA, 50 bp, homo sapien
atttatgagggcagagctcttgttayctaaccatcttccaaagcccctac

SEQ ID NO: 115551 - DNA, 50 bp, homo sapien
attcaggttggaccttcgttatcatragcataatagccatacggatctac

SEQ ID NO: 115552 - DNA, 50 bp, homo sapien
ctaaagttaaggactactttacctgytctttcacttatttgtttcaaatt

SEQ ID NO: 115553 - DNA, 50 bp, homo sapien
ctaggcaagtagcatacctgttgaaygaaacattttcatgaaatatgtcg

SEQ ID NO: 115554 - DNA, 50 bp, homo sapien
tgcatttagagcctgctgaagctcartctggagttattgctttcatttca

SEQ ID NO: 115555 - DNA, 50 bp, homo sapien
aacaacactcatgaaggtttaacaarctataaatgtggacacaaaatata

SEQ ID NO: 115556 - DNA, 50 bp, homo sapien
ttcttccacccacggcaagattatascagtcacactggcaaacatttgga

SEQ ID NO: 115557 - DNA, 50 bp, homo sapien
ttactttcattagagaatatgggtgytagacatttgacttgatattagat

SEQ ID NO: 115558 - DNA, 50 bp, homo sapien
aattatgagacttcttgtattgagakgtaattataggctgagaaaataat

SEQ ID NO: 115559 - DNA, 50 bp, homo sapien
aacagagctaagaaatgtatgtgtartaattcatgtatacaaatatctat

SEQ ID NO: 115560 - DNA, 50 bp, homo sapien
ggattgggaagaacccttactttcaytttgcattttttgaactatgtatc

SEQ ID NO: 115561 - DNA, 50 bp, homo sapien
atttgattaatgtcatatgatgaacyatttttgtattccagaaataactt

SEQ ID NO: 115562 - DNA, 50 bp, homo sapien
atttgggaaatactgtgataacataraaacttcattaacattaacctata

SEQ ID NO: 115563 - DNA, 50 bp, homo sapien
tcatcccatctggatgtattcttcaygcatcttaatatagtgctcccaca

SEQ ID NO: 115564 - DNA, 50 bp, homo sapien
gatgtgaatgtgtgctgatctgatasagaaaactttttaaagaagcttca

SEQ ID NO: 115565 - DNA, 50 bp, homo sapien
gcagcaagatataaacatatcaataragggtcaatagtggtaagctgaat

SEQ ID NO: 115566 - DNA, 50 bp, homo sapien
aagggctagaagccattactaataayccaaagatgcaaggcctcctcaaa

SEQ ID NO: 115567 - DNA, 50 bp, homo sapien
aagtgatataacttatagacaagaaraggaatatagaagtattttataag

SEQ ID NO: 115568 - DNA, 50 bp, homo sapien
caaagcattcttcacatataatcatratataaggttctccttcctgccca

SEQ ID NO: 115569 - DNA, 50 bp, homo sapien
attgcatttcagattccagggaaaaygtactaataagataattcaatttt

SEQ ID NO: 115570 - DNA, 50 bp, homo sapien
tgagggcatcattggtgcctccctakcacgtaaaatatctggcataaagt

SEQ ID NO: 115571 - DNA, 50 bp, homo sapien
gcttggcatttttgtcactgtagaastctaacatgggatccaaaacaatt

SEQ ID NO: 115572 - DNA, 50 bp, homo sapien
taggatcctggcaggaaacaaatggyatgctcaaattgggaatttgtgct

SEQ ID NO: 115573 - DNA, 50 bp, homo sapien
tatagcagaaataaatgaatctaaartgaaaaatacaaaagttcaatgaa

SEQ ID NO: 115574 - DNA, 50 bp, homo sapien
gaggtggccccataaatgtttcacaygattccagctgtagtttctatatt

SEQ ID NO: 115575 - DNA, 50 bp, homo sapien
tgaacaccttctttgtactaaggaaygatgaacataaaaacagttatttt

SEQ ID NO: 115576 - DNA, 50 bp, homo sapien
tgtatgaaataggtgatgaaataagwatagaagttcaaggatttgaaaat

SEQ ID NO: 115577 - DNA, 50 bp, homo sapien
aaacaaaatcctgtggggtctcttaygttagtctccttctctacaccacc

SEQ ID NO: 115578 - DNA, 50 bp, homo sapien
taaatggaatgtaagatgtccgaccragagaacacatgtagtcatgtaag

SEQ ID NO: 115579 - DNA, 50 bp, homo sapien
ttgaattaatgttcctctcatacgcraaatatattcactctatcccaaca

SEQ ID NO: 115580 - DNA, 50 bp, homo sapien
gaatctatgtcaagttagtatttgtragtggtgtaagatatggactaaat

SEQ ID NO: 115581 - DNA, 50 bp, homo sapien
agaaaatgggatacttatatcagaawgagctattggggaattaagctatt

SEQ ID NO: 115582 - DNA, 50 bp, homo sapien
gttttctgtgctttgaatcaacacartgtaagctagatgaacaaaatact

SEQ ID NO: 115583 - DNA, 50 bp, homo sapien
ctataaaagcattatcatttgtgtaygtaacatcaacattaatcattcag

SEQ ID NO: 115584 - DNA, 50 bp, homo sapien
tacttcacttgtttcttgtgaaatargactgagcttttgtctcatcaatc

SEQ ID NO: 115585 - DNA, 50 bp, homo sapien
acagatgtatttgacctttcagatakatagagaattcacaataaccattt

SEQ ID NO: 115586 - DNA, 50 bp, homo sapien
tatgtcaccgatatcaagtagtataragctcagtatagaatctgtgggac

SEQ ID NO: 115587 - DNA, 50 bp, homo sapien
gaaattggcacgatcagaatttaagycactcttttctgtccccaagccca

SEQ ID NO: 115588 - DNA, 50 bp, homo sapien
ggggcatggaatcaggaactttaggratatactgtgtactttgttttact

SEQ ID NO: 115589 - DNA, 50 bp, homo sapien
aaagttcataatataaaaacttcaaycattttatgcacttgtagtaaaga

SEQ ID NO: 115590 - DNA, 50 bp, homo sapien
ttataccacaagaatataacacaacrcaggtttagccaaaatgggattac

SEQ ID NO: 115591 - DNA, 50 bp, homo sapien
gaaggaagattactttggctcagaawtgttctgtaaggttccaaaatggc

SEQ ID NO: 115592 - DNA, 50 bp, homo sapien
agttcaaggcctgaaaatgtctgtamaaggcaaatggttccaaaattttg

SEQ ID NO: 115593 - DNA, 50 bp, homo sapien
atattgggattatcaacatatctgaractcttttgtatttagttggcagt

SEQ ID NO: 115594 - DNA, 50 bp, homo sapien
gaaaacttgaaaacactcctgagaaygagaatagaacaaggatgcctgct

SEQ ID NO: 115595 - DNA, 50 bp, homo sapien
acagacacacaaatttaacatttcayagtgaagcatcctaaagccatata

SEQ ID NO: 115596 - DNA, 50 bp, homo sapien
agttctgaagggaaaatatggcatakgagtaaaatggtttaggtcatctt

SEQ ID NO: 115597 - DNA, 50 bp, homo sapien
aaggtaaaatatctatcaacctatgsactttgttatgttttctctgtttg

SEQ ID NO: 115598 - DNA, 50 bp, homo sapien
caccctctacctgaggatctggaaayaggctgcttccctcggcaaacatc

SEQ ID NO: 115599 - DNA, 50 bp, homo sapien
taaaattactagcttcctagaaaggrtatatgaatgcaacaaaggctaaa

SEQ ID NO: 115600 - DNA, 50 bp, homo sapien
gtgaatgtaatagaagattagaatgsaataggaagccagagcaagaatat

SEQ ID NO: 115601 - DNA, 50 bp, homo sapien
tttgaaatcacataaaacataattaratgtctcctaaatttaaaaagata

SEQ ID NO: 115602 - DNA, 50 bp, homo sapien
tttgggtatatacccaatcatgaaaytgctaggtcaaatcgtaattctgt

SEQ ID NO: 115603 - DNA, 50 bp, homo sapien
tccaagaaattcagaattactctaayatttacgaatgtgatttaagaact

SEQ ID NO: 115604 - DNA, 50 bp, homo sapien
cttgagttataaagaaagccatggayatttatttgagtatttattctgtg

SEQ ID NO: 115605 - DNA, 50 bp, homo sapien
gatcttgctgagttccaatgacatcwacttttattaatttcatacttcaa

SEQ ID NO: 115606 - DNA, 50 bp, homo sapien
aactcagaccttagttatagattcarataagttaattgctatgtctttag

SEQ ID NO: 115607 - DNA, 50 bp, homo sapien
ctagactccaggcctgcatccagtgmaaaagatgctgagacactcatcca

SEQ ID NO: 115608 - DNA, 50 bp, homo sapien
catctatttctattgacttgacaaamaggtagttttatgagtccttttgg

SEQ ID NO: 115609 - DNA, 50 bp, homo sapien
atgtattttggaagtcaaatttttayataagcatttccaagtaattttac

SEQ ID NO: 115610 - DNA, 50 bp, homo sapien
ataaatacctggatgctaaaataackcaagctttagagatgaacagattt

SEQ ID NO: 115611 - DNA, 50 bp, homo sapien
aagaggagagctgagattaggcatasagtcatgagacaaaagcccaattc

SEQ ID NO: 115612 - DNA, 50 bp, homo sapien
gagaaaataaattcctgctgtttaartcatgcaggctttggtactttgtt

SEQ ID NO: 115613 - DNA, 50 bp, homo sapien
agttaaatgatacaagatatgggtaygtgcccaatatagcacatagaaca

SEQ ID NO: 115614 - DNA, 50 bp, homo sapien
ggagctgctgtccttttccattactraaaccacaaagaagcctctacaat

SEQ ID NO: 115615 - DNA, 50 bp, homo sapien
cagtactagacagataattaagataraaatcctacaaagaaataataaaa

SEQ ID NO: 115616 - DNA, 50 bp, homo sapien
tacacattatattcatagattataamctcattttgtaccacataaacata

SEQ ID NO: 115617 - DNA, 50 bp, homo sapien
acagatgagatttttgcattcattarcaattttttggcaatgccttcaat

SEQ ID NO: 115618 - DNA, 50 bp, homo sapien
ccaaagaccatttattttccaaagaygatttattgaaaagacagtcattt

SEQ ID NO: 115619 - DNA, 50 bp, homo sapien
tacaaggtgtacaaagatctgctacmattcctactaaacctattgcaaaa

SEQ ID NO: 115620 - DNA, 50 bp, homo sapien
tttagatttcaataaatggtgtcacytgctctcaagtattatattttttc

SEQ ID NO: 115621 - DNA, 50 bp, homo sapien
ggtgtggttggtatcagtgatcaaakactttctttcctaccttccgtgta

SEQ ID NO: 115622 - DNA, 50 bp, homo sapien
gttgtgtttcttatctatagtctcarctaaactgtgaatttcttgaatgc

SEQ ID NO: 115623 - DNA, 50 bp, homo sapien
aaaaaattatctctgggcatcacagwattcctttaagactgcctagtaac

SEQ ID NO: 115624 - DNA, 50 bp, homo sapien
atactcaccacaacatgttgatttayctttaacaaactttacttttttcc

SEQ ID NO: 115625 - DNA, 50 bp, homo sapien
gaagattttcaacaattattgacatyataaaaattaactatgctcaattc

SEQ ID NO: 115626 - DNA, 50 bp, homo sapien
tttaccaggcatgcttgatctgtctsaatttcaatttagatgcaagctgt

SEQ ID NO: 115627 - DNA, 50 bp, homo sapien
ttgagaaaattcagactattctaaamgtgattcttaatgcaaatgatcaa

SEQ ID NO: 115628 - DNA, 50 bp, homo sapien
aggcaattttgcttatctagggaagyatataaaaaatgcatttcaaagtt

SEQ ID NO: 115629 - DNA, 50 bp, homo sapien
aagactggcaacttgtcacatatgargaccatgggataattccttaggct

SEQ ID NO: 115630 - DNA, 50 bp, homo sapien
ttcagaattgagacaagtcctcttayataattaaccctgacaataaaaga

SEQ ID NO: 115631 - DNA, 50 bp, homo sapien
ttcctcctctcttccttttttctcaytcctaatctcacacccgtacacaa

SEQ ID NO: 115632 - DNA, 50 bp, homo sapien
tctaggatacccaccatgtatacacycattatgattgatggtggcccata

SEQ ID NO: 115633 - DNA, 50 bp, homo sapien
gcttggccacagaaaggtaaagcaayaagttgactcttggggtccctaat

SEQ ID NO: 115634 - DNA, 50 bp, homo sapien
cagataatgaagagcctgaatattargttaaataatttagacttgattct

SEQ ID NO: 115635 - DNA, 50 bp, homo sapien
tgtgatcgaagctctatctgtattargcttagatcacaacacccaagtcc

SEQ ID NO: 115636 - DNA, 50 bp, homo sapien
tatatatatgcatgtatgtgtataaratgtatgcataagaatagctcaaa

SEQ ID NO: 115637 - DNA, 50 bp, homo sapien
aatctaatgacttaccggtggatgtsaatgttgaaaggacttaaagtggg

SEQ ID NO: 115638 - DNA, 50 bp, homo sapien
tgggggtggactagaaacagaaaacrctagtcagccatctttgctgatat

SEQ ID NO: 115639 - DNA, 50 bp, homo sapien
acagcatagtttcagttaacccagaygaaatggtagaaactgcaaggtta

SEQ ID NO: 115640 - DNA, 50 bp, homo sapien
agaataaatcaagctgagaaaagaamcttaaagctcaaagactgatccgt

SEQ ID NO: 115641 - DNA, 50 bp, homo sapien
aataatgtcaaagagaaggatgagawcaactttactttaaaaggaagaaa

SEQ ID NO: 115642 - DNA, 50 bp, homo sapien
gcattaaaggactggaatataaaccrcattaaatccttcctggaacaagg

SEQ ID NO: 115643 - DNA, 50 bp, homo sapien
tgatgttaagagtagtagtggcactytctaaccattagggacaatctaag

SEQ ID NO: 115644 - DNA, 50 bp, homo sapien
catgatggccttgatgcccacgccgraaggcttttggtttacaggaatga

SEQ ID NO: 115645 - DNA, 50 bp, homo sapien
gctattggaggaaagataaatttggragttgagtaaatattaagcaggta

SEQ ID NO: 115646 - DNA, 50 bp, homo sapien
gggaacagtacttctggttgaaagartgcttgtctccaatttggcatgaa

SEQ ID NO: 115647 - DNA, 50 bp, homo sapien
ctcctggattcgttgatttttcgacragttttcatttctctccttcagtt

SEQ ID NO: 115648 - DNA, 50 bp, homo sapien
gggaaattgatgcaaactgtattaayggcttagctactactgaagctaaa

SEQ ID NO: 115649 - DNA, 50 bp, homo sapien
gagtagaagggaaacaagacaaataragatgtgttctaggcagaaggatc

SEQ ID NO: 115650 - DNA, 50 bp, homo sapien
aggaaccaaaatataggacaagacaygaacagagttggaccggggaaaga

SEQ ID NO: 115651 - DNA, 50 bp, homo sapien
acttaaatatggaaaatatctggctsaattagttgctaatttcttaagag

SEQ ID NO: 115652 - DNA, 50 bp, homo sapien
aaatcaccagtctattgccctcaaartgttctcaacaggaaaaagttgcc

SEQ ID NO: 115653 - DNA, 50 bp, homo sapien
cacaggtattctatttattagaagcractaactaatcagcccacactcta

SEQ ID NO: 115654 - DNA, 50 bp, homo sapien
aaaaaacctggcacaggaaaagtaaytgtcctcattttgtggggattaag

SEQ ID NO: 115655 - DNA, 50 bp, homo sapien
agaggctcagtattccttgtgaagarccgtcatttaaaaggaagatctgt

SEQ ID NO: 115656 - DNA, 50 bp, homo sapien
atccaattacttaatagcttctgaayacaatatgagtctcagcccaactt

SEQ ID NO: 115657 - DNA, 50 bp, homo sapien
gactagagatgttgtgggctagcacratccgtggacagcaggttaagaat

SEQ ID NO: 115658 - DNA, 50 bp, homo sapien
gacaaaggacatagcagacacttacyggatagatgaggttattcggtgcc

SEQ ID NO: 115659 - DNA, 50 bp, homo sapien
tgaggagcctaggtattatacattcycaagaggtttcatgtaggaactca

SEQ ID NO: 115660 - DNA, 50 bp, homo sapien
tcattgcaagtactacattgtatcaycataataacttcttttttatatgt

SEQ ID NO: 115661 - DNA, 50 bp, homo sapien
ttctgggctttgtgcttcttcaaaartctattaaaaatccagcatttgta

SEQ ID NO: 115662 - DNA, 50 bp, homo sapien
aaagtcattcagagtcagatcttatraacacagtgagcatcaaattgcta

SEQ ID NO: 115663 - DNA, 50 bp, homo sapien
ttttcatcaaccaagaaaggaaacarttatcagtactactatctcgattt

SEQ ID NO: 115664 - DNA, 50 bp, homo sapien
gaggcaaatcggtaggctaggaactrtagtagatactgactagtgtcaag

SEQ ID NO: 115665 - DNA, 50 bp, homo sapien
ttacaaagaagggaagcaggtaattytgaagcaagtaatactgattctcc

SEQ ID NO: 115666 - DNA, 50 bp, homo sapien
ttactctttctgctgtgcttatactrtgactgaatgtagtttcaaggtga

SEQ ID NO: 115667 - DNA, 50 bp, homo sapien
ttgtttattcagacaatggcacatayattggttaactgacttctacttac

SEQ ID NO: 115668 - DNA, 50 bp, homo sapien
ctccccaggggactggctagcttaayagtcatctattcttaaaggcctta

SEQ ID NO: 115669 - DNA, 50 bp, homo sapien
gcgcttagtagccttagaagcatcaygtatttcgaaagtggtattttacc

SEQ ID NO: 115670 - DNA, 50 bp, homo sapien
aggtacaggtagacacatgctcttaygtataacttcaacagttcatagat

SEQ ID NO: 115671 - DNA, 50 bp, homo sapien
taagataaaacagattttaaaccaaygatagtaaacatggacaaagaagg

SEQ ID NO: 115672 - DNA, 50 bp, homo sapien
caagcaagccgtcagcctcactagartctaaaatggtaaaggttctataa

SEQ ID NO: 115673 - DNA, 50 bp, homo sapien
atttcttgctgcctctcgcaaatccstgagtactctctcagaccaaaaaa

SEQ ID NO: 115674 - DNA, 50 bp, homo sapien
ttgaggggaaaaatctaatggcaccrataaaatggaggataataatatct

SEQ ID NO: 115675 - DNA, 50 bp, homo sapien
attttgacagcttttgatgcctccawatagattgcttttctagtagttcc

SEQ ID NO: 115676 - DNA, 50 bp, homo sapien
atcatcttagctcaaccatatatgarcgtccctcggttagcctgcctaaa

SEQ ID NO: 115677 - DNA, 50 bp, homo sapien
caagtagtagaaatacaaaagccaayggtgagaaagaagtaagtatgtga

SEQ ID NO: 115678 - DNA, 50 bp, homo sapien
aattatcaacttatgcttacaatgtraacgtgtaatagtcaatttaaggt

SEQ ID NO: 115679 - DNA, 50 bp, homo sapien
tattttcctgtaaacaaatatggacygtagctgaatatgtggaggttaaa

SEQ ID NO: 115680 - DNA, 50 bp, homo sapien
ctccattaccctgctttggacaccartcatatcacttctatccaactatt

SEQ ID NO: 115681 - DNA, 50 bp, homo sapien
tgttgggaggaaggagagtggatacratgtatggaggcaaagggcaagga

SEQ ID NO: 115682 - DNA, 50 bp, homo sapien
aaattgtccccacatatgattctaaragctaacaaaagaggcattttagt

SEQ ID NO: 115683 - DNA, 50 bp, homo sapien
actctagctcaaagcaacattatacrcaagacaataactcattcccctca

SEQ ID NO: 115684 - DNA, 50 bp, homo sapien
gacacagggatacagaaaggggtgayagtcatgtaaaagacaagaagaaa

SEQ ID NO: 115685 - DNA, 50 bp, homo sapien
ctagaaggtaatggggaatattgaarcaaggcaataatagcagatttgag

SEQ ID NO: 115686 - DNA, 50 bp, homo sapien
tggtcttcctggtccttgacgatacraatatagaataccagtctgtgaag

SEQ ID NO: 115687 - DNA, 50 bp, homo sapien
ctgatgaagaccctgatgataaaaaygcaccctttcggcaacggccattt

SEQ ID NO: 115688 - DNA, 50 bp, homo sapien
tatgcttctttttgttactacattgmgatacaccagtctaatgtgcattt

SEQ ID NO: 115689 - DNA, 50 bp, homo sapien
gttccatttagctaacatgcaaataygtacaattggaaactgaaacagca

SEQ ID NO: 115690 - DNA, 50 bp, homo sapien
gtaaatttatttagtgttttaaagcrcttctagctctctgtagtcttata

SEQ ID NO: 115691 - DNA, 50 bp, homo sapien
ggaagttcgctggacagttttgttgsattaaattgtgtaggtgacatgtc

SEQ ID NO: 115692 - DNA, 50 bp, homo sapien
aaaacagacctgttctatgatagccragagttcaggaacactacagctcc

SEQ ID NO: 115693 - DNA, 50 bp, homo sapien
ccagagcaattccatatttttaagckgcaatttcacacatgtatagtaaa

SEQ ID NO: 115694 - DNA, 50 bp, homo sapien
cacatgatatttacagcagtgtaatsataaataagcagattccttacata

SEQ ID NO: 115695 - DNA, 50 bp, homo sapien
ctttgtgactacctacctaatcaaamctctattggctttcaaactaatgg

SEQ ID NO: 115696 - DNA, 50 bp, homo sapien
ttagcattatggtgttatggtgttaycgttctttgcatgtaacatgtagc

SEQ ID NO: 115697 - DNA, 50 bp, homo sapien
gtattgttttgtaactcagttcacaytgtatgttattagtcttttaaata

SEQ ID NO: 115698 - DNA, 50 bp, homo sapien
agaaaaatattgaatataattggtgwaagcagatatacgtgacttctttc

SEQ ID NO: 115699 - DNA, 50 bp, homo sapien
acaagacttgtttccccgaggcatcrgttactatcaccaacagtctctat

SEQ ID NO: 115700 - DNA, 50 bp, homo sapien
gctatttatacatacactgtgtgacycagaatacataggcttacaaaagt

SEQ ID NO: 115701 - DNA, 50 bp, homo sapien
gcaatgtctaaaaatatgtaaggacwatgtaccactgtcatatgggattt

SEQ ID NO: 115702 - DNA, 50 bp, homo sapien
taaaagggaaaagcctgtaatttaasagaacaaactgaagatgtaattaa

SEQ ID NO: 115703 - DNA, 50 bp, homo sapien
gtgtcacataggatctggtgtaaggycatagctatagataaggaaaggta

SEQ ID NO: 115704 - DNA, 50 bp, homo sapien
tattgaacttagattcaggagaacayggtggttgaatgataactaatttg

SEQ ID NO: 115705 - DNA, 50 bp, homo sapien
ggttgccaagtcccatccacatgtarggaattcttattagaaaaggttga

SEQ ID NO: 115706 - DNA, 50 bp, homo sapien
gtccatagaaatttctaaggatccaratatttattctcagttgtgcaatg

SEQ ID NO: 115707 - DNA, 50 bp, homo sapien
gggaagtcagagaagatgcatgctargacagagaggaatgcctgcctttc

SEQ ID NO: 115708 - DNA, 50 bp, homo sapien
ataaatctttactggatactgggtamatctcaaaatgaaccaaaaccata

SEQ ID NO: 115709 - DNA, 50 bp, homo sapien
atttacacatactatttagcccagaytattcatatactacatatatgcct

SEQ ID NO: 115710 - DNA, 50 bp, homo sapien
tctttttctgcctcagtgtgtttgakacaaccattacttatgctgtttca

SEQ ID NO: 115711 - DNA, 50 bp, homo sapien
tccctttgccctactgactctaacarggcctgaagcactaagagaaatcc

SEQ ID NO: 115712 - DNA, 50 bp, homo sapien
tggagggtctggaaaagaaatccaaygtgcactgccactccaggtaaaga

SEQ ID NO: 115713 - DNA, 50 bp, homo sapien
gaaaaagtttgccaataccttctctmaataataggaaagtgaaaaaatat

SEQ ID NO: 115714 - DNA, 50 bp, homo sapien
atcaggttgcttgtctgttctaccarggactcggtttccattacctactg

SEQ ID NO: 115715 - DNA, 50 bp, homo sapien
aggtttaactcagaagcaaatctcasataggtgataaaccttgccagaca

SEQ ID NO: 115716 - DNA, 50 bp, homo sapien
aatttcaccaactctcctctcagtcrctttctatctcatgaccctgtgta

SEQ ID NO: 115717 - DNA, 50 bp, homo sapien
agaaagtggatggaaaagtaaaggcractatttcctgcacctcaggtatg

SEQ ID NO: 115718 - DNA, 50 bp, homo sapien
tttcaaggatcttgcaatatcgttaracagatgatatgtatagacatgaa

SEQ ID NO: 115719 - DNA, 50 bp, homo sapien
tcttattaatttctgctgtattatamgcccattattttattcattcctaa

SEQ ID NO: 115720 - DNA, 50 bp, homo sapien
tcatggatttattagtgtcttttcaytactaaccgtaatgagctccaaaa

SEQ ID NO: 115721 - DNA, 50 bp, homo sapien
tcatcataaaacaagatcctgaaatyataccatactgattattacctatt

SEQ ID NO: 115722 - DNA, 50 bp, homo sapien
ttcttctgttttctattcatattacmaagtctctgttattataactcctg

SEQ ID NO: 115723 - DNA, 50 bp, homo sapien
ttgacttttagaaaggtttaggtacrctgataaatggtgaacaactgttg

SEQ ID NO: 115724 - DNA, 50 bp, homo sapien
gatgcagaaggaattttgctctatakccccgacagctggtagggtgctga

SEQ ID NO: 115725 - DNA, 50 bp, homo sapien
aggtagcaaattctcatcaacttcaytcttattaatcacctatctaaatg

SEQ ID NO: 115726 - DNA, 50 bp, homo sapien
aaatgtataatttattttacaatagrcccttgatcattcacaaatttaac

SEQ ID NO: 115727 - DNA, 50 bp, homo sapien
tttctgtgcagacatctatatgtacmaggacaaacattgcaactttatta

SEQ ID NO: 115728 - DNA, 50 bp, homo sapien
tttttcaagattgttttgcctatcaygaggccctggtatttccatatgaa

SEQ ID NO: 115729 - DNA, 50 bp, homo sapien
acctccactgtccccaaaagaaataygtgatcttatgccaagcctctttc

SEQ ID NO: 115730 - DNA, 50 bp, homo sapien
aagattacaataccagaggcaagacrattaagaggaatgaacaccaaaaa

SEQ ID NO: 115731 - DNA, 50 bp, homo sapien
atgtgcaacatagatctcacacataygtagttcacaatagagtttgcact

SEQ ID NO: 115732 - DNA, 50 bp, homo sapien
tttatttggttagattttattttacrggatggtgataatgctaatagata

SEQ ID NO: 115733 - DNA, 50 bp, homo sapien
aacaagtctagatgagatgaaataaygcctattttgcctaaaacttgcta

SEQ ID NO: 115734 - DNA, 50 bp, homo sapien
tattatctggttctaaataaccaatsaagttaatgaattcgaccacttat

SEQ ID NO: 115735 - DNA, 50 bp, homo sapien
acaatattaatctctcttagttcttygacctctctgactagttttttttc

SEQ ID NO: 115736 - DNA, 50 bp, homo sapien
agcaccagaataaactctggacaaaygtatcctcttctttatattgctat

SEQ ID NO: 115737 - DNA, 50 bp, homo sapien
ttctaaaattcatatgccattgcaargaaccctcaatatcaaaaagtttt

SEQ ID NO: 115738 - DNA, 50 bp, homo sapien
ctaaggtcaataacatagttgaagtraaataatataatcaggttggatgt

SEQ ID NO: 115739 - DNA, 50 bp, homo sapien
atggactaggacttctactactgtamtaaataaaagtagtgggaaattaa

SEQ ID NO: 115740 - DNA, 50 bp, homo sapien
gttaacaaatattttaactaaactcraattcaatattacacatgccaaaa

SEQ ID NO: 115741 - DNA, 50 bp, homo sapien
aacagcctaaacttacatccagcatraagtttgatcaaccttgtcactct

SEQ ID NO: 115742 - DNA, 50 bp, homo sapien
ctatagagaacagctacattaaagcraattggaaattgtttagaaattta

SEQ ID NO: 115743 - DNA, 50 bp, homo sapien
cagtttctagctaatgctaaactccratttttaagagtccactgaagttc

SEQ ID NO: 115744 - DNA, 50 bp, homo sapien
tatggcctatcagtaagataagagcraagttgatgctgagaaccagaaac

SEQ ID NO: 115745 - DNA, 50 bp, homo sapien
aagtaaattctctgcctgatattcartagtccctctctccctcattacct

SEQ ID NO: 115746 - DNA, 50 bp, homo sapien
ttacaagattgctggaaggtctaackgtctatttcacaagcgtagttcca

SEQ ID NO: 115747 - DNA, 50 bp, homo sapien
tttctagggaaaatgctatttggatyaagtattcaccaagtgtttcctat

SEQ ID NO: 115748 - DNA, 50 bp, homo sapien
tgagtgaggttggactcaagagttaragcatctgcctagtggaagtctag

SEQ ID NO: 115749 - DNA, 50 bp, homo sapien
aaaaaatcacaattaagcaattataraatccactaatgtcaacagatttc

SEQ ID NO: 115750 - DNA, 50 bp, homo sapien
cttattcagttcttggcatcattgamcctttgaaaagaaggtgatatggt

SEQ ID NO: 115751 - DNA, 50 bp, homo sapien
tctgagagcctgcaaagttggcaccrcgtggatactaccgagatgtatgg

SEQ ID NO: 115752 - DNA, 50 bp, homo sapien
acatttttcctagagggagatataasctgtctgcaaagcaaatgaacctg

SEQ ID NO: 115753 - DNA, 50 bp, homo sapien
ttcctcctattagaaaaagattgatmagattcaggtttgcaatccattaa

SEQ ID NO: 115754 - DNA, 50 bp, homo sapien
ataagttctataataaataacaggastaagtcactagcaacaagaatatt

SEQ ID NO: 115755 - DNA, 50 bp, homo sapien
ttttcctttctctcatatatactcakgattttatgtttcccgcatagtat

SEQ ID NO: 115756 - DNA, 50 bp, homo sapien
agacacattgcaagtctttaagagcwacatgtggttatggttaccatact

SEQ ID NO: 115757 - DNA, 50 bp, homo sapien
aaacctatttccagattctccattcrttcttaagtgcaaaagacacagaa

SEQ ID NO: 115758 - DNA, 50 bp, homo sapien
agtcactgccttcaagttcactttgwattatgacagaattcttgctttgt

SEQ ID NO: 115759 - DNA, 50 bp, homo sapien
tgtaatagttaaacggattagaccasagtataccatggctttcttctgca

SEQ ID NO: 115760 - DNA, 50 bp, homo sapien
aaataaagccaactgcaatcattaarctaaatttgttgtagttttgtctt

SEQ ID NO: 115761 - DNA, 50 bp, homo sapien
ttttacatgcttattatttctgtaaytgcatactaacaaagtgtatctaa

SEQ ID NO: 115762 - DNA, 50 bp, homo sapien
ttagtgagtaaacacaaaaccgcaaycttcaggaagtagaaatcagatac

SEQ ID NO: 115763 - DNA, 50 bp, homo sapien
aacaagacatagaattgataattagratgccataatgtactagggtactg

SEQ ID NO: 115764 - DNA, 50 bp, homo sapien
cacagaaagtggggcactgctgtaaygatatctaaaaatatgacaaagtt

SEQ ID NO: 115765 - DNA, 50 bp, homo sapien
ctcttccccatcaactcttgagactmaaaaccatgtatctcagctatttg

SEQ ID NO: 115766 - DNA, 50 bp, homo sapien
ggtgcattttataaggagactgtacwatgatttgtgtcctaccatctcta

SEQ ID NO: 115767 - DNA, 50 bp, homo sapien
ttaaaaagggaaaggaactattcagsatcaagagacgtaaaaaacatgaa

SEQ ID NO: 115768 - DNA, 50 bp, homo sapien
aacataatttaatttacgatcttatsagctattgccctgaaattattaag

SEQ ID NO: 115769 - DNA, 50 bp, homo sapien
ttttgcagctattgtgtaatattcawcaaccaggatccctacggattgtc

SEQ ID NO: 115770 - DNA, 50 bp, homo sapien
gtggagcagacactgtagtaggagarcttgatgaaatatttggaaaatgc

SEQ ID NO: 115771 - DNA, 50 bp, homo sapien
cagctttgcaccaccgtgctttgaaygtatactttgctttctaccaatac

SEQ ID NO: 115772 - DNA, 50 bp, homo sapien
ttttattgaattgtaggtcatgtaaygaaggttttccatatatctcatag

SEQ ID NO: 115773 - DNA, 50 bp, homo sapien
aaaatctgtgtttcaaaataaagccrattacataaaggcatgacatttcc

SEQ ID NO: 115774 - DNA, 50 bp, homo sapien
agagtgaaagaggaacactgtataaytccctttaaagcatttattatttt

SEQ ID NO: 115775 - DNA, 50 bp, homo sapien
gaatgcagaaagtgaagtttcagtayatgacttctgtattagtttcctat

SEQ ID NO: 115776 - DNA, 50 bp, homo sapien
tgaaaaggctttcctggagtgagacmaaacccttgaatataccagttaca

SEQ ID NO: 115777 - DNA, 50 bp, homo sapien
taaggaacttatagaccagtatatamgattttgtgttgtttcaagtgtgc

SEQ ID NO: 115778 - DNA, 50 bp, homo sapien
atatgagacagaccctgagaaaatartatcgttggcagacaggctggcag

SEQ ID NO: 115779 - DNA, 50 bp, homo sapien
ttaagtcagacttttgttcaattgayctgaaaattttctacttatacaga

SEQ ID NO: 115780 - DNA, 50 bp, homo sapien
aggcttttctctggagcaggagttarctttacactaaatgtagacaagaa

SEQ ID NO: 115781 - DNA, 50 bp, homo sapien
aatctgtcatataggctttcctgtaygttttcactaggacttgttctttt

SEQ ID NO: 115782 - DNA, 50 bp, homo sapien
tcaagcttaattgaatatgtacataraatagtcaagttaggcaatcatgt

SEQ ID NO: 115783 - DNA, 50 bp, homo sapien
ctagccttggatcctctgttgaaagycaatgggtgtgggttttcagcaac

SEQ ID NO: 115784 - DNA, 50 bp, homo sapien
acatttaggctatccagcttctctgmataatttttagccagttggatgaa

SEQ ID NO: 115785 - DNA, 50 bp, homo sapien
gtatctttttaatgctttgttttaaygaggagtggcactcagctatcatg

SEQ ID NO: 115786 - DNA, 50 bp, homo sapien
gaatggacatggatcattaactagamgagaatggatttttttaattcctt

SEQ ID NO: 115787 - DNA, 50 bp, homo sapien
caccagaggtgaggcttcgtcagcaygtacaaatggggcagaacagacta

SEQ ID NO: 115788 - DNA, 50 bp, homo sapien
gataaattgtagagagattggatgaraacagtcttgggcagaaaaaagta

SEQ ID NO: 115789 - DNA, 50 bp, homo sapien
tcaggatggagacccctgctctatawgattggaaatgtcactttcagtat

SEQ ID NO: 115790 - DNA, 50 bp, homo sapien
gctatatacctatgaaactattaaasaagaactgaagttgatttagaaat

SEQ ID NO: 115791 - DNA, 50 bp, homo sapien
tggggaaggaggtgacagcttaatasgagatttaccacaagagaatcagt

SEQ ID NO: 115792 - DNA, 50 bp, homo sapien
ctaatgcaacaatgttatataaagargcacatgatgagaatttttagaga

SEQ ID NO: 115793 - DNA, 50 bp, homo sapien
tttcttatttccttcctcatctatcrcccaattctaacagctcttcctat

SEQ ID NO: 115794 - DNA, 50 bp, homo sapien
aaagtaattgaaaatcaaaacgagtrgaaatgaaactataataggtattc

SEQ ID NO: 115795 - DNA, 50 bp, homo sapien
attctgaactaatgattgactaaatyactgagagcacctaaaaaggtagt

SEQ ID NO: 115796 - DNA, 50 bp, homo sapien
gaaagaaacaaggaacaagtggttaraggcaattagaagtgaaacaaagt

SEQ ID NO: 115797 - DNA, 50 bp, homo sapien
taaataaaaaaaataaaaagtagtcragtcgcttaatgtaaagccactta

SEQ ID NO: 115798 - DNA, 50 bp, homo sapien
tgtgtcaaatatagagaagtatgaawatggatcagagtgtaagaacaatt

SEQ ID NO: 115799 - DNA, 50 bp, homo sapien
tttgtactatagacatcaagtggtakgtaggtcaatagcaaatttaagta

SEQ ID NO: 115800 - DNA, 50 bp, homo sapien
tattccttatgtgtttgctaaaaatsagtcattatatacgtgattgaatg

SEQ ID NO: 115801 - DNA, 50 bp, homo sapien
gcatcctaagatattcctgtagatargcaactgaacagtactgccaaatc

SEQ ID NO: 115802 - DNA, 50 bp, homo sapien
tcacacattgagatggaaaagctgastataatgcctctctttgtaattgt

SEQ ID NO: 115803 - DNA, 50 bp, homo sapien
gcaagcagctgtttaaatatgcaagrcactatccggaaagagaaaaaggg

SEQ ID NO: 115804 - DNA, 50 bp, homo sapien
tgagaggcatattttctgctcatccrgaataatgaatgggtgagtcaacc

SEQ ID NO: 115805 - DNA, 50 bp, homo sapien
catactgttgaccctctctaaaacckacatcccaatcagtgcagataatc

SEQ ID NO: 115806 - DNA, 50 bp, homo sapien
aagtgctgcccaattaattgcctaaytgggtatgatgctgtatattgaga

SEQ ID NO: 115807 - DNA, 50 bp, homo sapien
gactttttcatatggtgactgataaytacccactctcagtccatgttcag

SEQ ID NO: 115808 - DNA, 50 bp, homo sapien
cctgctcagcctccttactcaattcrctctcccctcttcacctgcaccaa

SEQ ID NO: 115809 - DNA, 50 bp, homo sapien
tttctgttctgaaaaactaagatccmtatgccaaatctggaatggcctca

SEQ ID NO: 115810 - DNA, 50 bp, homo sapien
tagctgatacacactgttttagaacyatagctttactcaaaataatttta

SEQ ID NO: 115811 - DNA, 50 bp, homo sapien
ggttgtgaaggactgctttaatgcamaccattcccagagtttggaaagtg

SEQ ID NO: 115812 - DNA, 50 bp, homo sapien
ttctacatctatgctttcaaagtaawacactgatatatcatttcatctcc

SEQ ID NO: 115813 - DNA, 50 bp, homo sapien
ttaccagaaaacttttggactgatayattttacttatgattatttgtcat

SEQ ID NO: 115814 - DNA, 50 bp, homo sapien
gactcaagatcagccctgtggaataygtaagccctgtggatgataaccat

SEQ ID NO: 115815 - DNA, 50 bp, homo sapien
accctagggcttaatatgccatctayctagggatatggtaccacctttat

SEQ ID NO: 115816 - DNA, 50 bp, homo sapien
tttgctctggaaaatgatagtttcartatatttcaatgctgtttgtttta

SEQ ID NO: 115817 - DNA, 50 bp, homo sapien
gagttaagagacaggagtcaacaacmagtttaggtagagaagacttcagt

SEQ ID NO: 115818 - DNA, 50 bp, homo sapien
tatagattggtggttgccaggatgcyatactaccttataaaggagggcta

SEQ ID NO: 115819 - DNA, 50 bp, homo sapien
gtttttggactagggtctatgaatargatcaagtggttcataaaacctct

SEQ ID NO: 115820 - DNA, 50 bp, homo sapien
ataggtaaatgatttctttatctctsaaatcatgccaaattggtacatca

SEQ ID NO: 115821 - DNA, 50 bp, homo sapien
aggaccaaggatttcataaagtaaasgaagtctttggaatcatccaagat

SEQ ID NO: 115822 - DNA, 50 bp, homo sapien
tctggcaattcaataggaattcagasaagatgaagtaagtaagagcctag

SEQ ID NO: 115823 - DNA, 50 bp, homo sapien
ctaacaggattctaaagatttctatyagggtagtgaccagagcataacat

SEQ ID NO: 115824 - DNA, 50 bp, homo sapien
tattcagagagtacagtgaagcttaraataaaggtaatttctaacaatca

SEQ ID NO: 115825 - DNA, 50 bp, homo sapien
tacagggctgtgttgtggatcataartatcagtgagtggtgaagagtaca

SEQ ID NO: 115826 - DNA, 50 bp, homo sapien
atgagaagtgtgagaaagcccacctraaatgatgatcacagagctgctgc

SEQ ID NO: 115827 - DNA, 50 bp, homo sapien
acctaaccccaagctgcaaagctcasaactccaaaaatgcccacttcttt

SEQ ID NO: 115828 - DNA, 50 bp, homo sapien
tttaaaaattacaaaagagctattasgttgtgaagaaatttcagtgttac

SEQ ID NO: 115829 - DNA, 50 bp, homo sapien
atactttccatatctattattcctaygtgtttcttttatgtaatttctac

SEQ ID NO: 115830 - DNA, 50 bp, homo sapien
tggggaaaagagaagtgtatttgcasaagaatttaatagccacagaagca

SEQ ID NO: 115831 - DNA, 50 bp, homo sapien
agaagatagacacaaccagttaagamgttctatactgttctagaatactg

SEQ ID NO: 115832 - DNA, 50 bp, homo sapien
tggctagtctcttaaattatatccaytattcagataaatgttgcatgcct

SEQ ID NO: 115833 - DNA, 50 bp, homo sapien
ctaaaatctgagtacagagaatctcrtttcttgactaagcaaatatgcat

SEQ ID NO: 115834 - DNA, 50 bp, homo sapien
gctctgattgctacttagactgagtraaagtattgctgaataaggtgctg

SEQ ID NO: 115835 - DNA, 50 bp, homo sapien
caggccagccaaagagtgattcataygagagatgacagtgaagatgagtg

SEQ ID NO: 115836 - DNA, 50 bp, homo sapien
gtatcatagaaacactaaagctttamcaagagtttacagaaatggcaggg

SEQ ID NO: 115837 - DNA, 50 bp, homo sapien
tttaacaagtatatttttaacatcartgaacctttaatgagtgcctacta

SEQ ID NO: 115838 - DNA, 50 bp, homo sapien
ggtactgaaagtagtgaatgcctaartatatgagagtggctggggaaacc

SEQ ID NO: 115839 - DNA, 50 bp, homo sapien
tccctgaagatcctgtactttgtagscctctgacatttggatgtggattt

SEQ ID NO: 115840 - DNA, 50 bp, homo sapien
ccaagcactagaatcacaataggcaragaagaaacatggtggcatcgtca

SEQ ID NO: 115841 - DNA, 50 bp, homo sapien
tataagtttagtctatggcggaacaytaaccggtctttattgcccccttg

SEQ ID NO: 115842 - DNA, 50 bp, homo sapien
tagtttggagattgcctgtcataccraagtttaggttcttaagtattttc

SEQ ID NO: 115843 - DNA, 50 bp, homo sapien
tttttctccataagtccgcaaattayattttttactgaaatcatctaaag

SEQ ID NO: 115844 - DNA, 50 bp, homo sapien
tctgctgaaaaatctgttgacgatckattagaagcgcacttttaaatgac

SEQ ID NO: 115845 - DNA, 50 bp, homo sapien
tatgctgtttactgttggccgtagckttaagtgtcagaagctaaaatttc

SEQ ID NO: 115846 - DNA, 50 bp, homo sapien
tgaaattgccagtatatctcaggaartaagggaaagcattcattagacgt

SEQ ID NO: 115847 - DNA, 50 bp, homo sapien
gtcagtgagtctaacatgaatccaasgcagaatatatttaataataaggc

SEQ ID NO: 115848 - DNA, 50 bp, homo sapien
ctaatgcatgtctctcaggcctcaamgtgaaactaggcaggtggatctga

SEQ ID NO: 115849 - DNA, 50 bp, homo sapien
agttctatcctcaaatgctatataamccaactggtggaaaaaaattttaa

SEQ ID NO: 115850 - DNA, 50 bp, homo sapien
tacgaacctgttggtcttctaacacrgagaataatttgtaaattgtttca

SEQ ID NO: 115851 - DNA, 50 bp, homo sapien
tggcttctttactcccatataaaackaacaatgatcatagaaaatgtgtc

SEQ ID NO: 115852 - DNA, 50 bp, homo sapien
gaagggaaatttctttagtgtctaayaatatctcgtggaatactagcatt

SEQ ID NO: 115853 - DNA, 50 bp, homo sapien
ttcatgcactccaaagcagtaatgamagagtaaatgtatggaaataggga

SEQ ID NO: 115854 - DNA, 50 bp, homo sapien
ccatggatacaaggagactgtcttaygtgtttactaactaaatgaaaaat

SEQ ID NO: 115855 - DNA, 50 bp, homo sapien
atctggatgtctcttggcttagagaygcacttgaggtatcaaaatggttg

SEQ ID NO: 115856 - DNA, 50 bp, homo sapien
taggattctggtttacctctctacargtctttttaatccttacttgaata

SEQ ID NO: 115857 - DNA, 50 bp, homo sapien
aaactcgtcagataaaagctagtaartgtcgactggttgcggtagctcac

SEQ ID NO: 115858 - DNA, 50 bp, homo sapien
tgttcttactttcaggaaaccaagastacgttagaaatcttcaataaaaa

SEQ ID NO: 115859 - DNA, 50 bp, homo sapien
tactagaggactgttgcatatagacscagtagtcatgtcttcaattcttt

SEQ ID NO: 115860 - DNA, 50 bp, homo sapien
tataccttctcttttcttctcacatkgaaggagacttttctctttcgtat

SEQ ID NO: 115861 - DNA, 50 bp, homo sapien
ttttctgaatgtatagttattataartgggtttgatgaaaaaggagaaga

SEQ ID NO: 115862 - DNA, 50 bp, homo sapien
ctgcatgaaatcatccttcctctacygactttttttcatggcctattccg

SEQ ID NO: 115863 - DNA, 50 bp, homo sapien
aacctttaggtagatgttgttagtaraaggtctaggctagggaattccca

SEQ ID NO: 115864 - DNA, 50 bp, homo sapien
gaagcctatgcagaatgggtatagaktcaggagtttggagtgcagaggga

SEQ ID NO: 115865 - DNA, 50 bp, homo sapien
gtgacagccatattgatcctgaggascaaaaccttaagtcgtaaatattt

SEQ ID NO: 115866 - DNA, 50 bp, homo sapien
tgcgttgtagaattacaggctatgayagtcagaaagaagggggtgaggga

SEQ ID NO: 115867 - DNA, 50 bp, homo sapien
aaaaaaattagaaattaagacatgcracagatacctgggtgactggttta

SEQ ID NO: 115868 - DNA, 50 bp, homo sapien
ggaattctagtataacttgaaatgarcttttgagtagaacaatcatgagt

SEQ ID NO: 115869 - DNA, 50 bp, homo sapien
ccagaaaaaacatgacctcactacaractaaacaaggtaccaatgatcag

SEQ ID NO: 115870 - DNA, 50 bp, homo sapien
ctgatttcaattgttttcggacaatraagagctttgcaatgtcgaggaca

SEQ ID NO: 115871 - DNA, 50 bp, homo sapien
gagggaattacagctgccgatattaygacttttctatctggtctgagccc

SEQ ID NO: 115872 - DNA, 50 bp, homo sapien
ggaacatgggttctatttgagagatyaattatttaaggcaagtggcagga

SEQ ID NO: 115873 - DNA, 50 bp, homo sapien
agactatggtctcaaaaccaggagasatgattaaatttaaggtaacaggc

SEQ ID NO: 115874 - DNA, 50 bp, homo sapien
gtaatttctcttcttcacctctgtascaatgctgtagcagaaaaaaagat

SEQ ID NO: 115875 - DNA, 50 bp, homo sapien
tgtatcctagaacctcctaaaggacrctcagataaacggccaactaaaga

SEQ ID NO: 115876 - DNA, 50 bp, homo sapien
aagcggaactattatagatgtataarcaatattctatgaaaatgcaaata

SEQ ID NO: 115877 - DNA, 50 bp, homo sapien
tttttgttttaaggcagcagtagtcrgaaatttaaagttcagaagtcgag

SEQ ID NO: 115878 - DNA, 50 bp, homo sapien
gtgaattggttcaagaagaatactayagcaataaggagtggtgaggcctg

SEQ ID NO: 115879 - DNA, 50 bp, homo sapien
tttgtgacatgtgaaagttgtatgarattatatgaaattcacatttcatt

SEQ ID NO: 115880 - DNA, 50 bp, homo sapien
ctcaccaacataaatgaaaatatacsgcaacatctatacatgcacatgta

SEQ ID NO: 115881 - DNA, 50 bp, homo sapien
ctgcacaagacaggtagactcagaawtgtctccgcaatctggggtagaga

SEQ ID NO: 115882 - DNA, 50 bp, homo sapien
caagaagagctcaaaattaggaggaygtaaatgttatcaggaaaagaaac

SEQ ID NO: 115883 - DNA, 50 bp, homo sapien
aattcagattccatggattagctcastcagtatactggtaaaaaactcag

SEQ ID NO: 115884 - DNA, 50 bp, homo sapien
gaatggggtccaggcctgttaccagratttggccaacagtgagtgaaaag

SEQ ID NO: 115885 - DNA, 50 bp, homo sapien
aggaaaaatgaattaagcaaagttayatgttatgttgataaaatacaaaa

SEQ ID NO: 115886 - DNA, 50 bp, homo sapien
aataacgatgattgatgattaattgraaatattgaattcacatgccctac

SEQ ID NO: 115887 - DNA, 50 bp, homo sapien
tcataaaacatacagaactataataygcttttcttgtgatgtccttgtct

SEQ ID NO: 115888 - DNA, 50 bp, homo sapien
gatagtcatgataactttagataaaygcttcaggaaatttcacattgtac

SEQ ID NO: 115889 - DNA, 50 bp, homo sapien
gctactagcttgcttggaactcagaygtgtttaaattatatcctgattgg

SEQ ID NO: 115890 - DNA, 50 bp, homo sapien
ccctgtgctcattccgaagcagctaygataaaaagaattttcattgttct

SEQ ID NO: 115891 - DNA, 50 bp, homo sapien
ctaaagaaaaattatattggatatcktgaattgtctgtttgaaacttgtc

SEQ ID NO: 115892 - DNA, 50 bp, homo sapien
catattccataaaaccatagggcccmataaatggtcaaatgtatttaaat

SEQ ID NO: 115893 - DNA, 50 bp, homo sapien
atacaaaattttggttgagtgaaacyatgaataaaacaatagtttgagct

SEQ ID NO: 115894 - DNA, 50 bp, homo sapien
gagaattaccaacacataagatggasactctcactgttctattctagatc

SEQ ID NO: 115895 - DNA, 50 bp, homo sapien
ttccttccattgcccttggaccatasacggtgcttgtggtgagatgccac

SEQ ID NO: 115896 - DNA, 50 bp, homo sapien
ttttttttttttttttggcaatttascgtttccagccttgagtgagaggg

SEQ ID NO: 115897 - DNA, 50 bp, homo sapien
tacaacaacccctacatcatttaggygtctaaaggtgacactgatccctg

SEQ ID NO: 115898 - DNA, 50 bp, homo sapien
cacagtttagaactatggatacctgkgttctaatcttaacagaagcactt

SEQ ID NO: 115899 - DNA, 50 bp, homo sapien
gttttaaagctttaatggtttggaasagttagtagagttagctcagactt

SEQ ID NO: 115900 - DNA, 50 bp, homo sapien
cattttcatagaaatcaagataaaartatcaaaagcataaagtcatggtt

SEQ ID NO: 115901 - DNA, 50 bp, homo sapien
tctcacttcaatactctttatataaycacatggcaatataagcaaaacca

SEQ ID NO: 115902 - DNA, 50 bp, homo sapien
aaaaaataatttagagtttaaaatayaactacaagacatttagaaaaata

SEQ ID NO: 115903 - DNA, 50 bp, homo sapien
tggggtttgtaatgacctcatttcakaaaatatttcctataattcttata

SEQ ID NO: 115904 - DNA, 50 bp, homo sapien
aaatactgagtttattcttcaatgcrgatagatgaaaatttcactttagc

SEQ ID NO: 115905 - DNA, 50 bp, homo sapien
tcacctcaagcttccttaatgacaaytcttatctactaaacagaacctaa

SEQ ID NO: 115906 - DNA, 50 bp, homo sapien
tcacctatatcattagaaatcaacawtaaagccagaaagcctgactctga

SEQ ID NO: 115907 - DNA, 50 bp, homo sapien
atgatgtagctctttcttacgttaawcacctaatcttgtgccactttctc

SEQ ID NO: 115908 - DNA, 50 bp, homo sapien
acatggtatattgtaagtgctcaaaygttaatgactattataatgatctg

SEQ ID NO: 115909 - DNA, 50 bp, homo sapien
ttcgccaatctaaagagggtcattcsactgaagttgctatatagctgaga

SEQ ID NO: 115910 - DNA, 50 bp, homo sapien
gggtcagaagggaacagaatgtttaygggccttcagaggactgtcactag

SEQ ID NO: 115911 - DNA, 50 bp, homo sapien
aattatagatggaggcactttgttgrattaagcttcttgataacaggaat

SEQ ID NO: 115912 - DNA, 50 bp, homo sapien
ggcactattagagacaccacgtttayagcacggaagaaaaaagttcttgc

SEQ ID NO: 115913 - DNA, 50 bp, homo sapien
tggtatacattaataaaaatgtcaasaatattatctctgggaggtaacct

SEQ ID NO: 115914 - DNA, 50 bp, homo sapien
atggctgacttgagaaactcgctcayactattgtgattttgcttttggtt

SEQ ID NO: 115915 - DNA, 50 bp, homo sapien
cttatacattagtatggagttcattsaaagaaataaagcccgggcacggt

SEQ ID NO: 115916 - DNA, 50 bp, homo sapien
tgggcatactgcccttgccattaacyattctctatctctgatccctagtc

SEQ ID NO: 115917 - DNA, 50 bp, homo sapien
agaaatatctgatgctgtcttcttcrctaaattttgattacatgatttga

SEQ ID NO: 115918 - DNA, 50 bp, homo sapien
gatgattatccccatttgacatatawgaatactacagcctgacagcagaa

SEQ ID NO: 115919 - DNA, 50 bp, homo sapien
tttataagctgatttggcctctaaayactaaatagtgataaaatgaccat

SEQ ID NO: 115920 - DNA, 50 bp, homo sapien
tttatttgtttttgttttatggatcmcatttagaactcttccactaacac

SEQ ID NO: 115921 - DNA, 50 bp, homo sapien
gattgcttgtggactgtagcactagwcttgtgaatttgaacccgtagctc

SEQ ID NO: 115922 - DNA, 50 bp, homo sapien
tctacatttttacccaattaattgaktaaaatgatgaagagaatatgatt

SEQ ID NO: 115923 - DNA, 50 bp, homo sapien
gccatatctacttaactaaataacakattagacatgacattaagcaattt

SEQ ID NO: 115924 - DNA, 50 bp, homo sapien
ccaccattttaccatctatcagctaygccatctttgaagttacttgctct

SEQ ID NO: 115925 - DNA, 50 bp, homo sapien
tagagaaatcctagtacttgtcactyaagtaatgcctatccctttattgc

SEQ ID NO: 115926 - DNA, 50 bp, homo sapien
cacagccctcataaggtcctgagaayatgtatccaatgtagtcggggagc

SEQ ID NO: 115927 - DNA, 50 bp, homo sapien
ccttgtgactaattgttatgaatgawatcccttttccttgctggctttaa

SEQ ID NO: 115928 - DNA, 50 bp, homo sapien
tcacaatgagaatctagcttgcaaawtatcttggtatcttgtgcccagtc

SEQ ID NO: 115929 - DNA, 50 bp, homo sapien
aattagagatattgtaagtcctgtaycttggaactcctaaatactggcag

SEQ ID NO: 115930 - DNA, 50 bp, homo sapien
gctttcagaaacataatggtccatartaatgaagaagattctgatcaggt

SEQ ID NO: 115931 - DNA, 50 bp, homo sapien
accaccatcactgctactgctactaygccccagactctctgtgctgctgc

SEQ ID NO: 115932 - DNA, 50 bp, homo sapien
gatgtactaacagaggttgttacacygacagcccacttaggctttcacca

SEQ ID NO: 115933 - DNA, 50 bp, homo sapien
caagaaaatattattcaattctttamgatcacttccattgtgtaaaaaca

SEQ ID NO: 115934 - DNA, 50 bp, homo sapien
ctataccctagaacaaatgtatatayggatacttatagaacattctaccc

SEQ ID NO: 115935 - DNA, 50 bp, homo sapien
tactacagttttcactactctttccragatctttttaccaactgtccatc

SEQ ID NO: 115936 - DNA, 50 bp, homo sapien
atctacttctttttcattcaatgcarcagtcttatagtagagttatgtgg

SEQ ID NO: 115937 - DNA, 50 bp, homo sapien
gcacaggatgggtccaatagtaacaygaaaacaacagatgtctgcaaatt

SEQ ID NO: 115938 - DNA, 50 bp, homo sapien
gagtagaaaaactacagtcagatcaygcaaagaataaaggttagaattaa

SEQ ID NO: 115939 - DNA, 50 bp, homo sapien
cccatgcagacggagttagttatacygatcttcattttgacctagtggca

SEQ ID NO: 115940 - DNA, 50 bp, homo sapien
cactgggttccatgcaccccaattaygctggctctgaggccaacacagca

SEQ ID NO: 115941 - DNA, 50 bp, homo sapien
ttaaggttatacaaatgcaaccctgrattaaatcaattatcttcttatta

SEQ ID NO: 115942 - DNA, 50 bp, homo sapien
gctctagatgctatggagctttaaastacgtgatgcctttcatctagcaa

SEQ ID NO: 115943 - DNA, 50 bp, homo sapien
acaaccaggaccacagaccttcacayttatacagcaatgaggccactaag

SEQ ID NO: 115944 - DNA, 50 bp, homo sapien
tgttctagctttgcaaggatagagcragagtaagaatcaacagaggggag

SEQ ID NO: 115945 - DNA, 50 bp, homo sapien
acatgaagtagtaatgtttcttccasaatagttagttgtgtttcattgct

SEQ ID NO: 115946 - DNA, 50 bp, homo sapien
gattaaatgaattttggcagtagaaytgggagaacttgatgtgattattg

SEQ ID NO: 115947 - DNA, 50 bp, homo sapien
tctattttctgttttatcaccataaytgtcacttgtcttaattcctagta

SEQ ID NO: 115948 - DNA, 50 bp, homo sapien
atattattttgaagcaaatcctatayatcatttaatttcatccataaata

SEQ ID NO: 115949 - DNA, 50 bp, homo sapien
ggcaacagagaacgtgatgaagaacrctatggggaaagactcatctgctg

SEQ ID NO: 115950 - DNA, 50 bp, homo sapien
aagtaatagttgttggtagtaattgsatcataaaacctttcaaatgagtt

SEQ ID NO: 115951 - DNA, 50 bp, homo sapien
ctatctaaaagacatacacatttgcraggtaaataagagaaaaaccaaaa

SEQ ID NO: 115952 - DNA, 50 bp, homo sapien
ggatctaactttggaaaaaaatgaaytatacaggctgccttagatataag

SEQ ID NO: 115953 - DNA, 50 bp, homo sapien
catagtattccctttcatcctatccraagtctgaaaaagaagatggtcag

SEQ ID NO: 115954 - DNA, 50 bp, homo sapien
agtttgatactttctcaaaggaaacragtaagctgaaaaagtagaagtct

SEQ ID NO: 115955 - DNA, 50 bp, homo sapien
caattggtgaggcagtgaggacatayataacattcattaagttcaccatc

SEQ ID NO: 115956 - DNA, 50 bp, homo sapien
gcataatattaaccttttggacttakagcatgactttgcagaataaatct

SEQ ID NO: 115957 - DNA, 50 bp, homo sapien
atctagacagagagctatgccttacrgattggcagcttggattggtgttc

SEQ ID NO: 115958 - DNA, 50 bp, homo sapien
gaggataacttttctgagctgaggaraaagctgaggatattgataaaatg

SEQ ID NO: 115959 - DNA, 50 bp, homo sapien
gcacattaagtaaaagccaaactaamactacagaaaataaaacaaaatcc

SEQ ID NO: 115960 - DNA, 50 bp, homo sapien
agtgccatggtaagtgatataaaaasgtgtgacattggactggaaatcag

SEQ ID NO: 115961 - DNA, 50 bp, homo sapien
actacacacaggtcactgtgctaagyagtgaagtcctcatggattgctgt

SEQ ID NO: 115962 - DNA, 50 bp, homo sapien
acacaaagaccaaatataaagaccarattttatcttcataaagactctat

SEQ ID NO: 115963 - DNA, 50 bp, homo sapien
aggaactctcacagaaatcataacaraaagtcaagacatagaaaatctaa

SEQ ID NO: 115964 - DNA, 50 bp, homo sapien
aattagatgaacccagcgcttatcartcatataacttggatgattttcaa

SEQ ID NO: 115965 - DNA, 50 bp, homo sapien
gttgttggtttttagcagactggatyacctacttaactgataaaagactg

SEQ ID NO: 115966 - DNA, 50 bp, homo sapien
cttctaatatatccacctcattgccyacagaaacgacaaaagttttgaaa

SEQ ID NO: 115967 - DNA, 50 bp, homo sapien
aagtctttcccttgtgtagagtagaycataggtgctcaaattaagttgaa

SEQ ID NO: 115968 - DNA, 50 bp, homo sapien
cctgaaagattcacagctaagacaargactcaaattcatctgctgtacat

SEQ ID NO: 115969 - DNA, 50 bp, homo sapien
cacctaggcattccttctactcagarcaccttatccttttttttaaccct

SEQ ID NO: 115970 - DNA, 50 bp, homo sapien
tattatattttctctacttgaaatawctcccatatcactttaaacttctt

SEQ ID NO: 115971 - DNA, 50 bp, homo sapien
caatgtaaaaaatgcatttcaatgakagtggtattacaacatttaactgt

SEQ ID NO: 115972 - DNA, 50 bp, homo sapien
gtttggctaagtactggggtgttagragagaaggaatagtttaaaaattc

SEQ ID NO: 115973 - DNA, 50 bp, homo sapien
ctattgctgtaataaatcttagccakgagcatgactatgtgctgagccca

SEQ ID NO: 115974 - DNA, 50 bp, homo sapien
caaaaacagatctgcaataaccatcratattggaaccttatatatttatc

SEQ ID NO: 115975 - DNA, 50 bp, homo sapien
atacttgttgctggggaaaataagcrcgtcctgtgtgattgcactgggag

SEQ ID NO: 115976 - DNA, 50 bp, homo sapien
agttggtacctgaattcaaactaatmaaatgagtgataaagtaggaacat

SEQ ID NO: 115977 - DNA, 50 bp, homo sapien
ccttgccaattttaaatcatgcatartatcctatttgtatccctttctgt

SEQ ID NO: 115978 - DNA, 50 bp, homo sapien
tagggctacttctccctctctaatgyatcaaatccatgatcaattattgg

SEQ ID NO: 115979 - DNA, 50 bp, homo sapien
aagtgtgtttcttgtgagtgacaaaycattggttcttttttttatccatt

SEQ ID NO: 115980 - DNA, 50 bp, homo sapien
gtgaacaccctcatggcccataagargtgataaaatctttcagatatgag

SEQ ID NO: 115981 - DNA, 50 bp, homo sapien
aagattttggttgaagactgaaagawgtgtagaagtctaacccaaacagt

SEQ ID NO: 115982 - DNA, 50 bp, homo sapien
tgcctcagacttgccttctatgtaaygtatcaccgggtagaagaatcatg

SEQ ID NO: 115983 - DNA, 50 bp, homo sapien
tgataagccacagaaataactgactraaacaatgagatagttcatttaaa

SEQ ID NO: 115984 - DNA, 50 bp, homo sapien
cagtttaacagacagaagttgagaaragttccaaaagtaagtgatcaaaa

SEQ ID NO: 115985 - DNA, 50 bp, homo sapien
ttcagaatagctggtactaattagarcgtaaagaatgtggcagaacacaa

SEQ ID NO: 115986 - DNA, 50 bp, homo sapien
caagcatgtaccaataataacttcaraatagctggtactaattagagcgt

SEQ ID NO: 115987 - DNA, 50 bp, homo sapien
gagttgagcttctctccaagctcacragaactagcaaatacagtagcaac

SEQ ID NO: 115988 - DNA, 50 bp, homo sapien
accatatgccaaaagatgtatccacrcttgaagcttcttgaatggccccc

SEQ ID NO: 115989 - DNA, 50 bp, homo sapien
gaattgcttttgcatctttgtaaaasaaatcattagctctttccccatta

SEQ ID NO: 115990 - DNA, 50 bp, homo sapien
tacttaggagtgaaaatggagtgtayataggagatacaaattaatttact

SEQ ID NO: 115991 - DNA, 50 bp, homo sapien
aggttaaatgacttgtctaaggtgamccagctaggaagtgacacagccaa

SEQ ID NO: 115992 - DNA, 50 bp, homo sapien
gtcattggcaatgccaagtaagttakctggtcatgacagcctgttgcaag

SEQ ID NO: 115993 - DNA, 50 bp, homo sapien
cccaaacctatcaccacctgttgggyatagccagagctgttcccacccag

SEQ ID NO: 115994 - DNA, 50 bp, homo sapien
gactgtctacatagtattggtctaargtgttatctacacagtaatgatat

SEQ ID NO: 115995 - DNA, 50 bp, homo sapien
cataaaataagatcacataattactraaaactgtggcactgcacttaagg

SEQ ID NO: 115996 - DNA, 50 bp, homo sapien
gacatttcacaaaacttcttgtaatyaatgtccgtgcttcttttgattga

SEQ ID NO: 115997 - DNA, 50 bp, homo sapien
accacacactaatttctttaatatcraaatcacagtttatttcctgtttc

SEQ ID NO: 115998 - DNA, 50 bp, homo sapien
atagatgtaacattttatttcttacmaatacagcattaaaatataaataa

SEQ ID NO: 115999 - DNA, 50 bp, homo sapien
tgtgccagtggttatatgtcattatmaaaccatgttactagttcccagag

SEQ ID NO: 116000 - DNA, 50 bp, homo sapien
ttggttagtaggtcttaatcactgaraatttgattaaatctgtaggttct

SEQ ID NO: 116001 - DNA, 50 bp, homo sapien
atttgatggaataatcagtgaattcrgaaaagagaaacaataaaatctcc

SEQ ID NO: 116002 - DNA, 50 bp, homo sapien
taaaatatatattgttcatataacastccaatattggtgatctcatttaa

SEQ ID NO: 116003 - DNA, 50 bp, homo sapien
cttctagatgtcacaagtttctagcrcaaaatccataatgactgctctga

SEQ ID NO: 116004 - DNA, 50 bp, homo sapien
ataaatggagaataatgattcttaartaacatcatgcagagacacacagg

SEQ ID NO: 116005 - DNA, 50 bp, homo sapien
gccagggaggacctctgaggaagcartatgtagactgagacctaaagaat

SEQ ID NO: 116006 - DNA, 50 bp, homo sapien
tttgcacaccactcttagaaacccaygtattagcctagacaaggcatcct

SEQ ID NO: 116007 - DNA, 50 bp, homo sapien
agcctggggcatttttgaacagttayacagtaccggatgtgcctttctga

SEQ ID NO: 116008 - DNA, 50 bp, homo sapien
atggccatagcttctgtttatagagyacatccacagtatacataacagca

SEQ ID NO: 116009 - DNA, 50 bp, homo sapien
tcttgtctttaaattaggtgtttgamtatatagcccataaacaatgctcc

SEQ ID NO: 116010 - DNA, 50 bp, homo sapien
tctttaacctccctccgtcacaccarataggaacaaaaccatttcatatc

SEQ ID NO: 116011 - DNA, 50 bp, homo sapien
gttgtgacaagcaactaaatgtttcrcagatttacagaaaggaactgatg

SEQ ID NO: 116012 - DNA, 50 bp, homo sapien
aatgtcgcaaggtactctttcttgawtttaatatacttggtgttctataa

SEQ ID NO: 116013 - DNA, 50 bp, homo sapien
tattcatcgaatacctcatatatacyagccattcaagcacatagtacttg

SEQ ID NO: 116014 - DNA, 50 bp, homo sapien
ttctagagtaagggaaggacatacawctataaaataatggagaagccttt

SEQ ID NO: 116015 - DNA, 50 bp, homo sapien
ttttccttggtaccattatacaaaaycggttgatcataaatgtttggatt

SEQ ID NO: 116016 - DNA, 50 bp, homo sapien
gaatatctaagtgtgaggtgcctccragcataaagagaaaataatttacc

SEQ ID NO: 116017 - DNA, 50 bp, homo sapien
tatcctaactaaaagggcttccaaastttattacaaatcattgtgcagaa

SEQ ID NO: 116018 - DNA, 50 bp, homo sapien
caagaaatgtgcccttgactgagaayagcactactaatagcctgctaggg

SEQ ID NO: 116019 - DNA, 50 bp, homo sapien
ctttgcatgtctacttaattctaacscttaatgaaacacacacacacaca

SEQ ID NO: 116020 - DNA, 50 bp, homo sapien
tatcctgtttttaattctctcatacrggttaatttatcttccttaagaac

SEQ ID NO: 116021 - DNA, 50 bp, homo sapien
ctacacatctgtggatctctaaacasgttaaattgtatgtgtcatgtaag

SEQ ID NO: 116022 - DNA, 50 bp, homo sapien
ttctttgtacttaaagtgactggaayagagccagagtagagccagacaga

SEQ ID NO: 116023 - DNA, 50 bp, homo sapien
acacattttgggtctgtatgtagtcyaacaaggagatatgtaaacagcaa

SEQ ID NO: 116024 - DNA, 50 bp, homo sapien
attctcgatcatttctctgtaaaacyaggtttctagccagggcccatgcc

SEQ ID NO: 116025 - DNA, 50 bp, homo sapien
tttgtacatatttatattttacaccrattacattgtacagtaagtttttg

SEQ ID NO: 116026 - DNA, 50 bp, homo sapien
gccgtggtaaattcacattatcaagracagtggtcaaaatgcactgctgc

SEQ ID NO: 116027 - DNA, 50 bp, homo sapien
aaaggcattgttctccagtgaaaccratacttaagctatatatacaattt

SEQ ID NO: 116028 - DNA, 50 bp, homo sapien
tcaaataagatgaggtgtcaagtccrattatttactctaagtaaattgca

SEQ ID NO: 116029 - DNA, 50 bp, homo sapien
aataaaagacctctcaagctcatcaytgaaattttaagagtcctaaaagt

SEQ ID NO: 116030 - DNA, 50 bp, homo sapien
gaaaaagtgccataatcagatcagamattatgacaacattctagaaaacc

SEQ ID NO: 116031 - DNA, 50 bp, homo sapien
taagcaaacactgtgcctttattaasagctattgattggaactctttttt

SEQ ID NO: 116032 - DNA, 50 bp, homo sapien
gaaatgtcaacttattgaagatctgyagaggaccatgggtaatgtcaccc

SEQ ID NO: 116033 - DNA, 50 bp, homo sapien
atagaatatatggccaagagcaggaytaataaatgaggaaattgtgtata

SEQ ID NO: 116034 - DNA, 50 bp, homo sapien
ctataaaatatcttcatccttaaaamtaagtgttagactagatgactttt

SEQ ID NO: 116035 - DNA, 50 bp, homo sapien
ttcactctattattctccattatcastgaatgctcctccactcaataata

SEQ ID NO: 116036 - DNA, 50 bp, homo sapien
tttcttttaacgagacctactcctayacagctacacttaataatggccac

SEQ ID NO: 116037 - DNA, 50 bp, homo sapien
aagaaagacaaagactctgttaatayatgaatgataaaacaggtatccta

SEQ ID NO: 116038 - DNA, 50 bp, homo sapien
agcagccccttatagcaaatatcgarctatcatgggtaatgttatggtga

SEQ ID NO: 116039 - DNA, 50 bp, homo sapien
gcaacatttgagttaaaagtgttacrgacttcctgagattagcattaatt

SEQ ID NO: 116040 - DNA, 50 bp, homo sapien
ccaaaccacgtaccatggtagtcaawgactttcctatttggctcttggct

SEQ ID NO: 116041 - DNA, 50 bp, homo sapien
cgaatgccacaggccctgcttagtcmtcattagtgcatttcagatattcc

SEQ ID NO: 116042 - DNA, 50 bp, homo sapien
agtcacaagcagcataataatgaaarctatcctgttatgggcactatttg

SEQ ID NO: 116043 - DNA, 50 bp, homo sapien
aaaagcactctttctatttctcttgyctttcggagagtttgataggaata

SEQ ID NO: 116044 - DNA, 50 bp, homo sapien
taaattactgccttatctgcaatccyatgtgtcaggaggcacaactatct

SEQ ID NO: 116045 - DNA, 50 bp, homo sapien
tagtcacagtaaaaacaggtttaatkagtggattcctcatcaaaggctat

SEQ ID NO: 116046 - DNA, 50 bp, homo sapien
ctcactccatcataaaagtctgaaasatgtcttcctgtatatattgttgt

SEQ ID NO: 116047 - DNA, 50 bp, homo sapien
agagaggcggaaagaagattctgtcrcgatccaaaggcaactggttgatg

SEQ ID NO: 116048 - DNA, 50 bp, homo sapien
tgaaggtccccaaatattcttgaacyaagatttctgaaacctatctccat

SEQ ID NO: 116049 - DNA, 50 bp, homo sapien
aaattaagatacgtctagttatacasattgacccagaacccaggcatgtg

SEQ ID NO: 116050 - DNA, 50 bp, homo sapien
tacagacagatctacaatgaaggtaragtaatctaaggacctctagaatg

SEQ ID NO: 116051 - DNA, 50 bp, homo sapien
acctatagattaacataagtttacargacatatcaggtttttttaaatgg

SEQ ID NO: 116052 - DNA, 50 bp, homo sapien
catttctaacagcctataaacataasgaacacacttaggaatgaaactgt

SEQ ID NO: 116053 - DNA, 50 bp, homo sapien
ctgttgttagactatacagaccactmtctacacggaagctggaatatttt

SEQ ID NO: 116054 - DNA, 50 bp, homo sapien
ctatagggcaatcatcgattccgaayaacttgattgaaaaaaaactcatc

SEQ ID NO: 116055 - DNA, 50 bp, homo sapien
aatgcttttgtgaaacacagaacaaraagtttgaaccgttcaatctagac

SEQ ID NO: 116056 - DNA, 50 bp, homo sapien
gaagcacaggggcacacagcttgacractgtatattctcaattgggaggt

SEQ ID NO: 116057 - DNA, 50 bp, homo sapien
gaaaattttttttctaagagattctraaggcaactgaaggttttcatcca

SEQ ID NO: 116058 - DNA, 50 bp, homo sapien
tatatatatcttacaaccttttcagsaatatcaatgctttttacttctac

SEQ ID NO: 116059 - DNA, 50 bp, homo sapien
cacaaggaagtttaattggaagcaasatacaggtcatgagaggacatagc

SEQ ID NO: 116060 - DNA, 50 bp, homo sapien; identical to SEQ ID NO: 115489

SEQ ID NO: 116061 - DNA, 50 bp, homo sapien
gtttctttgaggtttgaagggtcaartggcaattacatgtaggcagttgg

SEQ ID NO: 116062 - DNA, 50 bp, homo sapien
gcttgacacacattaataagaatgcygatgagttggatgtcaactatatt

SEQ ID NO: 116063 - DNA, 50 bp, homo sapien
gattttcgtatcccaaggtcagtaaygaatttgagttttctgtggctgtt

SEQ ID NO: 116064 - DNA, 50 bp, homo sapien
ggaggagagcagacagcataggctamgatattttcagcctattttaggac

SEQ ID NO: 116065 - DNA, 50 bp, homo sapien
gcagaactaataccaatcatattcayactattcagaaaactaaagaagga

SEQ ID NO: 116066 - DNA, 50 bp, homo sapien
gtgccagcaaaaagattcctcatgayagaactgatggatgttaccctcta

SEQ ID NO: 116067 - DNA, 50 bp, homo sapien; identical to SEQ ID NO: 115492

SEQ ID NO: 116068 - DNA, 50 bp, homo sapien
cagccattacttttctgattatggcmaggcattactgggaaaagtctaat

SEQ ID NO: 116069 - DNA, 50 bp, homo sapien
tggtccatttcccttatcatatgaarcgctaatggtagaagaaaagcaaa

SEQ ID NO: 116070 - DNA, 50 bp, homo sapien
gggccagagcaatatctgttaaagtsaatgactcatggcagggtcaacga

SEQ ID NO: 116071 - DNA, 50 bp, homo sapien
caccatagtaaccatcctgagataaytgatgatgaccttgaggatagaag

SEQ ID NO: 116072 - DNA, 50 bp, homo sapien
atatgtatttattgtatgagcttcarcattattgtgcttacttttgacat

SEQ ID NO: 116073 - DNA, 50 bp, homo sapien
tgctaaaaatctgactcatataaacsatggactgtattagtaagtgtcac

SEQ ID NO: 116074 - DNA, 50 bp, homo sapien
aattttcagaggggtctgagtctacygatacacgggttttggcccttccc

SEQ ID NO: 116075 - DNA, 50 bp, homo sapien
ttcgcttctctgagttcagtgttctyaatatatcgtccatttgtttcacc

SEQ ID NO: 116076 - DNA, 50 bp, homo sapien
tctgaggagtatttaaatgtgcataycatataaaacttgtaaataaattt

SEQ ID NO: 116077 - DNA, 50 bp, homo sapien
gaatagatatataaaaatgtttaaamccataataagatacattatttcta

SEQ ID NO: 116078 - DNA, 50 bp, homo sapien
ggaaaattcaggctgatttgaacctraggtatctgcagaggaggaatgag

SEQ ID NO: 116079 - DNA, 50 bp, homo sapien
ctgaaaattttgagcatacatattasaaatctaaggccttttctcaatga

SEQ ID NO: 116080 - DNA, 50 bp, homo sapien
tttctttccctctaaggaaataccamtaatcagtacgttgtgaaatttta

SEQ ID NO: 116081 - DNA, 50 bp, homo sapien
gcatatgctttgttggcatttacctrcttcaaaacatggaaagcttttcc

SEQ ID NO: 116082 - DNA, 50 bp, homo sapien
gcacactgagaacatagatgttacaktcagggaaattttacaaagcaatg

SEQ ID NO: 116083 - DNA, 50 bp, homo sapien
cctattcatatgtaagcccagggaamtagtaattgcagtcttcatgtgtt

SEQ ID NO: 116084 - DNA, 50 bp, homo sapien
cagggattctgtatacagagcctcayagtaaaattgttgatgctttcttg

SEQ ID NO: 116085 - DNA, 50 bp, homo sapien
gtacaaataactgacagtattgagasagttttaggtctagttctttccct

SEQ ID NO: 116086 - DNA, 50 bp, homo sapien
gaagagtcacacatccctatctatamattaaaaactgattaagattagtg

SEQ ID NO: 116087 - DNA, 50 bp, homo sapien
acagtttatggtgattttgaataaakatgctactaaacactcatgaacag

SEQ ID NO: 116088 - DNA, 50 bp, homo sapien
tttcttcacaaggcttcccacagackgtactttatttggtataacttgac

SEQ ID NO: 116089 - DNA, 50 bp, homo sapien
cccactagtgacctgtttggcatggyaatactagagatagctttccctta

SEQ ID NO: 116090 - DNA, 50 bp, homo sapien
tctttggctatgtaatgtcaacttayaaacctctcataataattccttat

SEQ ID NO: 116091 - DNA, 50 bp, homo sapien
atgaaagctatacaccgaatattcargtagagccagattttactttcatt

SEQ ID NO: 116092 - DNA, 50 bp, homo sapien
aatcatgctcttatcctttgtctacraccttgtattagttcattttatgt

SEQ ID NO: 116093 - DNA, 50 bp, homo sapien
tttttttaaataatatttttaaggaygattaggaatataatgaatggtaa

SEQ ID NO: 116094 - DNA, 50 bp, homo sapien
gttcttcttaatcatagcattcttaycgtactgaaattgcccttattgcc

SEQ ID NO: 116095 - DNA, 50 bp, homo sapien
gcccatattttaagatccataaacaytgaaccccttcagtcaaacgatgc

SEQ ID NO: 116096 - DNA, 50 bp, homo sapien
taaacactgaaccccttcagtcaaaygatgcaaagacaccatctgcagag

SEQ ID NO: 116097 - DNA, 50 bp, homo sapien
tttttgttttggtcttctgctttaaygtatctattttgatgcctaggaca

SEQ ID NO: 116098 - DNA, 50 bp, homo sapien
gtaagatgtgtggaggaataaagaaytaaggtcatgaattgagttactct

SEQ ID NO: 116099 - DNA, 50 bp, homo sapien
tcattttcaagaaatcaggttgaaamatgaacttaacacaacagtggtgc

SEQ ID NO: 116100 - DNA, 50 bp, homo sapien
gaaagcttttgactcttaacctctcragttacagtagttaatattcacca

SEQ ID NO: 116101 - DNA, 50 bp, homo sapien
aaacagcttgaaaaaagcatggagaytctaagatccaatccagcggattt

SEQ ID NO: 116102 - DNA, 50 bp, homo sapien
ccattattcatttctctactcattayctttgtcagttactcaattagcat

SEQ ID NO: 116103 - DNA, 50 bp, homo sapien
tgtcatcagttcttaaattggagagrattatttgcatgggcaaaacctaa

SEQ ID NO: 116104 - DNA, 50 bp, homo sapien
tacataattagagatagcctacataktaactcgaaaaattgtgaaaagaa

SEQ ID NO: 116105 - DNA, 50 bp, homo sapien
atgtctgtccatcttctggcagggawtaagatcaactttggagagcatgg

SEQ ID NO: 116106 - DNA, 50 bp, homo sapien
ccaaatgagcaatgagtaatcaagaycaacttgccagtaaacaaccaggc

SEQ ID NO: 116107 - DNA, 50 bp, homo sapien
gtcataaaatgcatttttgcagttcratatctgtgtacctacctacctac

SEQ ID NO: 116108 - DNA, 50 bp, homo sapien
ctgggttgtcttattcctcaggagcygaatgagtctgtcatgtggtatgc

SEQ ID NO: 116109 - DNA, 50 bp, homo sapien
atgcctccccttcaatatgttttatyatcctgtttctgctaaatacacct

SEQ ID NO: 116110 - DNA, 50 bp, homo sapien
agctttttctgcattgaaataatgasgttttatggaatccagaccttgtc

SEQ ID NO: 116111 - DNA, 50 bp, homo sapien
aactttagggatttaatttagattcragtatagataaaccactagtttcc

SEQ ID NO: 116112 - DNA, 50 bp, homo sapien
gtacatgccctccagaggaaatccamtacaaataaatggaatgttcctct

SEQ ID NO: 116113 - DNA, 50 bp, homo sapien
tgtcaggtgatactttttctatacckagtcctattttgaatttgacactg

SEQ ID NO: 116114 - DNA, 50 bp, homo sapien
tgcttaaaaaatatttgttgaatcawaaaggatgaataaattctttttac

SEQ ID NO: 116115 - DNA, 50 bp, homo sapien
atgattgccaattaacagcgtaggayaatgtataaacatgcaaacagata

SEQ ID NO: 116116 - DNA, 50 bp, homo sapien
tttttatttaattttatgagattaaygtaacctctttttgagccctaata

SEQ ID NO: 116117 - DNA, 50 bp, homo sapien
gaatggctttttgtcactatgtggasactcctgtatttcttcctctgccg

SEQ ID NO: 116118 - DNA, 50 bp, homo sapien
gtagagtgagaatcagaattagcaamgttttaaagactgggaactgaggc

SEQ ID NO: 116119 - DNA, 50 bp, homo sapien
aaaatatatccaatgaaatcttacgygtactcagtttgagagtcacagtg

SEQ ID NO: 116120 - DNA, 50 bp, homo sapien
atttcatcttagctgtacctgaaacygaactgtgttcctcttgctttctg

SEQ ID NO: 116121 - DNA, 50 bp, homo sapien
acccaaggccacagggttcacaagcrtcagaggcaggattccaagttctc

SEQ ID NO: 116122 - DNA, 50 bp, homo sapien
gctactggcaaattctttgaagttayagtaatgttagagctagaataaac

SEQ ID NO: 116123 - DNA, 50 bp, homo sapien
tatattatgtttctgattatacacaygttcttgctctttaaaaaaatcaa

SEQ ID NO: 116124 - DNA, 50 bp, homo sapien
gatttttatttgatatattgtacaaytgagaggtgtaatagtgacttgtg

SEQ ID NO: 116125 - DNA, 50 bp, homo sapien
agtattcttccacctggataatgtcycttagtctctaaagacctaacata

SEQ ID NO: 116126 - DNA, 50 bp, homo sapien
aaagtagtctgagagaaatagcagtsaatgtaatttccttaaggacaagg

SEQ ID NO: 116127 - DNA, 50 bp, homo sapien
ctctccctccctttctcttctgttartaaataattgctactactaatgat

SEQ ID NO: 116128 - DNA, 50 bp, homo sapien
agaaatatgaaaattgagaactcagragaagatcagcttctactactgcc

SEQ ID NO: 116129 - DNA, 50 bp, homo sapien
ctttaagtgttgcattacttttatakctgcttcacgtaagtcacctttct

SEQ ID NO: 116130 - DNA, 50 bp, homo sapien
aatctagtgagaaaagcacaagtaasgaaatgcttagaacagagtgtgtt

SEQ ID NO: 116131 - DNA, 50 bp, homo sapien
tccattctccccattctctactccaygcttgtacacatttaaaaagtgat

SEQ ID NO: 116132 - DNA, 50 bp, homo sapien
atcccagagttacttttttcagccckatataagtagcaactaacagtaat

SEQ ID NO: 116133 - DNA, 50 bp, homo sapien
caccatttgccttttgttaggactayggatcttgagaaaagtatgagaca

SEQ ID NO: 116134 - DNA, 50 bp, homo sapien
atgccgaggttctttatgagcaaaargtggaattactcagaaactcattc

SEQ ID NO: 116135 - DNA, 50 bp, homo sapien
agtgatagcagatgtgaattctacaracccttgttgtggttactcttagt

SEQ ID NO: 116136 - DNA, 50 bp, homo sapien
actaaccaatttctggtctttaggartatgaaagcgaccttccttgctcc

SEQ ID NO: 116137 - DNA, 50 bp, homo sapien
ctttaaagaagttcaggaaattagaygagaaactctgatcctgttgcttt

SEQ ID NO: 116138 - DNA, 50 bp, homo sapien
ggtagctgcatcttaatcttaagtawccatatcattaaaaaggtgaaata

SEQ ID NO: 116139 - DNA, 50 bp, homo sapien
ggttgcctatgcagtaggtacggagraagtttcactcctgctttgcctga

SEQ ID NO: 116140 - DNA, 50 bp, homo sapien
accccaacagagactgctaattagakgaatcctgcgttagacagaaacag

SEQ ID NO: 116141 - DNA, 50 bp, homo sapien
cattgtcaagggaataaggcagtcasgagtttaaatactggctctgccgt

SEQ ID NO: 116142 - DNA, 50 bp, homo sapien
gtgtgagtgcttcatgtttttattcratcaagatctctattcttgattta

SEQ ID NO: 116143 - DNA, 50 bp, homo sapien
actccaagaaatgattgaaacttccrgatttagtgatttaattcaagtac

SEQ ID NO: 116144 - DNA, 50 bp, homo sapien
ctccagtgttccttcagttcaatcayctgcgaactgctactattattgtt

SEQ ID NO: 116145 - DNA, 50 bp, homo sapien
ctgtctcctttgttctaggttgacartatattttgctaaagcaatcaaga

SEQ ID NO: 116146 - DNA, 50 bp, homo sapien
ttggatattaacctcttacctgatayatggtttgtgaatatttttcccag

SEQ ID NO: 116147 - DNA, 50 bp, homo sapien
agatggtacaaggttgaactatgcartgatgagtgtttcatgtgatatta

SEQ ID NO: 116148 - DNA, 50 bp, homo sapien
ggaatgttttcaaagcttcccatgtkatttgagtgtgcatgcagccagag

SEQ ID NO: 116149 - DNA, 50 bp, homo sapien
gtcacttatatatcaaggcaaaagaytagagagtgacataaaaatgtgag

SEQ ID NO: 116150 - DNA, 50 bp, homo sapien
catactcctgaatgtagacaattgayaatgaacgtaattacaaactattc

SEQ ID NO: 116151 - DNA, 50 bp, homo sapien
gcagtggcaaggtacagagaacatcrctgagcaccgggaaagggagaata

SEQ ID NO: 116152 - DNA, 50 bp, homo sapien
aaaaatcttaattcctatgaggaccrctttataatttccaagtcatttta

SEQ ID NO: 116153 - DNA, 50 bp, homo sapien
gttgtcttccaatactcaattaacaytacttccacagttaactgtagtca

SEQ ID NO: 116154 - DNA, 50 bp, homo sapien
gcagaatctatcaagcagaagaacgmatgagcgagcttgaagacaggcta

SEQ ID NO: 116155 - DNA, 50 bp, homo sapien
aaagacaaagacacatggagaataaytaatcatttagttttaaaaactct

SEQ ID NO: 116156 - DNA, 50 bp, homo sapien
tgaatgaatgattctcccaagtctamcttgtttcatgttcacttttcccc

SEQ ID NO: 116157 - DNA, 50 bp, homo sapien
agtttattcaagactatttgcaacartaaaataatttgtgtctacacata

SEQ ID NO: 116158 - DNA, 50 bp, homo sapien
atcttatccaaggcctgctgtaatcrctcactggctactgcctatgtttg

SEQ ID NO: 116159 - DNA, 50 bp, homo sapien
aatttcaagctattgctcccatctgsgcactttgagcttctcatgctata

SEQ ID NO: 116160 - DNA, 50 bp, homo sapien
gacacaagctgcaatatgttcgatakagatccttgataatttaacacaga

SEQ ID NO: 116161 - DNA, 50 bp, homo sapien
aatgtgttaaccaccaaacctgatckcaggctcgtgttaacactaccttg

SEQ ID NO: 116162 - DNA, 50 bp, homo sapien
ctcattctataacatggtaagagaakgcgaatcataaatcttattagtaa

SEQ ID NO: 116163 - DNA, 50 bp, homo sapien
ttctattgtcatatatggtctgaccrttgtctgtttgtatattcgatttc

SEQ ID NO: 116164 - DNA, 50 bp, homo sapien
acaactcgctgctacttggtgcaatrtcttatacaaagctctgatacacc

SEQ ID NO: 116165 - DNA, 50 bp, homo sapien
aaaagaggttctcttcaaaaggagaraaaacaatagttgagaaacttcta

SEQ ID NO: 116166 - DNA, 50 bp, homo sapien
aacttatagaaaatgtgtctatgatyaggaatgtaagcactctttgagtg

SEQ ID NO: 116167 - DNA, 50 bp, homo sapien
tgtttagtatgtaaaggaagctgcayaagtgatagatagggttaatcttc

SEQ ID NO: 116168 - DNA, 50 bp, homo sapien
aaacataaaagctgatcccttcaacrcacctattagtgtcatgccatggt

SEQ ID NO: 116169 - DNA, 50 bp, homo sapien
ctcaaaaagtgtctcttcagaatcamtatcgtcattaccttggatgtgtg

SEQ ID NO: 116170 - DNA, 50 bp, homo sapien
agtttctagacctgctctattagacyagttgtatatatggttcttttatt

SEQ ID NO: 116171 - DNA, 50 bp, homo sapien
aaaattttctgtcaactgacttggasaccaaacaagtagatgattgaatt

SEQ ID NO: 116172 - DNA, 50 bp, homo sapien
aagttagttaaattaacaatctaaamttgaacctacaggaactagaacaa

SEQ ID NO: 116173 - DNA, 50 bp, homo sapien
ctaatagagaccattctcctgaacaktaaaaattggatccaggccagata

SEQ ID NO: 116174 - DNA, 50 bp, homo sapien
aaaattccaatgcctaagcctgacawtcatggccttctgcaatctgttcc

SEQ ID NO: 116175 - DNA, 50 bp, homo sapien
ctgtcacatagtaggatcttaataartgataaattaaacataaagcaata

SEQ ID NO: 116176 - DNA, 50 bp, homo sapien
tgcagtgaaaaacaggactatgatartaactaggcactgtagatgaggca

SEQ ID NO: 116177 - DNA, 50 bp, homo sapien
taaaaagtatttttctgatccttacmctcaacatgggataatattggctt

SEQ ID NO: 116178 - DNA, 50 bp, homo sapien
ctaagatgttgctaggcttaagaaaygtagcatctttaaaaaatataccg

SEQ ID NO: 116179 - DNA, 50 bp, homo sapien
tcttgaatcctcttcttcctcatcartgagcacacgtccagtggtttcgc

SEQ ID NO: 116180 - DNA, 50 bp, homo sapien
tatactcagaatgtagaaaaatatayggttggaaggaagaaattggaagt

SEQ ID NO: 116181 - DNA, 50 bp, homo sapien
taacatgctttgagaaagtaacaaargtccttctgttattcttgaaagag

SEQ ID NO: 116182 - DNA, 50 bp, homo sapien
tagtacttctatcgcctaaggcagaygttccaaaactccagtcgcgctag

SEQ ID NO: 116183 - DNA, 50 bp, homo sapien
aagttggctatataagtatggtaccmagaagaaatatctgcatgagaaat

SEQ ID NO: 116184 - DNA, 50 bp, homo sapien
ctggaagataaaagcaccagctaaakacgtagacagtgctcccagtcccg

SEQ ID NO: 116185 - DNA, 50 bp, homo sapien
agaagtctctggtggtgaccaaacayataggaaaagttaattcctagaag

SEQ ID NO: 116186 - DNA, 50 bp, homo sapien
gagagttattttttcatatgtttacyaaaatacgtgtacaaaaatgctca

SEQ ID NO: 116187 - DNA, 50 bp, homo sapien
ataagagttaagcagaactgcgattsaaacagtgagtcgacatttcaaaa

SEQ ID NO: 116188 - DNA, 50 bp, homo sapien
agctatatccaggtactatatcaaayatcttggtgagcctctgagatttg

SEQ ID NO: 116189 - DNA, 50 bp, homo sapien
tcttttctaagatcaaacaataataygcaatgtctgactagagagtaggg

SEQ ID NO: 116190 - DNA, 50 bp, homo sapien
acttgcatctgtactgagactaaacygtgactatattaacctgatggaat

SEQ ID NO: 116191 - DNA, 50 bp, homo sapien
gataaccactaaaaccacgtcagtarataaagattggctttttaaaaatt

SEQ ID NO: 116192 - DNA, 50 bp, homo sapien
gcagaaaattctatttcagtcactamtggggcttcatcccaagatcatgc

SEQ ID NO: 116193 - DNA, 50 bp, homo sapien
gatgggaactagcctggtatgtttarggaagagaaagatagtagtaagaa

SEQ ID NO: 116194 - DNA, 50 bp, homo sapien
ttttggtgcatatcttgtacatggargtttgagatttaattggcagtatt

SEQ ID NO: 116195 - DNA, 50 bp, homo sapien
gggaatagtggtgatagtctgactgkaatccccatgggcctgtggtcgtg

SEQ ID NO: 116196 - DNA, 50 bp, homo sapien
tctggtaagaacagtgggtctctcaytcactgccttgaaagatgaaagcc

SEQ ID NO: 116197 - DNA, 50 bp, homo sapien
acttgggtaaatgaagaacagaatayggcactagatttcctcacctgtaa

SEQ ID NO: 116198 - DNA, 50 bp, homo sapien
tgtttagtatctactacatataaagygctctggaaggtagaaggagaaga

SEQ ID NO: 116199 - DNA, 50 bp, homo sapien
ggcagcattggtattgacagtcctamagaaatgcacttgtatgcacagac

SEQ ID NO: 116200 - DNA, 50 bp, homo sapien
ctggccctggtcctttccttttgaarttcctaggtaagcagccaactcct

SEQ ID NO: 116201 - DNA, 50 bp, homo sapien
caggtaacaaatcttataaagtagcraaaaaacctgacaggaaacagtag

SEQ ID NO: 116202 - DNA, 50 bp, homo sapien
tactggtggaactaataccagataaycctagaagactctaccagggtggt

SEQ ID NO: 116203 - DNA, 50 bp, homo sapien
tgcttgggacagctcagtcttaatarcagtggagtaggggcccaaaaacc

SEQ ID NO: 116204 - DNA, 50 bp, homo sapien
gaacaaaaatatgatacagatcacasatgacagagcaagcattaaaacag

SEQ ID NO: 116205 - DNA, 50 bp, homo sapien
gattctcaagtatctatttaaggagyccatcacaaaagtggaaatgttca

SEQ ID NO: 116206 - DNA, 50 bp, homo sapien
atatgtattcccccactagagaccamgcatctggaaatggtgcttgtctc

SEQ ID NO: 116207 - DNA, 50 bp, homo sapien
aaggagggtgacataatttatggaamcatgaaggaagaatgaggtttttt

SEQ ID NO: 116208 - DNA, 50 bp, homo sapien
tccttgcaaatgatgactagttgatmagtgaaaagagtttagagaattga

SEQ ID NO: 116209 - DNA, 50 bp, homo sapien
ggtcctttatcactgtgagcctccaygactcagttattaattaattggaa

SEQ ID NO: 116210 - DNA, 50 bp, homo sapien
ttctctcatggccatggtaatgagaycagagcgaaggtgactgcatccta

SEQ ID NO: 116211 - DNA, 50 bp, homo sapien
gatcaaatagttaaataactctgaascacatctttttaaacttttctgtc

SEQ ID NO: 116212 - DNA, 25 bp, homo sapien
tcatttaacatttgtgttaacaaaa

SEQ ID NO: 116213 - DNA, 25 bp, homo sapien
tcatttaacattagtgttaacaaaa

SEQ ID NO: 116214 - DNA, 25 bp, homo sapien
atttaacatttgtgttaacaaaaac

SEQ ID NO: 116215 - DNA, 25 bp, homo sapien
atttaacatttgagttaacaaaaac

SEQ ID NO: 116216 - DNA, 25 bp, homo sapien
tttaacatttgtgttaacaaaaact

SEQ ID NO: 116217 - DNA, 25 bp, homo sapien
tttaacatttgtcttaacaaaaact

SEQ ID NO: 116218 - DNA, 25 bp, homo sapien
ttaacatttgtgttaacaaaaactc

SEQ ID NO: 116219 - DNA, 25 bp, homo sapien
ttaacatttgtgataacaaaaactc

SEQ ID NO: 116220 - DNA, 25 bp, homo sapien
taacatttgtgttaacaaaaactcc

SEQ ID NO: 116221 - DNA, 25 bp, homo sapien
taacatttgtgtaaacaaaaactcc

SEQ ID NO: 116222 - DNA, 25 bp, homo sapien
catttgtgttaacaaaaactcctcc

SEQ ID NO: 116223 - DNA, 25 bp, homo sapien
catttgtgttaagaaaaactcctcc

SEQ ID NO: 116224 - DNA, 25 bp, homo sapien
tcatttaacatttgtgctaacaaaa

SEQ ID NO: 116225 - DNA, 25 bp, homo sapien
tcatttaacattagtgctaacaaaa

SEQ ID NO: 116226 - DNA, 25 bp, homo sapien
atttaacatttgtgctaacaaaaac

SEQ ID NO: 116227 - DNA, 25 bp, homo sapien
atttaacatttgagctaacaaaaac

SEQ ID NO: 116228 - DNA, 25 bp, homo sapien
tttaacatttgtgctaacaaaaact

SEQ ID NO: 116229 - DNA, 25 bp, homo sapien
tttaacatttgtcctaacaaaaact

SEQ ID NO: 116230 - DNA, 25 bp, homo sapien
ttaacatttgtgctaacaaaaactc

SEQ ID NO: 116231 - DNA, 25 bp, homo sapien
ttaacatttgtggtaacaaaaactc

SEQ ID NO: 116232 - DNA, 25 bp, homo sapien
taacatttgtgctaacaaaaactcc

SEQ ID NO: 116233 - DNA, 25 bp, homo sapien
taacatttgtgcaaacaaaaactcc

SEQ ID NO: 116234 - DNA, 25 bp, homo sapien
catttgtgctaacaaaaactcctcc

SEQ ID NO: 116235 - DNA, 25 bp, homo sapien
catttgtgctaagaaaaactcctcc

SEQ ID NO: 116236 - DNA, 25 bp, homo sapien
ttttgttaacacaaatgttaaatga

SEQ ID NO: 116237 - DNA, 25 bp, homo sapien
ttttgttaacactaatgttaaatga

SEQ ID NO: 116238 - DNA, 25 bp, homo sapien
gtttttgttaacacaaatgttaaat

SEQ ID NO: 116239 - DNA, 25 bp, homo sapien
gtttttgttaactcaaatgttaaat

SEQ ID NO: 116240 - DNA, 25 bp, homo sapien
agtttttgttaacacaaatgttaaa

SEQ ID NO: 116241 - DNA, 25 bp, homo sapien
agtttttgttaagacaaatgttaaa

SEQ ID NO: 116242 - DNA, 25 bp, homo sapien
gagtttttgttaacacaaatgttaa

SEQ ID NO: 116243 - DNA, 25 bp, homo sapien
gagtttttgttatcacaaatgttaa

SEQ ID NO: 116244 - DNA, 25 bp, homo sapien
ttttgttagcacaaatgttaaatga

SEQ ID NO: 116245 - DNA, 25 bp, homo sapien
ttttgttagcactaatgttaaatga

SEQ ID NO: 116246 - DNA, 25 bp, homo sapien
gtttttgttagcacaaatgttaaat

SEQ ID NO: 116247 - DNA, 25 bp, homo sapien
gtttttgttagctcaaatgttaaat

SEQ ID NO: 116248 - DNA, 25 bp, homo sapien
agtttttgttagcacaaatgttaaa

SEQ ID NO: 116249 - DNA, 25 bp, homo sapien
agtttttgttaggacaaatgttaaa

SEQ ID NO: 116250 - DNA, 25 bp, homo sapien
gagtttttgttagcacaaatgttaa

SEQ ID NO: 116251 - DNA, 25 bp, homo sapien
gagtttttgttaccacaaatgttaa
